United States Patent 7,745,391 (HUMAN THROMBOSPONDIN POLYPEPTIDE) - sequence listing, part 234

SEQ ID NO: 629455 - DNA, 254 bp, Homo sapiens
tcagagtcatctcttgagttcgagaccagcctggccaacatggggaaaccctgtctctactaaaaatacaaacattagccgggcgtggtggtgcatgcctatagtcccagctactcaggaggctgaagcaggagaattgcttgaacctgggagacagaggctgcagtgagccaagatctgaccactgcactccagcctgggtgacagagcacgactccatctcagatcgctttgctgatcgtgatatgaactcc

SEQ ID NO: 629456 - DNA, 223 bp, Homo sapiens
ctcgcgaacgttgttccgtgattgttggatgaaatgttctgtacatatctgttaagtccatttgttccaaggtatagtttaaatccattgtttctttgactttctatcttgatgacctgtctagtactgtcagtgtagtactgaagtcccccactattattgtgttgctgtctatctcatttcttaggtctattggtaatatgttggataacacgttcgcgag

SEQ ID NO: 629457 - DNA, 2238 bp, Homo sapiens
aagagccctgacttcccttgttttccccccttgcgcccaacgtgcgtccgctcccccgccgagcgcggagtcgcctcagttgcccaggcctctatctgcatggagggccgggccgccgtgaccagatctgcgcacggggtacggacgtgcccgggcagatgggggcctacggggtgacaccgaggccgggacagcttcaggggccccagaaggacctgacccagaaattgaggtccccgctgccttctgaggagggggaggagttgctcctaggtctgaaccccgccagccttgccccgtaggaagctggagtgcgggcctcgtccacccacagaccccggggagcgcagggaaaagggtgcttcggtcgttccgatggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacattgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacacacaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacggaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtca

SEQ ID NO: 629458 - DNA, 265 bp, Homo sapiens
ggggtggtggggcccccccccccgccttttcgggggtgaccaggggggggggggccaagcgcccctcccaggggggggcaggggggcgggcccttttcccccccccgttaaaagggttttttcctggggtgggggggggtcccccccccaaagggggggggctttttttttttgggggtttttgttccccgggggggggggggcccccccccccttggggttccctttttttcgccccgaaaaaaggccccccgggttgggttta

SEQ ID NO: 629459 - DNA, 802 bp, Homo sapiens
  misc_feature (29)..(29): n is a, c, g, or t
  misc_feature (97)..(97): n is a, c, g, or t
  misc_feature (107)..(107): n is a, c, g, or t
  misc_feature (111)..(111): n is a, c, g, or t
  misc_feature (117)..(117): n is a, c, g, or t
  misc_feature (126)..(126): n is a, c, g, or t
  misc_feature (162)..(162): n is a, c, g, or t
  misc_feature (166)..(166): n is a, c, g, or t
  misc_feature (191)..(191): n is a, c, g, or t
  misc_feature (194)..(194): n is a, c, g, or t
  misc_feature (206)..(206): n is a, c, g, or t
  misc_feature (233)..(233): n is a, c, g, or t
  misc_feature (256)..(256): n is a, c, g, or t
  misc_feature (269)..(269): n is a, c, g, or t
  misc_feature (273)..(273): n is a, c, g, or t
  misc_feature (278)..(278): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (296)..(296): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (312)..(312): n is a, c, g, or t
  misc_feature (320)..(320): n is a, c, g, or t
  misc_feature (325)..(325): n is a, c, g, or t
  misc_feature (336)..(336): n is a, c, g, or t
  misc_feature (339)..(339): n is a, c, g, or t
  misc_feature (346)..(346): n is a, c, g, or t
  misc_feature (349)..(349): n is a, c, g, or t
  misc_feature (351)..(351): n is a, c, g, or t
  misc_feature (356)..(356): n is a, c, g, or t
  misc_feature (360)..(360): n is a, c, g, or t
  misc_feature (362)..(363): n is a, c, g, or t
  misc_feature (366)..(366): n is a, c, g, or t
  misc_feature (368)..(368): n is a, c, g, or t
  misc_feature (372)..(372): n is a, c, g, or t
  misc_feature (383)..(383): n is a, c, g, or t
  misc_feature (386)..(386): n is a, c, g, or t
  misc_feature (389)..(389): n is a, c, g, or t
  misc_feature (391)..(391): n is a, c, g, or t
  misc_feature (393)..(393): n is a, c, g, or t
  misc_feature (401)..(401): n is a, c, g, or t
  misc_feature (409)..(409): n is a, c, g, or t
  misc_feature (413)..(413): n is a, c, g, or t
  misc_feature (450)..(450): n is a, c, g, or t
  misc_feature (455)..(456): n is a, c, g, or t
  misc_feature (458)..(458): n is a, c, g, or t
  misc_feature (466)..(466): n is a, c, g, or t
  misc_feature (474)..(474): n is a, c, g, or t
  misc_feature (490)..(490): n is a, c, g, or t
  misc_feature (506)..(506): n is a, c, g, or t
  misc_feature (516)..(516): n is a, c, g, or t
  misc_feature (531)..(531): n is a, c, g, or t
  misc_feature (538)..(538): n is a, c, g, or t
  misc_feature (543)..(543): n is a, c, g, or t
  misc_feature (566)..(566): n is a, c, g, or t
  misc_feature (579)..(579): n is a, c, g, or t
  misc_feature (584)..(584): n is a, c, g, or t
  misc_feature (586)..(586): n is a, c, g, or t
  misc_feature (592)..(592): n is a, c, g, or t
  misc_feature (683)..(683): n is a, c, g, or t
  misc_feature (802)..(802): n is a, c, g, or t
ttcccgagggtttctgcccaacgcctccnggcgctcgggacaacactgtgtagcattgatactggaatgatataaataaagctttggtgtgtaggtntgcaggaganagtncaggtnaacactgtnatacgaaaacttcagacaacaccagccctcaatgtnaatngggtttttggccaaggggggaactnctnagctccactggncactggcgcccgctcgccatggctacncgaggcaccagctccgcacgcgngcgagggcagtcnaggnctgangcnccncntcgcgccctnctcgccncncctncanctcccgcnccccncccttcccctnccncacagcnctncncctcntccncnnccncnggcnccacccccccngcncancncngcgacccncctccccncccncagcgacaccgccaggctcaagcacagcgcactcccngcccnncnccccttcncacacccntccacaacacgcgtcngcgtccaccaacaccncgatctccangcgcactcatccccncgctccnagcgncacccgccccgagatcggtgatngacgcagcctttntctgnancttgtnatgaaaattaatgtgcgttcacggaagctgtcacgatgttggtcttgcagtggcgtgcagccacgagtcccggcgacctcatccatgagcntcatggtcacacctccgtgcacaaagccgtgcagggtgcagtgtgaaggccccaccaggtggatcaagctggactggctgtcgctgaaagtctacggctctgggttgaggactggctgn

SEQ ID NO: 629460 - DNA, 1815 bp, Homo sapiens
ttgctccacctatcatgttttattgcctttgggtgtctcgatcacctgccttccttacgctgtactcatttaatgggcccataacaggtaccgacaatgggtcacaaacgacgggctggaggcccagggtttcctaaatgtctccctaacccaccacaaacagactccatgacaccaccctggctagagtatgatggcggggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacattgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatttaacgcgggctgcgtcggtcccggacttttctaatttattaaaaacatggccttggcagttatttttccatcaccgagagagagagacagagagagaaaataaactacccctcctattcagaagtttatagtttatggagatggatgacataaaaatgtaaacatctccacacacacaaaaaaatgtcttaaccaaccgaaaagaaaaattaaaaaaggatttgtattaaatcttattctgtatatttaatgtagcatttttgtatttaaattgataattcaatatctttgaagtaaattatgaaatcaagacacctgtacaggcatttaatgtttttttgtaatataaatatatacatttgtgtttcccccaaaactgtttcatagttaaaaaatacaagtttaatttaattttttacacctattgattctgctgggtatgagctaaagtattacggaaaggaaacaggttatactcttagatttaaaaagtgaaagaaactgcaggcgcctttgtaaaatgcaaaatatttaattaaaagagattttaacataatgagagccactcattactttttagaagcctcaataaactgtccattgccttggtca

SEQ ID NO: 629461 - DNA, 148 bp, Homo sapiens
  misc_feature (24)..(24): n is a, c, g, or t
  misc_feature (39)..(39): n is a, c, g, or t
aggggggggcccccccaaaccccnaggccccggaaaccnacggggggggcggcaggcagggctccttcaacagtaaacccccccttttggcaacaaaactgtgcggggacatgatttttgtaacggccttgggccgctccccccccct

SEQ ID NO: 629462 - DNA, 1773 bp, Homo sapiens
aagagccctgacttcccttgttttccccccttgcgcccaacgtgcgtccgctcccccgccgagcgcggagtcgcctcagttgcccaggcctctatctgcatggagggccgggccgccgtgaccagatctgcgcacggggtacggacgtgcccgggcagatgggggcctacggggtgacaccgaggccgggacagcttcaggggccccagaaggacctgacccagaaattgaggtccccgctgccttctgaggagggggaggagttgctcctaggtctgaaccccgccagccttgccccgtaggaagctggagtgcgggcctcgtccacccacagaccccggggagcgcagggaaaagggtgcttcggtcgttccgatggcagtggagaccacggtccacactcacctctctgcgtctccaccgcagggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgaccactggtgcgcccaactgaacaaacggtggggacggagaacggacagtgcacgagtggaggagaggagtgactcactagtgctgcctaactgctgacaccaaagtgtactgaacaacgttcaccacacccacccttaagtggtttatacaaagtcactcaagcagttatgagtctttcaaaagctgcaccatgtatggcgtagattttctaggaagtgtccatcagacattacccattgacacttcccatgcctgatcatcagagcattagccttgtgacactgaccttctacctgtaaattctctacaacaaaacggacattccttatctttggaacacttcgaaaaggttgttaaaccttcccttacaaggttctctatccttggaccttcaacaccacaaggcacaacaaattaagcgcatcacagcagatacaataaaccgtgtagcgtgcacaaggcccgttgatgagagaatttacacttacgactaataacgtatgatccacattgatgagtaaaaacggtatttaaccagttaacccctaaacgtttccacatccttctaagacaattggtggcagagatcaccaaacgagaaaaggcccttaacttctgccttgcccacagtacataggccgcctaacaacaaccttcaaagtaacacattaacaagtgcagtggggctggaccgcctacagagtcaaatcattttgggttgcacagttacataagtgacagtacttaaacaggagaaagggcgaagtatggtaagaatattgtagagaaatcaggagataaaacacaaacttgaccaccccttgagattatatataacaaaagatatgaaggaaaactagaagaattccaaagaaaaaattcaaggggcaagagagtgaaacgtatagtgaaattataaccgtttgtggagtattgggagaacttgtaataggaatgaaagaaggagaaaggaagtacagtgtaaaaacagtgtggttggagttatggcagaggtgacttgtgtgtggacagacagaaggcaagatagatgaacaagagggaa

SEQ ID NO: 629463 - DNA, 331 bp, Homo sapiens
cgagttgcaagatgagggaatctggaggcaacagtagagataaagaattagccaggtgcagtggctcacacctgtaatcccagcactttgggaggccaaggtgggtggatcacttgaggtcaggagtttgagaccagcctggccaacatggtgaaaccccatctctactaaaaatacaaaaattagctgggtgtggtggcgggcgcctgtaatcctagctacctaggaggctgaggcaggagaatcgcttgaaccaggaggtggaggttgcagtgaaccaagattgtgccactgcactccagcctcggcaataagagcaaaactccatctc

SEQ ID NO: 629464 - DNA, 739 bp, Homo sapiens
ggataacgtcatatagcatcttgttggtttttccttactctctatgtacatatctatctactgtctgactgtagatgggctatatagatagatgccaagcttcttatgttctgggggtagtatgcatcattattgggtctctgccttaaaacgacatcaagaattcattttgagacaaagaaaacttctgctttgtcattgaggtcattagggagctctaatgtgtgtttgtggctccgagttacattatgtgtcttcattgatctatatgtatatatgtgatgtccatcatatatataactgtgtgtgtgtgtaaatgatggtatcatcaggactgacacccaatttgacacttttgtatctagaagaccctccaaaaaaaggaaccacataagcacacaagaaaaagagtgctatgatgttcttagcatttgctaatcatgcctatttttatctagattgtgtaaatgtagctaggtcataacaaaatttggaattacgagtgtgggctggataatgagaagaaaaagtatttggacatggtcccgagtgatgaaccgcagagactcgatgaaccttgagacatagcattgcttcgtgcactttcgaatgaccaagtcatgtgtttctggtgactgacttatgtgtcaccgttgcattcgatgttcagcatcctgatgtcaagtatatcgggggtgtgcccagccaagtaaagcctctggactaatcggtacgaaag

SEQ ID NO: 629465 - DNA, 230 bp, Homo sapiens
cccgggaggggggccctttgggcataaagaaacctttgaaaattttttggtttaggggtgggaagaccgggtttcccagttttggtttttgttggttggcccccctggggtccccccaaaaaccccttttttttgggttttggggcctttttaatggggggccaaagggggccaataaagggggggaggaattttttttttgggtaatattggttggttttgaatttcca

SEQ ID NO: 629466 - DNA, 254 bp, Homo sapiens
tttcccagggttttgggggaaaaaacccccccccccccccccttttgggattttttttgtttttcggccggccccgccttatcgaaaattgttttgggtaaagaaggtccccgttgttttggggggtaccccgggggggggcctaaaattggggtttttttttggggggggaaaagggaaccccttcccccttgggaagggtttttccaaaggcccttttttttaattttttttacccctttttttttccccca

SEQ ID NO: 629467 - DNA, 137 bp, Homo sapiens
tctgtactggtgcaggaggaggccatgaaggagaacaccgccgccgtgcttgtgcaggtgccggtcgaggtcacctcgttccctcctcaacgaaaagcgcaccgagatcaccaagatcgagctcaagcagcgcgtga

SEQ ID NO: 629468 - DNA, 811 bp, Homo sapiens
  misc_feature (255)..(255): n is a, c, g, or t
tcacagctggggggtttccccttttttgacctcctcctctttaaagctacaaaaaccacctcccttttttacaggaccggcatctttttaaggttgggggtgtttctccccagcctctcttcaggagggggggaagggtgggagtgtgcatctggtgaactctcctttctcctttcttctcctttctttggccgccgcttttcccatcctggcgtgtagacttctggattggtgcacgtcggtggtcacatccangtgataggtgttgggtttctgtgccccttttctggactggcccagggtcgctcagaaccccagaaatcccttccttacacaaccttcttttggggggggagtgggaaagggactgaaatgggggggggaagggtgaggagggcgccatcaataaaggagggaaacccccaggtctgaaaaaaacaacaacaaaaaaaaacacacacacaaaaaaaaacaagaacacagcaagcaaaaacaaccaaaccacgcacacaacaacaagaacaaaagaaaaaggcaacaacaaagaacaaacaaaacaacaaccaacaaagacaaaacaaagcggagccaggccacaaaccacacgaagaaaaagaagaaaagcgggcgccaacgacaagaaaaaataactgcgacgcagcagcgtgcacaaggaccaacaaagcagccgatcttacagagcgcagaggacacagagcagagagcgagtatacagagaaccgcgacagcgccggacacacaccacaacgccgcacacccggaagccaacatagaaagaaggaagcagcac

SEQ ID NO: 629469 - DNA, 691 bp, Homo sapiens
tcccttgatgacttccgatccctttgggcacgtactgctaatttcatggtacatgcagtggctactcatactggctatccatatggttttcagactttatcttcacagaagccaccgtgctcactattcctttaattaaggagaaatgctggcatagagcagcactaatatgtactccactgaagttcacgatcagacagatctggcatgtgtagcgttatagaagataactggcctcattctcttcaacaatatcaagtgttgggaaagtaaagaaaggaagtggaatggcttactcgttcttgattaaaagttatgtaataagccttattgcttatgtgtataatattgttacatggactgctattttgaaataccatctgtacaagatctggggtggtgggtgggaggccagcacggtggtgaggacagttgagaaaatttgaatgtggattagattttgaatgatattggataattattggtaattttatgagctgtgagtaagggtgttgtaggtttataaatagactgtcttaatttgcatacttaagcatttaggaatgaagtgttagagtgtcttaaaatgtttcaaatggtttaactaaaatgtatgtgaggcgtatgtggcaaaatgttacagaatctaactggtgtacatggctgattaaccgcccggggtttttctatc

SEQ ID NO: 629470 - DNA, 354 bp, Homo sapiens
  misc_feature (36)..(36): n is a, c, g, or t
  misc_feature (106)..(107): n is a, c, g, or t
  misc_feature (117)..(117): n is a, c, g, or t
  misc_feature (182)..(182): n is a, c, g, or t
  misc_feature (188)..(188): n is a, c, g, or t
  misc_feature (222)..(222): n is a, c, g, or t
  misc_feature (245)..(245): n is a, c, g, or t
  misc_feature (286)..(286): n is a, c, g, or t
  misc_feature (311)..(311): n is a, c, g, or t
ccggcttccacttctgcgggggctccctcatcagcnaggactgggtggtcaccgctgcccactgcggggtcaggacctccgacgtggtcgtggctggggagtttanncagggctctnacgaggagaacatccaggtcctgaagatcgccaaggtcttcaagaaccccaagttcagcattctnaccgtnaacaatgacatcaccctgctgaagctggccacantggcccgcttctcccagacagtntccgccgtgtgcctgcccagcgccgacgacgacttccccgnggggacactgtgtgccaccacaggnttggggcaagaccaagtacaacggcaacaagacccctgacaag

SEQ ID NO: 629471 - DNA, 680 bp, Homo sapiens
agcctcgcctttgcctgatcctgccgcccgtccacaccctgccgccagctcaccatggatgatgatatctgcctgcgctcgtcgtcgacaactggctccgtgcatgtgcaatggccttgcttcgctgggcgactgatgcccccctgtggcctgtcttcccctccatctgtgggtgcgccccagtgcaccatgggcgtgatgtgtggtgcattgggtcagaatgtgattcctatgtggtgcgacgatggcccagagcaatgagatggcatcctcacccatgaagtaccccatcgatgcactggcatctgtcaccgaacatgggactgacatggatgaaaatctggcaccagcaccttctacaatgagcttgctgtgtggctccctgaggagcaccccgttgctgctgacctgaggcccccctgaagccccaatggccaaccgcgagaaggatgacccagatcatgtttgagaccttcaaacaccccagccatgtacgttgctatccatggctgtgctatcccttgtacgcctcttggccagtaccactaggcatcgttgatggactccggtgacgggggtcacccaacacttgtgctcatctacgaggggtatgcccctcccccatgcatcctgcgatctggacctggttgcgggacctgatgactactcatgaagatctc

SEQ ID NO: 629472 - DNA, 869 bp, Homo sapiens
gatagcatgagttttagtctgttcttttaaaaaataagttttctctttgttctttggaagacttttaagaaagaataaaagtaatgacatctcaatcctaacaagtaactagaactgctaaaaaaaaaaaaaaaagggcacctgaaaagtttaaaattttctctcttaaaagttagctccctggttaaaggcagaatttttaacttcaacttaacaacttgtggctgccatctaagtccagagtactaggtgctctaggacccttacccttgcgaggcagtgggtcctcaaagtgtggcccccagataaattagcatcagcaatccatttaagaatttggttgaaatttcaaattcctagagctccaccccagacccgttgaatctctggggctgtagcccttgcagtctgttttaacaagccctctaggtgacgctgatagaggcaacacttttggaggactcagctctgggctgtacggagaactaaagggattctggctgtgaggtaactagaacacaggagtaacatttcgacctgtgaatgaatttgcttaacttcctaagcaagaaaattgaacgctgtttaatagttacaactgacaggggcaaaaaaccttgacaagttccggcgtacacctttaaattttcggtaatacttaatttttatgccaaacaaaatttattcaaccaatttttttcctaacgggggattctacacatttggggaggccagcagactgggggtactgcacgacagagaacaccaacaaggttctcgaaaacctttggcgtgcacggaaagaaagaaccataccgtatcgactgggtatatggggaaattcacatttcacattctacgttccgaac

SEQ ID NO: 629473 - DNA, 246 bp, Homo sapiens
cttacgtggcttgtgggttgacctgagacttgtgggttgactgaggcttgtgggttgacctgtggcttgtgggttgagcgtgggttgtggaaggtgaggaggctatggactaagataaggcctatactaccctcgacctttgcccctccaggcagctgggggagagcggaggcagggtcgctcagggttctaccgacacgctgctgattggtcacccgggccccgaaccagcccttccatgtatga

SEQ ID NO: 629474 - DNA, 338 bp, Homo sapiens
  misc_feature (61)..(61): n is a, c, g, or t
  misc_feature (310)..(310): n is a, c, g, or t
  misc_feature (326)..(326): n is a, c, g, or t
atctacctttacaaggggttgctgtgaaaattaccgagatagaacgttgaggtgcctggcnatgagtatgctgattacatgtgagtttccttcccctgccctcccctctgtgcccactctgatggatctagtgaactcctactgactcttcaatacccagcacggttgtctctcctctggtaagactcccctgactctcccaaaagaggtagctgatctctctttggtgctccctaaccatgctgtgaccacatgtgcaggacagccgtgcaggcagtgtgcttcttagctctggaacccccaactgggnctggggagtttctggncggcaaacacca

SEQ ID NO: 629475 - DNA, 169 bp, Homo sapiens
catgccaggcaacagaatgagacttgtttaaaaaaaaaaaaagtgacttgatttaaggggaaaaaatgactgggctatattcagtcagatatgggcaaaaagtctcaaggggttaatggtgaatgattaagggtctggagggggggtgtcccctaatcaaactacaggt

SEQ ID NO: 629476 - DNA, 1232 bp, Homo sapiens
gggggtgtgttacctgccgacagcataatgtgaggcaaggtccagccgttccgcccagcatacaagcttatggagcagccccctttggagatctccaggtagacttcagagagatgccaaagtgtggagatctgattcctagatttcgactgcccttacggatcggctcacataacgggcctgcgtttttggctgccatggtacagaagacggcaaaggtgtccaagtcacacagggccacggaatctcacaggagcctgagaactcctcctcctgggactctcagaggatccagaactgcagcccatcctcgctgggctgtccctgtccatgtatctggtcacggtgctgaggaacctcctcatcagcctggctgtcagctctgactcccacctccacaccccaatgtgcttcttcctctccaacctgtgctgggctgacatcggtttcacctcggccacggttcccaagatgattgtggacatgcggtcgcatagcggagtcatctcttatgcggactgcctgacacggatgtctttcttggtcctttttgcatgtgtagaagacatgctcctgactgtgatggcctatgactgctttgtagccatctgtcgccctctgcactacccagtcatcgtgaatcctcacctctgtgtcttcttcgtttcggtgtccttttccttagcctgttggattcccagctgcacagttggattgtgttacaattcaccttcttcaagaatgtggaaatctctaattttgtctgtgacccatctcaacctctcaagcttgcctgttctgacagcatcatcgatagcatgttcatatatttcgatagtactatgtttggttttcttcccatttcagggatccttttgtcttactataaaattgtcccctccattctaaggatttcatcgtcagatgggaagtataaagccttctccacctgtggctctcacctagcagttgtttgctgattttatggaacaggcattggcgtgtacctgacttcagctgtgtcaccaccccccaggaatggtgtggtggcgtcagtgatgtacgctgtggtcacccccatgctgaaccttttcatctacagcctgagaaacagggacatacaaagtgccctgtggaggctgctcagcagaacagtcgaatctcatgatctgttccatcctttttcttgtgtgggtgagaaagggcaaccacattaaatctctacatctgca

SEQ ID NO: 629477 - DNA, 1448 bp, Homo sapiens
  misc_feature (1415)..(1415): n is a, c, g, or t
gggggtgtgttacctgccgacagcataatgtgaggcaaggtccagccgttccgcccagcatacaagcttatggagcagccccctttggagatctccaggtagacttcagagagatgccaaagtgtggagatctgattcctagatttcgactgcccttacggatcggctcacataacgggcctgcgtttttggctgccatggtacagaagacggcaaaggtgtccaagtcacacagggccacggaatctcacaggagcctgagaactcctcctcctgggactctcagaggatccagaactgcagcccatcctcgctgggctgtccctgtccatgtatctggtcacggtgctgaggaacctcctcatcagcctggctgtcagctctgactcccacctccacaccccaatgtgcttcttcctctccaacctgtgctgggctgacatcggtttcacctcggccacggttcccaagatgattgtggacatgcggtcgcatagcggagtcatctcttatgcggactgcctgacacggatgtctttcttggtcctttttgcatgtgtagaagacatgctcctgactgtgatggcctatgactgctttgtagccatctgtcgccctctgcactacccagtcatcgtgaatcctcacctctgtgtcttcttcgtttcggtgtccttttccttagcctgttggattcccagctgcacagttggattgtgttacaattcaccttcttcaagaatgtggaaatctctaattttgtctgtgacccatctcaacctctcaagcttgcctgttctgacagcatcatcgatagcatgttcatatatttcgatagtactatgtttggttttcttcccatttcagggatccttttgtcttactataaaattgtcccctccattctaaggatttcatcgtcagatgggaagtataaagccttctccacctgtggctctcacctagcagttgtttgctgattttatggaacaggcattggcgtgtacctgacttcagctgtgtcaccaccccccaggaatggtgtggtggcgtcagtgatgtacgctgtggtcacccccatgctgaaccttttcatctacagcctgagaaacagggacatacaaagtgccctgtggaggctgctcagcagaacagtcgaatctcatgatctgttccatcctttttcttgtgtgggtgagaaagggcaaccacattaaatctctacatctgcaaatcctgcctcttagtcacattatttttgtggcttgatggcttttattcctttccgcatttcctttgtgaatattgctttcttcgttatgcctttaactggaatgggtgaggattctggggatcccttgtttagcagaaacctcatgactgaatcccctatacccagggggcctctttttagnttccgaggcaataaccccgtcatcaggggggga

SEQ ID NO: 629478 - DNA, 501 bp, Homo sapiens
  misc_feature (13)..(13): n is a, c, g, or t
  misc_feature (86)..(86): n is a, c, g, or t
agataggacatanatgtcatttatttgctagtagtatttatccaatagatgatactactctttatcttaaaaatacataactgggnggctagcgaatgttggaaatgccgtttcccacttaaaaaaagctgggggaatttctggggccttcccttggattttccggcctttcccccgggggggcttcctggggacccaaagcccatttttgccgattttggcccctttgaaaaggccgggggatttttgtttgttttttggggaggggtggggggggccaaaaaaaaaaaaaccccgttttttctctcttttttttttgaggaaaacaaaaaaggcggctttttttttaaaaaaaaaaaccccccccttggggggggggggggggggggccccccttttcctcaccaaccagtggggggggcggggcgcgggaatttttttttttgcggggggggtgaaacaccccccgcgcgctgcgggaaaaacacctccttcttcctt

SEQ ID NO: 629479 - DNA, 736 bp, Homo sapiens
  misc_feature (57)..(57): n is a, c, g, or t
  misc_feature (680)..(680): n is a, c, g, or t
taattgcaaaaatgttcatatttccatagcaagcggagtatcgtgtgccaagactgnaagctcatagtgctggttgtaacctgtgaaacatcttcaaattgtattgttatggtcccactgttttaattttagggaacgagtttagtcctgagcagtcttcttcttagagtgtagagctatagtgtttgaaacatgttttcgtaacattgtgcataaacgcagatcttatattgtagacacatcgtgagtgtgtaggcttaacttcattgcgaaggaaacagtttgttatcacatcactttgagccccgtcttagcagcttctttcaaacacttaatacttgcagaaatgtgtgtcactatatccacgggcaagatttacatgttgaaagaggttagtttttaaagcatcaccttcattgttgagagtaaatgtgctcttagggtcctaatattagtgttcatataagcatgtgcctttttcacgctggtggtagcgggcagatagttctcagtcactagcaatcttaggtttgcggatcttgattgggacaatagttcttcctgtagtgctcaagtttctttttggtaaacagaatctttttcaaagaaggtgagcatgaaagttgtaagtcgcgtgtgtatacatcacctctaatgtccatcatagtatccgtggctcnctgtgtatgtttctgtccacagtgtggaagccgttccttttcctttctaaagtatg

SEQ ID NO: 629480 - DNA, 365 bp, Homo sapiens
  misc_feature (255)..(255): n is a, c, g, or t
acctcctagttcccccgaaaacaaaactaagttaatatagacatttcaatagacagccagctttgacaagaacagtaatgccagctgctcaggacccttcccactagccatgcacggcttcgaaaaacattgactgttttctttgactctcctttattctccttgcagacaataatatgaacttggaaatgttactattaattgcatcataaatgcctaacattaattaacgaagttttgttagcaatacatttntaaaccatctcttagggtatctttcttacaaagcatgattaatattatttataacactcttaccaattagtttcagtttcactttagaaacctatccttaaatcctaggg

SEQ ID NO: 629481 - DNA, 1588 bp, Homo sapiens
  misc_feature (1387)..(1387): n is a, c, g, or t
gcagacacgatcccattcagtgactcagaagtcttcagcaacgaaacccagtactcctggggctgtgtaccgtgagtggtactgtaagccatacagtcttcggttatttgcactcctgtttcgcgaggacacacacaccgtttaacccctgaagctacaagggctaacgaggatgggcagctctgcctctcgtggtcgtaggaatcgagaatggaagtgcaatccatctattctatgtgctcaactaaataaatcaggaagggcgcaacggagcaaggcaccagatccattggcaattgccacaggctcatagtgctatggtcgggcttggcgcgggctaatagacatcgcggccgttgagtactctctggagactcatagtcccaccgaatttgacagcctcttcgatgcattcttcctttgagacgttctcgggttcctactaaggccttaggcgtcccttcctgagttcggcactgtgggctttcgttatgaggccttttaggtcacaacagtgggttatattgtcggtcaccgcagtgattgtcccaagggtccccactccaccgtcggtcatgtagcactcgaagggcttccgtcaatgccccccactaacggcacgttatcaagggggaatgaagcgaaaattgcactagagatttgctccatccggtctcctcatagggggaagggacgcctttcccgcggaattatgcacctccgtaaataaccggctaaagctattgtggtttgcgcttactatagcgaaccccgtcgactggctcaggggcttggatggactgtcccttggcctcaagtggcttggttacggcgaggacgtcggcaaacttctgagacatggttttccaagcctaggccatgaggcccataggtttcacattccgtaaaaagttaacttattacacggatcgaactccctcccttgggtatcgcccaattaaacaaactcgcctatgtaattaagcgtcggaatatgttcgtgtcaaccccgccaattgcggtaaatgtccgcctggcaatgtgcgcatcacccccgtggtgtgccccatttaagcgattccccaggcaggagtcgccagggatcatcgcgattaagcgtttattccggtatcgacattaaaattaccgattccgtttcgcgccaagggaaacccatgaagtacctgtgggcctagggcagcaaactcaaaaccttgagttcaacctgtaatcgcttaaaaaacaagggagagcccggagaaaaagcgtcctttctgaaatagaacccaaatccccatttgtgcttttgcagcaagagccccccggttgcctgagccaagccgcgaaggtggaggaaaagctcaccaactgttgtgtcacttattcnccaagaggagggcgcgtataactcgcgttggagaatttcaaagttgccgcgcgatcaagcccccttgtgtacacaaagcgtgcaaaataatataagcgcttgttaaattaccgttataacaccaagagggagtatttccgcgccacacgtatgaaatacgtgccgcggcacaaatatatggtgcgagacgcgcgttgtcaa

SEQ ID NO: 629482 - DNA, 1643 bp, Homo sapiens
gaatgctcagcagctgatctcgattacaacccatgactgcctccaggtgctcattcatgtggcgtcaaacgtttacttcttgcctatcgtttgcctatttgctagcaacaggactctagttcccaagaggagctagtagtgactgtaccaagattgcacaacagatgagttcacggttgcatccactctagctatgcagcactgtgaggaaggaacgaataaaactgttacattccggtcgctatgggctcggtgtgcactatggcccgtttccgcgtacgagacagagttgcattgcacggaacaacggttgttcactacatggcgcaacatacatctccactggtgaacacataggttaggctccgaattcgaaacgatgatacgttggaacaattgtagcaagacacaaccattggttggttgtgccttgtaatgactgggcagattcggtatcaagacatcttatgatggagcagaccacggtctaacggtctctaattacccgcactattttctgggacacgtaactacacccattatcacatggccaactacgaggtgtggttctaacaacgtccgttttcaggcctgaacataggggcgcttaattggacttgcttggaactgtggcctcggacccgtgaactttgcttggcaccaacacggtggcacgaactatgcccgtgggaagcgcacgaaaaacaactgttaggaggtaggccctaacccgtgttaggaccatatttccacgtaggatcaagttagtttggaaccatacaaaaccgcgaactataaaaattaccttgggccaccgacaacgacaaaatgtcgggagttcggcaaagtaacacgcccagtacacggggttctggagctgcgatgggaaaattgattcggacaatggagttggcaaattataaggcgacagtgggtaccaaagacgtgtgacgaagcaccggcaacaagtttctctccgtccacttacattcctgctgtgccactcgtacaatggccggagacacatctctggcgcacagtagattgaatgccattcaccgatataccgattgccttgaaatgactctctcgggagaacaactctgacacgtagtcgaagacctttaacgccttgaaaacaagcagggattcatacatgaggccactaggtataggtgacccaccaaacagaaaagtatggccctgagcccaaattggcatgggggatagaccgttataacataggcattgggccacataaggtcacactcggatcatagcaccagagcaacagactatagctaccagcaggtaagccacactttaggggcgcaatcggcaaatagtggcgaactagcgggcattcactgcgctaactaggccctaattaacattatacgacgaaccgtgcagttagaatggatggccacagtgttttatgtgcccatgcagcccaagtttgctgcgggagctacataatacacgtctgtggccactggcggccccagtggggaaccaaacaaacttaagctcaagacgcgttggcacaccaacggagtgagcgatatcactcggcaatgcctttgcacagtgactcacaagacacagcatgatacaccacatttctttgcgtgtaaaaccga

SEQ ID NO: 629483 - DNA, 427 bp, Homo sapiens
gcgggttaatcactccggaccatgtgcgctgcagggcggatcaggtaggcggggagctggccggtctgcacatgcgagaccactttcgcttaccgaccgggcttgtagctgctcggagccggtgaacctggtgaggcacggctgacgccggcctgtacctgacatgcagcgaggctaatcgcgcctttgtggctcctcctggccaggtcatacttcgaagtagtacccctcagcaaaagggacgggtcagtagcgtctataagccactagagtggagtagagattccggaggctacctgatggcacagcacttactagtggtaccgaaacagaagtcagtgcagaacctgcgtccttccgttaaatacaaaagccattagagctgagataagtcgagaaaataaagcatagtgtagtggagataatc

SEQ ID NO: 629484 - DNA, 129 bp, Homo sapiens
catatcaacacatatgattcagtctgtggctgtgcaatgttataattaaggagatttgtagggcagattagtatagagaggtagagttttcgtgctagtggtcactgacaacggtctgggtaccgagct

SEQ ID NO: 629485 - DNA, 453 bp, Homo sapiens
cgatactacgtatgtagctcacttccactatgtcctatcaataggagctgtctatgccatcataggaggctacatacactgataccccctatactcaggctcacaccatagacaaccctacgccaaacatccattgcactatcgtattcatcggcgtaaatctaactttcttccccacaacactttctcggcctatccgcaaagtatgtagtcaagagtcggaggtcatgtcagttcggcagtatgtcgtctggaagtatgtagtcaggaagtatgtagtcagccgtatgtagtccggaagtatgtagtccagacgtatgtagtcgggagtatgtagtcagaagtatgagacggacgtatgtagtcggacgtatgtagtcggaagtatgtagtcggaagtatgtaggacgggacgtatgtagacgggcagtatgtcgtcaggaagtatgtagg

SEQ ID NO: 629486 - DNA, 366 bp, Homo sapiens
cgcaagatgtcttatcatcgtctgctcctcctctgccttgctggactgacaactgtgtatgaggctggccctacggtcacacggtgaatccaagtgtcctctgatggtcaaagatctagatgctgtccgaggcagtcctgccatcaatgtgtccgcgcatgtgttcagaaaggctgttgatgacacctgtagagccatttgcctgtggggaagggatatacaaagtcggaatatgcacctcttactggaaggcacttggcatctgcccattccatgagcatgcataggtgtgattcacaggccgactccggtccacgtcgatacaccattgccgacctgctgagcccctacttctatatcccgcgg

SEQ ID NO: 629487 - DNA, 128 bp, Homo sapiens
cgtatgactgtccacaggcactcaaaccacttggacaaagatggactgatcacttctgcccctaacttgcttggttttttattttgacgctggctttggcggagaagaccaccatcatgcagtcactc

SEQ ID NO: 629488 - DNA, 169 bp, Homo sapiens
cgctactttgaagtttcatcaggtttgctgaagatggcggtatataggctgagcacgaggtggtgaggttgatcggggtttatcgatttcagaacaggctcctctagagagatatgaagcaccgccaggtcctttgagttttaagctgtggctccgcaatgagagattt

SEQ ID NO: 629489 - DNA, 1159 bp, Homo sapiens
  misc_feature (326)..(326): n is a, c, g, or t
  misc_feature (344)..(344): n is a, c, g, or t
tatgcccagcccgcacctaatgaacagccctcttaagaggtggtcatcacgacttcaatttcacagactagaattgagaaatggaacaaataccttgggataccagccttccatttggtcagcggatcacttgtcaacaaacatggctagcggatcattgtaagatcatgctgttggctgtcctgcaaaccttacttccgcatagctggttaagagaccacactaagaactgatcatcacgatctagtcaactaagcagaatagtggttatagagatgctcacctggtgaccaactctcgtttgcttataccaaattctctcatgngtatgcttgcggaagagnttgtcaacaaaaaattaccttacaacacacgaacatagagaagaagagaacaataaaaacacatgataatcatatacgtggggtggagcctttgtcttcagaggtctactcctctcaggccggggcgccgcaaaatatttcacacgagagcttcatggccccgaaaacgtattttgtgggcatgcacacgagcgtgtgcgtaccaccgcttgatttgagggtgatgagcgttctgccatttattgttaaagacggacacgaggacgcccgcggagcgcagcgagcgagctctatatatacccataagcgtttggagaagaacgcgcgcggagaacatgagggcgcgttagtaccagcgagagggggagaagtcctctcgtggggtccaaaggtagcacacccccttatcatatgatgtctcgtcgggtggggcgcgtgcgtagcacccaacctaatattgtgggggcaacaaaaaacatcttaccgctcatcatggaagagaagagatttttagaaaagagaacggtctcatataagggggggaatcacacagttttgtatagcaacacatgtgttttactacagacagggggtgctatatacgaggggcgtgtatatagaacctcgtaattgaaggctgcgggaataaaatatattggcatgttgtggggacgcgctatttttaggaaaaaagtatggttttgaggggcagttaaactgcgaggaggactatgggactatctttggttagaaaaaacaatttatattaatttcacccgacgggggggagacctatattgaggatagaacaagaa

SEQ ID NO: 629490 - DNA, 397 bp, Homo sapiens
  misc_feature (141)..(141): n is a, c, g, or t
ttaacagaatctcctacaaagttaagagatcccactttgccagaattcactgtgacactactggcttgttctttcctactcaattaccttataaaaattactttttggctggacacggtggctcatacctgtaatcccaanactttgggaggtcgaggcaggcagctcacatgaggtcccaggaggttgagaccagcctggccaacatggtgaaaccccgtctctactaagaatacaagttagtcagtcattgtggtgcacgcctgtaatcccaacctctcgggaggctgaggtgggagaattgcttgaacccgggaggcggaggttgcagtgagccgagatcacgccactgcacttgagcctgggcaacagaacaaggctctgactcaaaaaaaaa

SEQ ID NO: 629491 - DNA, 193 bp, Homo sapiens
ggagtgtgtcctatttcatctagctaggcgtggatatacacctagatactagtttagcaggcgcgctctctctaagctagaataatctacaatatgagataatatcagctaaggatagaggataggataagtaatacgggcaagggacgccatacctagtatagtataggggaccgggatcgcgagcaattcg

SEQ ID NO: 629492 - DNA, 165 bp, Homo sapiens
cggatccgcggccgcaataacaataaaccccccccccccgagcccaggccctggtcggaccaccctgggagcagggactctccacagccagcgggacgcacactcagcccagcaaaccccccgattcatcccgggagccccggggagggcacagctgcctcctta

SEQ ID NO: 629493 - DNA, 150 bp, Homo sapiens
ctgtagtatgcgaataggatatcctaaatacggtgtatcattcatgagtactgatatactcgatatagctgaaccatcaaacaaatcaaggaggagtaagtatcacctaggagctaaggacaataggaaaaggtatttaccattataaaa

SEQ ID NO: 629494 - DNA, 172 bp, Homo sapiens
cttcaaactgcataatctttataacttcttttgggcccgggctggagtgcagtggcgcaaatctcagctcactgcaacctccgcctcctgggttcaagcgattctcctgtctcagccacccaagtctcagccgcccaagttgctaggactacagacaggtgcagcgtagaat

SEQ ID NO: 629495 - DNA, 390 bp, Homo sapiens
  misc_feature (1)..(1): n is a, c, g, or t
nggggtaccccccggttcctccatagggttaagggtgctttgggggttccccccgtaaccctggcccccacaagggggggggaacccccacccttgggtttggaacccggttgggcccgtgcacacccccgggggggggcccctttggaacgggtttcggggggagttgggggaccgggggcccccccggcctccccgggccctgttggtcccccccccctccccggggcctcttggtacccttcccctcctgggggaggggtggtttggggccgggccccctttgttttggcggttttcccctccccttttttgaaggttttttttttgggggatcccctttttaaattggggtttttttcctgggtttaccctttggtccttttttta

SEQ ID NO: 629496 - DNA, 224 bp, Homo sapiens
gcaacaatgcaagttaccaaaatcacagtgtgagcatctcctgtccttctgagattaagattttaatcatctcctccaagagaaaagcaggagtttcctgtagtctccagatgtgtcaccctttatgaacgagtacagagacttaccatagagtctcttgaagtgtgcccagatatccaacatgtcaatttctgctctcagaaaccatcatctaatgagggtgt

SEQ ID NO: 629497 - DNA, 381 bp, Homo sapiens
ggaggtcagcacggtactcagatgtcgacggaacttgtacaggcaggcatgcaccgcaatggtgaatacacgtcgaccaggctgcatctttacgatcattgtggacgtgagcacggtgctcacagtatctgacggagcttgtctaggaaggcatgcaccgcagtggtgaatacacgtcgaccaggaagcatgcatgcatactcgggtactgaaggatccatctaaagtcgaccaggctccagcttaacgatatatggaggtcagcacggtgctcacgtgtcgacggaacttgtacagggaggcatgcaccgcagtggtgaatacacgtcgaccaggatccatgtaagcgatatcgggacatgagcggggatctcaagtatc

SEQ ID NO: 629498 - DNA, 226 bp, Homo sapiens
taatatccgaacaatagtgctttattgatgaaaggttagttgtaatggatacactgtcgatgatatcgattgatatgcttctttgtgttatttctaggtagagactatgtcttagtaaaagagcagttatctattatcaaaagtatctatttagatttgggtagtaaaaccaaaggggatcagaagtgtagcagtgtgggtcctccctccctgcatagcgtcgacg

SEQ ID NO: 629499 - DNA, 153 bp, Homo sapiens
aaagcaaaatcaagaaagagtcccgattgtgttccagtacctggtttttttggtcttcatgttcaggtccccctctgcccttttcatgtcttgattgttgaatttttttgtgagatactccaaatatcctaataaattttcatgtttgcttca

SEQ ID NO: 629500 - DNA, 322 bp, Homo sapiens
gcgtccgtatgacgggacacaggtgcgtaccagcatgaccggctaactttttacttcttggtagagatagaggtcttgctatgttgcctaggctgcttttgaactcgtgagctcaagcgatcctcccacctcagcctcccacagtgccgggattccaggcattagccacccagtgttgttaacatcttacattagtatggtacatttgtcatgactaatgaacggatattgatacattattattacctgatgaccatattttactcagattttcttagttgttacctaatgttcttttcttattccagaattccatgcaaga

SEQ ID NO: 629501 - DNA, 226 bp, Homo sapiens
  misc_feature (6)..(6): n is a, c, g, or t
  misc_feature (16)..(16): n is a, c, g, or t
  misc_feature (192)..(192): n is a, c, g, or t
caaaanttagccaggnatgatggcagatgcctggtaatcccagctactcaggaggctgaggcaggagaacagcttgaacccaggtggcagaggttgcagtgagctgagatcatgccactgcactccagcctgggcaacaagagcgagactccgtctcaaaaaaaaaaagaacagaaataatcaaaccacagnatcaattcattcattcattccaccaacatttatt

SEQ ID NO: 629502 - DNA, 355 bp, Homo sapiens
atgaaaaaaggggcctttttttcccttagccccaaagcaccttttaatttcccaaagcccgtgaaagttgggggtgaagcccccaaaggggaaatgtctcccctgttaaactgaggggaaaaatctgaatttttaaaaaagcggtaaccagttgtaagggcttaggaagaaactttgccaccctttaatggggaaccccggttcatttttaaaattcctccccccgggcccttcatgggttttatatttttttgtggcaacccacaaaactcggatttttccaggggcccggggctttatttggatttttttttgtaaacggtttcaataaggcgggatgtaacttatcgttaca

SEQ ID NO: 629503 - DNA, 266 bp, Homo sapiens
  misc_feature (161)..(161): n is a, c, g, or t
gtgtgtgtaatttttgaaaaactgaacactgtgattatggcgagttgttgtaaatctagcagtaagcatcattactgtgtagaaaacaatatgaccttgaatttagtgtcgtaacgtctatgcggaagagtattaattcgtagatatcaaaacttaatcanttggtaaagtacacgtgtccactctgtataaagtctgtacatgaagagtccataggatgcattatacttgtcgatgcatggaacctatggacgtggagacacaca

SEQ ID NO: 629504 - DNA, 233 bp, Homo sapiens
gtgaagcacacttattatcttcagttgcagttgatttcaaatttagggattttttgttgttgggtttgaacctgtccccttaggtttcttgttattccaatttgttctgcttagtcattacttttaattcttttcctcactaaaattttatggggggtgggggaagggagttagcatcactaacccacaattgttgccaggaatttgctttgtttactgctaggatattagga

SEQ ID NO: 629505 - DNA, 303 bp, Homo sapiens
  misc_feature (15)..(15): n is a, c, g, or t
  misc_feature (20)..(20): n is a, c, g, or t
  misc_feature (26)..(26): n is a, c, g, or t
  misc_feature (151)..(151): n is a, c, g, or t
atttttaaataagantaatntttganttctatgttttcatatttgatttttttcgtatatacatgttagaaatataatgaaatatctagtttctcaatttaattgaaactatgaagagtacagtttagaaattaggtatctctaaattgtncttttcatatattacccataattacattgaaatatattatctagtcatttggctcagtaaagcttaatggaggcagttaatgaaaatgagcagactagaagccagagacggcagtagaagcctaagggagattaatgacaagaaattgtctt

SEQ ID NO: 629506 - DNA, 578 bp, Homo sapiens
gggtgagcctggattagtctgctcctgccgccctctgccctgccagagacagacccatgcgctgcctgcccaccgtgcccctttgtccccatgtcagtgcgtgaggctggaaggcccaccgtgccagaggctggcaccagccttaaccctcactctgctagcacctcctccctttccccaatggtagcacatctggctcactccccactccgtctctggagcccacgcagggaagtgccctcatcccctgcctgctacttctctgggtgaatgtgggttccatccaggattggttgtgcctctctgctcacgccacgtctgcagcgcaggatccatagtcccgctgccctctggcagagcgtgcttcctgcaagaaagcaagtcttaggtctccctgaggaaggccatgtccctcgtgctgtcatcagttgccttgtagccagccttgtgcacttggcctccaggcattgtagttaaggtcccctgggcatgccacccttggggtgccccccgagtcccagggatcccctctggtgtcatgtaggcagttggaaggaaagcagttgggaagatgaaag

SEQ ID NO: 629507 - DNA, 350 bp, Homo sapiens
ccgggaggtcaccatattgatgccgaacttagtggggaacccgatcggcatagcgcactacagcccaaaactcctggactcaagcgatcctccagcctcagcctcccgagtagcttgggactacaggcacgcgccaccgcgcccggctaacaccagtctcttaatttatcagcccaggattataagctactagtgatataagatgtgcatggacctggaaaaggatgtgtgtcagagacacagacattccttaaaattcggagaaagaaatatgacttcagtttagcagtcccaaatgcccaaatccagtccagtccacttaactgttgggattagtccaataggatgtg

SEQ ID NO: 629508 - DNA, 911 bp, Homo sapiens
cccgggtcgagcatgtagcggctgctggcggcggtgctcccggggcgggccgggcgggccgtgggagccgtacgcggcgatatggaagaggagggcaagaagggcaagaagtatttaggtcagttaacgtccatacctacggatacctgaatccctccagtaggactgaaatcctgcatttcatacgcacaatgcaaagagagcccaccatggttcctgggacacttgactctatgagcagcgatgctgtgctcgatgcctgtctgctgtacgaacgtcaaggctggcctggagggacggggaggatatcatcctcagggtgcccattccatgacatcgccgacgtctcctatgttcgggactgacgctgtcacacctggtggtcctgacagacagtgccaggacgccagggatctcccccagtccagagtctgtgtgcggaaagttccatgaggcctcagtgcatggctccctgtcggagagtgcagttgggcccgctggaggctatgcgtgcctggtcagtcctggctgctgagagctgggtcgctgcggaggagctttgctgttctgctaggccaggtcttccaggttgtttacagcggagtccaccatcgactttctggtacagagcgatatttgatgggagcctctagcaccgagccaccacgtgtccctggacagcgatgaactcttctacaaaaagtggacacttgaggaagacctaccgaggttgaaatcccagcacattatctgggttcccttgaactcgtgtggcattgtgaggttggtgcattggcccgacgaggagatgaccgatcaggtgaagaagccgagctgagccggcagggccactgagcatgatgcgggactacatgctgaggctggcgaccaaggtgtatttcagggatcca

SEQ ID NO: 629509 - DNA, 755 bp, Homo sapiens
  misc_feature (244)..(244): n is a, c, g, or t
  misc_feature (278)..(278): n is a, c, g, or t
  misc_feature (283)..(283): n is a, c, g, or t
  misc_feature (318)..(318): n is a, c, g, or t
  misc_feature (347)..(347): n is a, c, g, or t
  misc_feature (372)..(372): n is a, c, g, or t
  misc_feature (393)..(393): n is a, c, g, or t
  misc_feature (399)..(399): n is a, c, g, or t
  misc_feature (507)..(507): n is a, c, g, or t
ggcggaccatggcgcaggggcagcgcaagtttcaggcgcacaaacccgcaaagagtaagacggcagcggagcctctgaaaagaatcggggcccaagaaaaggcggtcgtgttatcgctcccaagaaggcgcgcgtcgtgcagcagcaaaagctcaagagagaacctagaagtcggaatccggaagaagatcgaacatgacgtggtgatgaaagccagcagcagcctgcccaagaagctggcacntgctgaaggcccagccaagaagaaaggggcagcntgccngccacctcctccaagacaccttcctgaggacgctngccccagtgcaggccaaattcccaccccntacctccatattgggaccttgcaangtccatcccacaggctgcacntgtcanggaagagggaccctgtccccccagcacgtggcttcacctaagaacttcagtggggggccaagggtgctgagaaccccagcaatgaccaggaagatacagtcactaacnttcatctgtccccgttgcccctttcccaaggtcctgcctccacagggtttaaccccaagaaccaataaaccctggcttggtcacaacaacacacacaaaacaacacacacaaatgttgtggggcctgggccagagaaaatgttcttacacccttctgttgggccgcgcgcccaggggtcatggaacctgtgcatcgtggcccaaagactcggcttcaatagtgtggttccccataaaaggggggcgcg

SEQ ID NO: 629510 - DNA, 144 bp, Homo sapiens
tcaccgtcctttactgaggagaatgatgcggaggagtttcctctccaggtctaggcaaggcaggcgagcagccagtaagccgggtgcccacagggcaggcacaggaaggctgtgctgctactggctgctcacttctccatcaac

SEQ ID NO: 629511 - DNA, 847 bp, Homo sapiens
  misc_feature (209)..(209): n is a, c, g, or t
tggtaggctctagtcttctttgtgtatcacaaactgagtttctttttatccaaggatatgcaattctttttctattttactttctttcttttgtttttctcttgattttctttgtcacaaagagggacattcttgtgctccaggccacgcacagggctggagatttcacaggggacgtcacagatcctctacagccacaatggtcacangttatctcggccatctcgggtggtcgcaaaatccacaagatatccctctctgactatctcagagtcctctccacaaagagagagacttggggggcatatgctcacagagcgcattttgggcgctcgaacactggtgtgctccggggggcccaaaaatgattgtctttctattgtgtttttatgtgtatgtttctttttctataatgttttccctcgatgcggtttctctctccgacgaaacacaacacgctgaggggagtgtgtctcctcttcacaccaccaggtgtatggtcgtgacgaccaccagcaccaagaaagagtagggttgttctgcctcctcacaaatctcctcttcctccgactgtgcgacgccccagtcgtcgagcggggtgatacaccatcaccaacccctcaacggcggcagcttacgtcaggcggtagcgccttcctcttcctaccgacaaaggaggagccggggcggaggccgaggcgattattattactcggcaggcggacgctggtgatgatggccaacaacaaaagaagaagattaatctgttgcggccacatctattattctcttatatttatgttaaaacacatatcgggtcgtgcgtacttatctaaaatcataaaga

SEQ ID NO: 629512 - DNA, 463 bp, Homo sapiens
aagaacaaagggccatcaactccaggtcatgcaactgagagggcggacaatggcccattctgctgggaaccttaaataggcctctgagggactttgactgctgttttgccgaacagcaccccctgtcagcaggaagcagttaagatcggtctttgtccttatccttatccttattctaatggcagttagatgcatttctttagagggggcaatgagacagccaggtgggaaggggtccccagagaaactccagcctgcacactgggaggagtgtgcactggggtgaagccacagaagtttgcgccatttccagtggggaagagcccagcccctcctcttcctgggtggaacctgaaattcaaactgccaggtgggaagcccacaagcagggagtctggctttgcagaaggaccgtttccctcttttccttttcacccaataaacgctgccctcctcacacttc

SEQ ID NO: 629513 - DNA, 294 bp, Homo sapiens
acctgggtaatttttttttgtttatttatttttgaaaaaacaagttttccctgggtcccccagggtggtttcaaaatcctggccccaagcaatccccctgaggtggccttattttttttttttgttttcaaccctttaagaataaaaaccccttttagccttttggccctgcaaaaacaagtagtgagctgggtttgggcctcaaactaaagtttcctgcttttcctggcctggtggggttttatgtttcctttccaataaccccgggctgtgttttaaagtggtcccccggga

SEQ ID NO: 629514 - DNA, 708 bp, Homo sapiens
  misc_feature (434)..(434): n is a, c, g, or t
gctctgatctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggacttttctctccatgggccacaggggacagggctgggagaagaaatagacttgcaccttatgtcatgtaaatacttgactttctagttcaagaagataatattggtagtgtgggaattggaggtaggaaggcgaggaagccagcgtacgccagctggcttataaggcaagaggattcctctntgcttatctctgagacaggccaaccttgacacaagctgtactagggagagtaatgctgcgatgaaatagtcgccttatgacaacataccctctgtaggtatcgaatgagtgcagcaacttattggcgttgactcacagccccctataggacctgtgcatgcatacatacaattgtgcaaaatagcgtccgatgactcaggaggacattactacttgctatagcacatggcttgcgatgattatggagctaattacactggccggataacaaccg

SEQ ID NO: 629515 - DNA, 89 bp, Homo sapiens
gcggccgcctactactactactgctcgaattgaagcttctaacgatgtacggggacatgaaaccccaataaatatactcattggcaacc

SEQ ID NO: 629516 - DNA, 368 bp, Homo sapiens
  misc_feature (30)..(30): n is a, c, g, or t
tggtttaaaccaaaatgaccatctcacaanacgaggtttagttgaaggctcaattccttacaaaatcttcatttaaggctgagtgtggtggctcatgcctgtaattccagcactttgggaggccgaggcaggaagactgcttgagcccaggagttcaagaccagcctgggcaacataggaagactctgtctctacatagaaattttattataaaagtagctggggatggtggcacacacacctgtagtcccagctactcaggaggttgaggtgggaagattgcttgagcccaggagtttgaggttgcagtgagctgatcatgccactgcactctagcctaggctacagagcaggaccccatctccaaa

SEQ ID NO: 629517 - DNA, 235 bp, Homo sapiens
gctgggaatcgaagattgaggactactttccatgaatttgctcgctacactactcctgagagatgctactcccgagcccggagaggacccacgcagtgaccccgggccaaggtacttcattcgcagattagtttctgacggatcagcactgccatgtggagatgggcgtcactacttgctaccctctatttcactctgtcgctgtgggacactgagtaacatcctgccgtgttgt

SEQ ID NO: 629518 - DNA, 246 bp, Homo sapiens
  misc_feature (56)..(56): n is a, c, g, or t
gttctcctgcgtcagcctcccgagtaactgggattacatggcatgcagtcaccatngcgcatgctaagtttattggtatttttgagtagcgacagtgatttgcaccatgttggccacggctggtctcgaactcgctgacctcagggtgatgcatcctgccttgtgccttccaaatgtgctggcgattacggggcatgagccatgcacgccttgaccgtaaaatcatgtttactattgccagttatt

SEQ ID NO: 629519 - DNA, 141 bp, Homo sapiens
gctaatggcttggaactggcatactggtctatgtctctacgcacaacgcctgctcgctctccgtgtggttgccaagccaagccgcctgctaccttcatacaccaaattgcactcgctccttacctactgggtttcgagagg

SEQ ID NO: 629520 - DNA, 174 bp, Homo sapiens
cagcagtcacaggctggtgtgtcgaccagctcgtcactagggttagtgtgttaggaccagccagtcagcagggttcgctgtgttcggagcagtcagtcaatcgggttcgtcgattcagtgaccagtcagtcagcagggttagtgtgttaggaccagtcagttctgccaaggggt

SEQ ID NO: 629521 - DNA, 111 bp, Homo sapiens
ctatagcagaaaagtcaaatccaccatctacataatatatccttcgaatacttaaacgatcgctttctatgaattctcaactcaactagctttctagtgtcttctttttct

SEQ ID NO: 629522 - DNA, 410 bp, Homo sapiens
taatgagttgacagatggtgagatgactcacaaagtgaaatgatggaaagactgaactgcatgagagttaaaaaaaaatcttttccaggcaataaagctctgtctacacagcgtaacgaatggtttaaaaatagggccaccactcacgcctgtaatcccagcactttgggaggccaaggcacacagatcacttgaagtcaggagtttgagaccagcctggccaacatggcgaaaacccctctcttactaaaaatacaaaaattagctggatgtggtggtgtgggcctgtaatcccagctactcgcgaggctgaggcaggagaatcgcttggacctggcaggcagaggttgcggtgagccaagattgcgtcactgcactccggcgtggacaagagagtgagactccgtcac

SEQ ID NO: 629523 - DNA, 380 bp, Homo sapiens
gtatatctatctccctgaaaggggatcaagggacggctgaacagacttccccctgctggtgtgggtgaccctggtgatggcccaccagtccagaaaggccaaacccagagctccagaaaaaaggtacatcccagccagtggtccattcgaccaacgaaagtcataccgtagaaaagatggcgtgtttcttttattttgaagataatgccaggagtccatagtgcacaataaaggcgagatgaaaggttttgcccttaccggacccgttgaccaagggagatgtgccagacttgtggccccgggattgcatcccatgctggccagcattgccatgattctcccagtatatttgtaaaaaattaaaaaaaacttaaccccca

SEQ ID NO: 629524 - DNA, 270 bp, Homo sapiens
gaccagttattgactcgggtactggaggatctctaaattgacaggccatattacgatatttggaggtcagcacggtgctcacgtgtcgacggaacttgtacagggaggcatgcaccgcatggtggatacacgtcgaccaggatccatctttacgatatttggaggtcaacaaggttctcacgtattgaaggaacttgtctagggaggtatgcatcgcagtggtgaatacacgtcgagctgcgggggttcctgcatgctcgggtccttggc

SEQ ID NO: 629525 - DNA, 462 bp, Homo sapiens
acggggggggcggggcgggtttctgggtatttttcccccgcgtcggcgccgcggcggcgcccccgtgcccccaaaaggggttcccctaggggggggtttttttttttcgggttcccccaaatttggggtttggcccccggggggttttgggggccccccccaaagggggggctttttcaccccgggttttttttttaaaaaaaatttccctttcccgggggggttttttttaaaccctttttccggggggttccccttttaagggtgggggggggccccctttttcccaaagggggggggggggtttaaaaagggggcccctttttttttaaaaaaagggggggggttttgggggcctttgggcccccgggctttttggttccccccccggtttttttttttttttcccctggggggggggttttttttttttttttggggggggaggggggggccccccca

SEQ ID NO: 629526 - DNA, 123 bp, Homo sapiens
aatgtagcagcactaagaattttcattactattcctccactacattacagttacttcattcatccctatacataccgcaataatgagtcggaggcatagtaagaaaatcctgttggctggcga

SEQ ID NO: 629527 - DNA, 406 bp, Homo sapiens
  misc_feature (8)..(8): n is a, c, g, or t
aacagccnagtatttcaaagacatacctatatcatttccccttacctagggaatctggattttatgtataataaatttatatttgtatttcatttccctcacttttttcctgttttccaaaaaacatggcccaggtgcaagtcgcacgcctgtaatccccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggagtctgaagcaggagaatcgcttaaatccgggaggcagaggttgctgtgagccgagatcgcgccatttccagcctgggcaacaagagggaaatccgtctca

SEQ ID NO: 629528 - DNA, 100 bp, Homo sapiens
gtcgacgcctgaagattctgcagtgtattactgtcagcagtttggtagttcaccgtggacgttcggccaagggaccagggtggaaatcaaacgaactgtg

SEQ ID NO: 629529 - DNA, 764 bp, Homo sapiens
taattaggctaggtacgaggctggttttaaatcggcgcgggggacgcgcgctgttatgccgccggtctgcctgcggtgctgaaaacccggcgcgcagtgcggctggctctgtggctgctgcgccagcaaatccactccgtggagccctgcggaccccgagcacgcgcctgacagcccctgctggccctggcgcgctggctgtctgccagtgccagctataggccccctgaccctggtgtgcctgcctgagacctgcggctacagggacctacccctgcgctaactatcacctgtggacgaggtgtgcccagcagctcagggtgcgagtgagcggtggctagtgatcgaccgtaaggtagtacaacatcagcgatgttcaccctgcctggcatccatgggggctccctgggtcatcagccactacgccagggcatgtgatgccactgggatcccattttgtggccttccacatcaacaatgggccttgtgaacgaagtatatgaactctctcctgatttggagaactgtctccagagcagcccagctttgagcccaccaagaataaaggagctgacagattgagtacctgggagctagcggggccacagtggagcggatggggctcatgaagtgccaaccatgtcttcttccctgctgtacctgcttgccatcttgctgctggatggtgctgcctggctcaccctttgggtcttgggacggtcttttgcccttcctcgtcttgtgcggtgctgtcagtgcagtca

SEQ ID NO: 629530 - DNA, 884 bp, Homo sapiens
gagtgtgttgggtgcaagacctctttccctctgggcctgttctcttggatgtaaataaggacagcagctggtgccgcccacctgcctggtgcattgttgtgtgaatccgaggaggcagttgggcatccgtaactgtaagcccatcggagctccaggagtttcccaggatgaatgtgtattcctcagtggatggtcatcgacggcagctgggttcctcaactgggggtccggacggggtccctggcaggaagttactgactatctgtatcttcgccgaccctcgagttaactgggtccctcgggtaatggctcggtactgttgcccaatccgtcgctgctgctggggaacggtgaagcagtgtctcatggtagtacccagggtggccccggggggccctaatcgattaggcgacgacaatattggctgattggatgtatgacgagttgttggagaagacgtactggggagtgtattgcagagatagtgatgggtgggacaaggtagcttgttagatgataaggtggatgggagctagttggtgcgctgccggtcgttcacacctgatgcagtggtctctaatcttgggctgatcttgaaacggctggtgggacgatcgctcgggcacaaaggtttggggctggcggtccatggctgagattcctggaggtgttgtgtgccacacttctaaggctggttacccgactgcagatagggcatacgggcgtgtgccggggtgtctagagtgtggacttgttccccatgcccattccggttgtgtgtaattcccagggaccctgggccccggaggcggcatggcccaaggattagaatttccgcccctttgtccaaaccattaaaagtcccgggtccacggcgggcagga

SEQ ID NO: 629531 - DNA, 352 bp, Homo sapiens
ttcggcacgaggtttttttttagacactgctggatttgatgtgcttatattctgctgaggatttttacacctatgtttatgagagatattgctatgtagctttcctttcttgtaatatttttgtctgcttttagtactagggtaacagtggcctcataaaattagttagaaagtattaccacaacttctattgtctggaagaaatggtaggaccttggtataatttcttttaaaaaatgctggggctgggcacagtggctcacgcctgtaatcccaggactttgggaggctgaggcgggcagatcacaaggtcaggagattgagaccatcctggttaacgcggtgaaacccc

SEQ ID NO: 629532 - DNA, 108 bp, Homo sapiens
ctgctggtccaaaactactaatactaacatctcagacgctcaggaaatagaaacgtctgaactatcctgcccgccatcatcctagtctcatcgccctcccatccctac

SEQ ID NO: 629533 - DNA, 294 bp, Homo sapiens
cgaggcaactgttagaaatccagtgacgagacaaacagagaagcgctggtgaagccaacagtagagactgtcaatgtgtacactggagttcccaccctcgcatgaacagccggtatataacgcaatgatctccgcgccccgagttcgcagatagagagagcggaagaaagtaacgacgtctacatacaatcggaggcacctcaggagtgactaactgacacaagacgaggagcagacttgatcacgtaggataagtactcagcatacagaatagaacactaactgcgaatgagc

SEQ ID NO: 629534 - DNA, 309 bp, Homo sapiens
  misc_feature (208)..(208): n is a, c, g, or t
  misc_feature (223)..(223): n is a, c, g, or t
  misc_feature (269)..(270): n is a, c, g, or t
  misc_feature (282)..(282): n is a, c, g, or t
  misc_feature (298)..(298): n is a, c, g, or t
atatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaattttaaaattgtcatggtggtgcacgcctgtggtcccagctactcaggaggntgaggcaggtggatnacatgagcctgagaggtcgaggctacagtaagctgtgtgatttcannattgcactctancctgggtgatagagtngactttgtctc

SEQ ID NO: 629535 - DNA, 152 bp, Homo sapiens
tgtctatctcggcaggacagaaaaatagagaaggtcttctacagtctaagacaaaagttcccgtgtgtcatgcctgaaaatattctattcttatgatcatgtcacatgcttacaaaaagaagccacagcacagacacttccttagtgaagac

SEQ ID NO: 629536 - DNA, 672 bp, Homo sapiens
  misc_feature (55)..(55): n is a, c, g, or t
  misc_feature (95)..(95): n is a, c, g, or t
  misc_feature (120)..(120): n is a, c, g, or t
  misc_feature (150)..(150): n is a, c, g, or t
  misc_feature (167)..(167): n is a, c, g, or t
  misc_feature (196)..(196): n is a, c, g, or t
gctaatgattccatttatttaaagttagattacatgtttccatccagccactccnaaatctcatgtcctcacatttcaaaccacagttatgcctnttctacagtctcccaaagccttatntcagggttaactcaaaagtccacagtccanagtctcatctgagacanagcagtctcttctacctacgagactgtanaatcaaaagcaagttagttacttcctagatacaatgggggtacaggcaatagaaaaatatacccattccaattgggagaaattggccaaaacaacagggctacaggcctcatgcaagtccaaaattcagcagggcagccagatcttaaagctccaaaatgatctcccttgacttcatgtcacacatccaggtcatgctgatgcaagagatgggcacccatggccttgggcagccccgcctctgtggctttgcaagatatagccccactttccactgctttcataggatggtgttgactgtctgcagcttttccagatgcatagtgcaagctgttggtggatctaccattctggggtctggaggatggtggccctcttctcactgctccactaggcagtgccccagtggggactctgtgtgggagttctgacccaacatttcccttctgcactgccttagcagaggttctctgttag

SEQ ID NO: 629537 - DNA, 122 bp, Homo sapiens
aagcgatgcttcatatggtaaccaaccatattacaagtcacaaattggtaacattttcctactcaacggaaaagtgattggaggaaagtcgacaaaggcttcgttaacatgcacttcaacta

SEQ ID NO: 629538 - DNA, 1421 bp, Homo sapiens
gggggaagatgctccgcgggaggacatgattttctaataaattgttggagggggcggagggatgggggtgccgccactattattgagagatagtgtggtggtgctcccctccttggagtatggtgtgatgtacgatactttcctctcgtggtgtgacttccccctcgctcgggaggtgataatatgatgtgtctttcttattaagagacacgatgtgtaagacgaccgcccactcggggtggcttgtttccctccgccaagagagagacactcgctgggggtgtataataccgaacgggcagctgggttattttctttcggccggcgggtggtgtggaaacaacatatcattttagttaggacgaatgttttgggggggcgcgcagaaaaaatgtgtcttccgtccgtgtggtagagtgctcgaaaaacacattgtttttggatgtaatgacacgggagatgtgtgtatttgccttcggtgggttgcctgcagtgtgggtcttcctcgagatgggctccgcgctagcgtccggtggccgcgcgttgtgtgttcgcgcatggaggcaaagaggtgtgtagtagtataaagagagagagcagatagatatatataataagaagaatagtttccggcagagccggtgtggatagtgtaaaagaaagaagtggtcgggtgaagaaagatagattctgcggacgaatattgttgttgtgatgagaagaactcgccagccctgtcggacacaggttgcgcgcaagagaatttctctgttgagtttctgttctctgtttaaaatatgatgggcgcccgcccgtggggttggcacacaatattttgttgacgagggggcggcacaaaacacatagagggtggtgcgcaaccgacgaggctctctctgcttggtcgcacagagcaccaagagagcgtgggttctgagagaaaaaaaactgcgtgccaaagacttgtgggggagcacgcacacaaaatggggcccccctttgtggcgcgtttgtgtctcaccagagttttttgtgtcagaccacagatacgcggataaagcggcgggtgtttgtcgcgctcttttcgcacatagtcttctcgggagagatacaccccctgtgaggagactccccgcccatctctttttttagagaatgagggggaaacttgtaggcccaccaatttggatgctctccaatgtgggagggggcgacaaaattttttcatatttatgggcaaaatctcttaaaagcaccaacaggcgcctcattcccagatgttggcccttggcgctatctctaaccgcctggggaaaggggtgtaaatacggtttttttttaagcgcaccccccccccggaaaaggaccggttttttgaaaaaaggttttgtggaaggaaaaaaatttttaataaaattata

SEQ ID NO: 629539 - DNA, 198 bp, Homo sapiens
cagcctccgggtatcacaggactagaagtccagaacatgtatgtgggaccccagaccatcccagccaccccccatcttcctggcctcatttggcagctccagccctgtccccccaccccacaaacgggggactacgcagatcactgacgttcctacaccaacaacctgcctcacgacatgacacatgacctgtacaga

SEQ ID NO: 629540 - DNA, 592 bp, Homo sapiens
  misc_feature (66)..(67): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (94)..(94): n is a, c, g, or t
  misc_feature (516)..(516): n is a, c, g, or t
taatttatcctattgtctgaaatggtaggtgatgcaagtctaattaccaaggattattttaatttnntnccacanttncaagaaaatgcgtatntagacctctagagtttgactaaatcacaacgtttaatcatctggcataatttatacacctttgagaactgagattatgtattaaaaaacattatttcctttaactggctttttatttaagggcattagcaccattctaagcaagtggatctttctttagattatcattaccttttccattatctataaaggggtactagaaagcaactttaagaaaattcttttcccattctgttttactttttaaaatatttctgctctctcagtccctagttttcaatctatctaaaaacaaattttcctaaattttgtgttaaggttttttctttttcattttaaatattgtgtttgtattacatatttaggtatatttcatgtaccctgtttatcatctccatacacaatagtcaggcgagctcaagntttaaaagcaaggcttttaagaactcacttttaaagcattttctcttgtagtagtgggtttgtacgtatatattat

SEQ ID NO: 629541 - DNA, 911 bp, Homo sapiens
  misc_feature (3)..(3): n is a, c, g, or t
  misc_feature (137)..(137): n is a, c, g, or t
  misc_feature (162)..(163): n is a, c, g, or t
  misc_feature (179)..(179): n is a, c, g, or t
  misc_feature (274)..(274): n is a, c, g, or t
  misc_feature (280)..(280): n is a, c, g, or t
  misc_feature (282)..(282): n is a, c, g, or t
  misc_feature (304)..(304): n is a, c, g, or t
  misc_feature (355)..(355): n is a, c, g, or t
  misc_feature (576)..(576): n is a, c, g, or t
  misc_feature (619)..(619): n is a, c, g, or t
  misc_feature (682)..(682): n is a, c, g, or t
  misc_feature (686)..(687): n is a, c, g, or t
  misc_feature (690)..(692): n is a, c, g, or t
  misc_feature (694)..(694): n is a, c, g, or t
  misc_feature (697)..(697): n is a, c, g, or t
  misc_feature (699)..(699): n is a, c, g, or t
  misc_feature (714)..(716): n is a, c, g, or t
  misc_feature (718)..(725): n is a, c, g, or t
  misc_feature (727)..(727): n is a, c, g, or t
  misc_feature (738)..(738): n is a, c, g, or t
  misc_feature (742)..(742): n is a, c, g, or t
  misc_feature (751)..(751): n is a, c, g, or t
  misc_feature (759)..(759): n is a, c, g, or t
  misc_feature (778)..(780): n is a, c, g, or t
  misc_feature (786)..(786): n is a, c, g, or t
  misc_feature (807)..(808): n is a, c, g, or t
  misc_feature (816)..(817): n is a, c, g, or t
  misc_feature (822)..(822): n is a, c, g, or t
  misc_feature (827)..(827): n is a, c, g, or t
  misc_feature (901)..(901): n is a, c, g, or t
aantgggtctctactacagaggtacaagggggaaaattttataaggttcccacagaagcaagacaaagaaaatacttggttaaagttgaaaggacctagttagaggttagatggtggtttctaattggttaagcttnttaggactgattaacactgagtcgnntattagtttgcttggngctggaacctaaatggtggaactgttaccagcagcaaatccaatgggtctgcagcagactccatccttgccccctgggggagaggagggaatttngccggngnggggtaaggtagcatgatagtncaaggcaagttttatagcaggagtaaaagttttagagcaagaacaaaaggnagctaagtgcacttgaagagagccaagcgggtgacttgagagatccaattgccttggtaggcccttgacttggggttttatacattggcattgttccggggtttccatttctcctcctctgatttttctttggggcgggctgtctgcatgcacagtggcctgccagcacttgggaggggacgcatgtgcagtgtttttactgaagttgtgcacgtgttcantggaggagtttttcccttaccagtcaagccttcctaaaggaangtcatatatgaattaaatagacaaatattctgcctcttagggtgcatgcttgagcctgcgcanccanntcnnnanatntnaaaaaaaaaaaaaannncnnnnnnnncnccccccccctntctnttggggggncttcgttncctggtttcggtggcgctnnnttattntgttggggacactgctttacnnctgcctcnncctcncctgntggttgcctgacattcctggtgcgggggccctcccctgccctgctcctgtctggctagctacctgctccacatntcccccctca

SEQ ID NO: 629542 - DNA, 322 bp, Homo sapiens
tagagcatcctccagagtagacttaacccaggtagagttctggtggtcactcatagcctatgatatacagcagccagcatcttctcggtcacatactggcagcgcttcaaggttctggtctggaacaccgcctgatctcaggctccacgatgggcacaatgccattctgctggcagatactggcataacgggccagaacattggcattttccatgatggcgagggctgagggggtgtgttccccaatcttcagcacacaacgccacttggcgaagtcagctccgtccttcttgtactgggcacagcggttaggtctacctgg

SEQ ID NO: 629543 - DNA, 280 bp, Homo sapiens
gtggtgatggaacaattcccggtggttatagcaatcctctaggcagagctggtattaggacaaagactcatacaatatggtataaacctgtgagagaggatgaagaaagtaatacaggcattgtgtatgcatggtaaaatgaggaagagcccaatacagctccaactgagaacttcccctaagaaatgcaaaacaagcatgatggagttataggcactgatggacgtgtgcccactcagtatacaaatcctttagcaagtttacctacattcctcatcac

SEQ ID NO: 629544 - DNA, 159 bp, Homo sapiens
cgaggggtggagtgggggaatgataaacacacaaaaacaacaaacacaaagcgtatatgtcctctacacgaggatcttattctattagtaggaaaacacatctacataaaatgatattagagaaacacggctattgaaaccatatattcttcatcccct

SEQ ID NO: 629545 - DNA, 285 bp, Homo sapiens
gctctgtctctggaatgcctcgtcgttactcggacatacctcgatgcatacactatatgaaatatcctatcatctgtatgctcattcatttctctaactgtagtattattattaattttcatgatttgataagccttcgcttcgaagcgaatagtcctattagtagaagaaccctctataaatctgtagtgactatatggatgccccccattctactacacattcgaagatcctgtatatattaaatctagtcaaaaaagtcatgtaggtcatggggttggcttg

SEQ ID NO: 629546 - DNA, 324 bp, Homo sapiens
tggggcttggctgagtcaccagcactgtaacttctttcatgaattcccactgatcacaagaccccacaccaccatctcactgacaccatgttcaaccatgtcttttacttaacaaattccaggaactgttcttaggaaactccaagtatcaaaccaaggttgtggagtattccacctcaggaaggaatgctgaacaactgatttacagacttgttgccccagctagaccaccaggtagcccattactcaaggtaaccattacaaccaaatagtgcttacctgcataccctacccctcacatgctttgccaagccccagctgcgg

SEQ ID NO: 629547 - DNA, 497 bp, Homo sapiens
cgcgaggggcacagacacatcacgctgaatgcaatttaccgaagattggttcgaggaggatgtctcaacatggctttgtgcagccgatttaaaagatcttgtaggtatttatcaagatgaataacattgatggaaaagaactgttgaatcttacaaaagaaagtctggctaatgatttgacacattgaatctctaggactgcgtagtaagagtgctgaggaaaattgaagagctcagggaccaaggttaaatccctttcttcaggaattcctgatagaatttataatttccgataactagagaacttatgacaagaatccggtacatcgcatcagatgggctattcatattaaaaggaagcaatgaaagattggatcagccaaaagaaacgtacaaatcgcatgacggatcttgttctacctatcagcggtacttacaccagataggactcttaaaataggcatcaatagattgctggagacacaccaaaagtaaca

SEQ ID NO: 629548 - DNA, 300 bp, Homo sapiens
ggtgcagaggtgtgccctcatctcaaaaggtatattccgtgtcagtggtgtcccctaaagttattcagtggaaggccctttgggaagcaggggcgggaagatcacttgagcccaggagttcagacccaacctggggggcaacatggagaacccccatttttacaaaaaatataaaaattagtcccagctactcgaaaaactgaggtgggaggatcccctgagcctggggaagttgaggctgcagtgagttgagttcttgtccctgccctccagcctgggcaagggtgagaccctgtttca

SEQ ID NO: 629549 - DNA, 887 bp, Homo sapiens
agcggaggtgatggcgcccaccgcggcctagaggtccagcgcccgccgcgagcagcggacagtcctcctgttgtgtccgaccgagagtcctggtgactttgaacatgctggtgccgctagccaagctgtcctgcctgggtgagaggaaacgggcggtggggataagtggaggagttagggcaaaagggacaaggccggtcctgggggctgtaggcacctctcgccccttctctcatcagctttctcaggctatctagggcaaaggtcacgcgctgtcagcctgttgggggaccctggcttcctccctctggggttgccccagttggtagaattaatatctaggctaaaggtcaagggcggggaaaacttgtcaacacgccctcggcatcaccaccacctgtcaacacacacacacctcggtggactcctgaactgaggcttcccaaatcctggttctaatcttcaaacctctgttggaaatggaaaaaaaaaaatcgtatttgcccagtttttctccctggtcctgacctgactttcgtcttcggagccattctagttcagtctaaagaaattgaagtctgatctgtcacatcatggttaacattcatatgttggccaagtcacccaagtgtatctggagccagtttttctgcgttgtctaaaattaagggctgggattataggcgtgagccaccaatgcctgggccccaggtgctatagtttaagatatgcgtaagtaagttcatttcttttgcccactttaaaaaaattgaccaaacacagattttattgccctttcacagaaaattctctgaaaagcattaatctttagtagacccatgtgtcaagggacgattctaaaattagggtcaacgaatattgtttac

SEQ ID NO: 629550 - DNA, 473 bp, Homo sapiens
  misc_feature (197)..(197): n is a, c, g, or t
tgtcgaggtaccaacaggtggtggaagggtggggtgtagtgggagtggggagtcgctggtgagaggacaggctcatggacaactgtgttagggcagtgacctgtgggtttgcaggttttaggccccgggtgtggtctcagggacttggggtgctgttgagttgctgtagcttttccacatgtgggggtgcaagctgnttggtgggtctatgaatctggctctgcctctggagcaggtttctgcctggaaacagtgggaggtgaaggtgggggttgcggggggcagatccttcagcagtggttaagcaccaatcttctggatgctgaccttgtgatactgagttctcatgagatctggttgtataacagggtgggcacctctttcctctctcagtcttgcttctagtgctgccacatgaagcatttccttgcacctttggccttctggtatgattgggaggctcctgagtcctc

SEQ ID NO: 629551 - DNA, 852 bp, Homo sapiens
acactcacacactctctctatatagatgttcaatagaaaacacacacactctctctataggtgttcaatagaaaacacacacacacactctacaggtgttcaatagaaaaaacacacacacacactcacactctctcttcctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629552 - DNA, 202 bp, Homo sapiens
gcctgaaactcctaaaaccaattggaccaatctatcaaccctatagagactaatgttagtataaggtaacaatgaaacattctcctcccaatagcctccgtcaagattaaacactaacctacaattacaagccaatatctcaatcacccacaaggtcatataccctactgtcaacccacaaaggcatgctcataggaagggt

SEQ ID NO: 629553 - DNA, 242 bp, Homo sapiens
ggcttccttaaaaacactgatggaatctaacaaacttgagacaattcgttatcttgcagatctgcaatggtgtatcttagcttcgtcaattacgctttgcagaacctatagtattactgtgaagtacgtagggatagttcatcttgttgtaagagctggattacaggacaccgcagccgggataatgaaatccacctgaatcccatagcatgaaagcctctggcagagatctacacacgatt

SEQ ID NO: 629554 - DNA, 2681 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629555 - DNA, 367 bp, Homo sapiens
  misc_feature (66)..(66): n is a, c, g, or t
  misc_feature (121)..(121): n is a, c, g, or t
  misc_feature (158)..(158): n is a, c, g, or t
  misc_feature (361)..(361): n is a, c, g, or t
tagaggatcccagacgtccattctgcaattgtctgatttctaattttctgccaccactacgcctgnactcctccaggcaaggactgtgtttattcagctttacatttccactatgcttagnacaaagtagatgttcatgaaatgcttgatgagtgatnggatggttgaaggaatgcatgaatgtatggataattggatggatggatggatggatggatggatggatggatggatgactggatgggtggacgattaggtagatgagtggatggatggatggatgggtgataggatagatggatagataattggaaggatagatgaataaataattgggtggatagatagatgatgaatgatnggatgg

SEQ ID NO: 629556 - DNA, 266 bp, Homo sapiens
cccctttttttttttaaaatttgggccccccttttttgaaaaggttttggggcccttaaaaaagcccctttcccaagggaaaaagggtttttaaaaaccccccttttttggggggggggggccccccccccccccccccccctttgggggggggggccccgcccggggggggcccggaaaaaattttttttttttttttttttcccccgggcttttttttccccctttaatttggggaattaaatttttcccccgggctttggtta

SEQ ID NO: 629557 - DNA, 677 bp, Homo sapiens
atctacacagggctttgctatttaggtacagaaagcacaatttttattgaaagtaggttcctcaaaataacattctgtttcaaactctccggtcttccttaactcctataatggactccaaagcattctctattgaaaggaatcttccttgcttggagggagaaactgcctagtggaattctgcagctcattttcaagttgaacagccttatttcttaagagctaagaatcgccctggattgtgtccgactgaactacccccttgggtaatctaacaaaaacgtcttccagctgtgtttcaaaactctctacttgatggcgcatgcgagcaaaagaggttgctattcgtagaaccacttggtgaccgcagctttggctcatggagctaacaatcgggcctagcccttcagttgcacaaattacaaactgctaggctaaagctagaatctttgcaattgcccgtcccggctcagggtttgggaaagatccaaggttccttcatttggccccgaaacactgcgggggttcaggctcttggaaaccaaacactccccacaacaaaacgttggccacttaaggtgtgggaccccccgaacgccaatctgtgtcttatgtaaacatcgggtttttcccggaacccatatatagggtttttgggtggggaaagaactcatggc

SEQ ID NO: 629558 - DNA, 2533 bp, Homo sapiens
  misc_feature (5)..(5): n is a, c, g, or t
  misc_feature (10)..(10): n is a, c, g, or t
  misc_feature (18)..(18): n is a, c, g, or t
cgacntccancttgcagntggcctactgggaagcttgagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629559 - DNA, 259 bp, Homo sapiens
acagaggggagcagatcagtggctgcccagagcttggaggagggaaatagggagtcactgcttcctgggcaccaggtttcggtttggggtgatgaaatgttctataaccagacagtggtgatggttgcataacattgtaaatatgcttaatgccactggattgcacaatttaaaatggttatgatggtaaattttatgttatgtgtgttttaccacgtacacacataaaacttattttgtgccattaaaaagaaaaaaa

SEQ ID NO: 629560 - DNA, 229 bp, Homo sapiens
tgatccacatcaccgccacgcggctttgaccgcgtcagcaattcgcctttccaggcgccgctggcctcgctgccgtcgctcaggcgtcggcgcaggtcaatggcctgaagggcgcctgggttgactgagtgctgcacgccgggattgtcggcggcgctgtcgctgatgatcaggccgtcgcggatctcgatgatgcgtttggcgcgcgcggcgacttcgcggtcgtggg

SEQ ID NO: 629561 - DNA, 2642 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629562 - DNA, 2461 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629563 - DNA, 2627 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatcctactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629564 - DNA, 185 bp, Homo sapiens
ccacctcagcctctcgagactggcaggcatacaccactacctccagcatttttttttttcctatttttggtagagagggggtttggctacacacgggcgggtctggaacggggctcaagcgatctgcccacttgggcctcccaaaggtgcgggggtcacaggcaggggccagggcaccgggccag

SEQ ID NO: 629565 - DNA, 2190 bp, Homo sapiens
ggactacagcagatgttgtaacataatcgatgacacggctcttgagagttctctgtcacctagtccagtactagacatcgagataggattggtaggccacagtgcaagaagggcacgatcacggtgctagtagtcgtacggtgagcaggacagactggcaccaggatagagtagtcgtcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629566 - DNA, 2312 bp, Homo sapiens
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatcctatatgtaagattgtcccataaacgaaattacggggtaatgcttttaaataacctttataacgaatgcagcatcttcctacctcttcagattcttcagagaattcagtaccaagaagcaaaattcactactggacctttacattttgacttgccaaaagtttagtaatccacttatcaccatggagtatatattcttagactaaaggttttattgggaacaccaggcatatccgtgggttaccatttgtctatgagcaattctgaattcaccgtgccgggaatggggtgacacttccgggcacaaaggctcaagccttctgactgggcctggacaaacgttggccatcctgaaag

SEQ ID NO: 629567 - DNA, 130 bp, Homo sapiens
  misc_feature (46)..(46): n is a, c, g, or t
gtgtttatctagaggatcccgtgaggcttggtggtaggcatgcgtnctggaggctgcagggtccttgtagcagagcagtttcttgctgcttgggtcctcagcacgccaagccccccaccaaccctccacc

SEQ ID NO: 629568 - DNA, 1964 bp, Homo sapiens
  misc_feature (1858)..(1858): n is a, c, g, or t
aaaagcagctggtacggtcgggggttaggatccgcgctgtggctgtttcaccgctccccggctgggacttggagtcccttatctttccctggtttggtacatgaccctggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctataagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggtaagaaattcctgtgtaaagtatacaaaagaaaattgctgggttatgtgtatttcaattgacattaaaagatttgtattgcatctgtcactttatagaaagtattaataagcatgtatgcaaagaaaactacatggcttattctcaataattacagtcagtgattttttactgtaatgttctgttttattcacatcaaaaaagtagaaaagtaccagtggtagccagccacggtcncacgcctgtaatcccagcactttggtaggctgaggcgggtggatcatctgaagtcaggagctcgagactagcctggcccacatggtgaaaccccgtctctactaaa

SEQ ID NO: 629569 - DNA, 763 bp, Homo sapiens
  misc_feature (132)..(132): n is a, c, g, or t
  misc_feature (287)..(287): n is a, c, g, or t
gtgaagccagtggtggggaggaggtgactggccagttgctctggctgatgggcctcatcccgatcttcgagctgggatcattgtgtccatgatgttatgactcaccaggaggcttgtgagtgtcgtagatgnttgtcgcattcgtacacccgctcatcaccatgtcaatggctgccacgtgcacagtagcgagcgatggtcagggagactgagaaggtgacatatggagtcgatcatggcctagaccaaaacctttgtttagtttgacgcaacgaggaacagcaagntcctcgagatgacacccgagtgaacattcctcgcgacgttcacactggatgaacttacgttgatcatgccatgaattgcgagtcgaggcgctttgggaagggcccaggaccctgtcgcatttccttccgtaacttccgttcctgtcagggaatgctgcgtactgtaagaggtaactgttattgactctaggtatgcctttgcctttactagtgatcacttaaattatgaaatgaccgcccttttcattttatagcgtaggcacacacgttcttagtctttcaacttgttgtcttgtgtccgcgtgggagagtcatggataacatctgcgtggcttttacaaaaagtggttcatctgctgctgggggagacaccagtagagagggtgcgtgcgcgtgaaccagtgagcacaagttgggccggaactttggaatcgccgggagtacgttcccgttgtgaaaggcgctgtgtgaaacgg

SEQ ID NO: 629570 - DNA, 229 bp, Homo sapiens
  misc_feature (196)..(196): n is a, c, g, or t
  misc_feature (204)..(204): n is a, c, g, or t
tcaagctttatacttcgatgagtcttcatggagtaaaaaatgtatttaaaagaaaatgagagaaaggactaggagagccccggaattaataccaatcagaagggcaatgcttttagcattaaaatgacaggtgacttcaaaccagcttaaagtttaagtttaaacagttggtaggtgcattaaacataatttgaanggcgatcnttttaacaaagcagattcaaaccgg

SEQ ID NO: 629571 - DNA, 286 bp, Homo sapiens
tcatcgaatcccgagatggagaacatttggccacatggtgagaatcccatctctactaaaatacaaatattagccaggcatggtggcgtatgcctgtagtcccagctactctggaggctgaggcaggagaattgcttgaacctgggaggcagacgttgcagtgagccgagatcacaccagtgcactctagcctgggcgacaagagtgaaactccgtctcaaaaaaaaaactaaaacccattaaattagccggttgtggtgtccggtgcctgcaatctagcctggaa

SEQ ID NO: 629572 - DNA, 103 bp, Homo sapiens
tccgcatgaggcgtcacaacggagactcatccctctcctggtgcatgattcttactcttcttctttctgccaaagaggctcttggtaactttggcaagacaga

SEQ ID NO: 629573 - DNA, 989 bp, Homo sapiens
caccaggcggtgggctcggctcgggggcggaggcggtgaaaagggcggggagcgcgaggaggagcgacctggcctcatcgcgtgccgcctcttccccgtccgcatgtgacgagcgcctcaggccttctgtcgctcgccgccgtccgccctctagtcctcgccaccgcgcccaccctcctcagcgcctcaggctgagcagcgttgctggtgcctcgacagctgcttgcgtgaacctagctggcatactgcggtgtagcgccgcgcgcgaggcctgcgagcgtgcacgcccgacgatgacctgttggtgccctgtgggtaccgacctgctgttagccgcgagagtggcgcgatgagtggacggggccctcgcccttcaagagcggctcgtgtgcggcgaccgtgcatgctgtacctgcatacgtgagcctgcgttgagcgcctctcgacgtgcacgagcgcgttgtgggccggagccaaggactctgcgtgctgcgggaagtcgcaggtgcgtccgatcaaccatcgtcccgggacgttgcgctttcgagtacggcagcctgatagacccttttgccctagtttccacacgaagtacgggcatgactgggctgaggcccaaaagacggctgcaattgagggtacattctgagacccgtcttcccgagacacgcagtacattcttcagaccgacaatcaggaccagtcttacgaaaagcacaatcctctagctaactatcagtttccgggggggcctgcattcctgctcgggacgggttcaagagatggccccagtcaggaccaattttacctcgcgaggagagaattccgcgtttcatatacaagacttagggctgagggcacggcccatatggaagaaagttaccgagagcgaacaaaggcgcttacttgcgtgaaatgaggatccgggacctatggcccagccagagaacattcagcgccaggatgaagaatgacttacaagtaacccg

SEQ ID NO: 629574 - DNA, 350 bp, Homo sapiens
acctccgcctccatctcagaacatctttcccaatatgaaatgtgatgaaatataagacccatcacaggggagccagagattccagacaatcttacaaagaaaaaatgaaaataagccagaagaggaagccagaaaatggaagaactgctgatttcccatctagctcttcatcttttaaaataacaatgctatatttctggactttaatatcacattatatctaaaaacagcaaatgaggccaggtggggtgggtcacacctgtaatcctagcattttgggggaccaagacaggaggatcactgaaggcctggagtgcaagacagcaacacagtgagaccccttctctatt

SEQ ID NO: 629575 - DNA, 1283 bp, Homo sapiens
  misc_feature (1283)..(1283): n is a, c, g, or t
gactgctcttccagagcagtggatcaaccaaaatgagtgccctgggagctgtcatagcccttccatgcctctgagtggatcagcgtccttcttcgactaagatggcgatctcagggccaattcgagtgtcactgagattactcggtcatgactgcatcgtgtctgttaccgaatgcacccccgagaattgacataatggactatgttggacgacactcggctatcgatatcagtgtaaaggaagcatactatcaaatgctgcgcaaactgcaatggcagatggatgatgttacaccctttacaatcacactggcgacagtcacgttgtgactataaatagagaggctggtttgcgagaatatacacctttccctgaaactggtgcaagcacgtaattgtgggcgaacgacctgcgaatgaaatgtcccgggtaaaagaccctatagtaggccaggccgtgaacttcgcttgggagttgagaaccaatccctagggatttgctcacaaatgggctatgtccttttacaccctagtgtcacgttgacttaaacggattgggttatccccaacgcattacattctgcaacccataaaggttggtccaacggcttgattcaacttgaaagcatagtagagctggctagaaatcactgtgtcttaaaagatatttctcttttcctggaaacctattgcagaatcaatgcaaacctagtcggcaacagcaacatttggcccccatagcattttaagaatacttcctaatgctggggggagatcatagcaaggatttggttagaattaattgccgaaagggtcgatcctaggagcctataactaactgtcccaagggtatgcatataggcgtcgccgattcgcaaaactccaaaaacgcagaaagggtgtgctcctggtcgaactcgagacagaagttggattgcccccattaacgtgagacttattcctgtccaaaaacgggagttcactgccatgaaagcctcagtgagcggtgatgggggccttatatggatttcccctgtgccttgggggcgcgagaaaattgcccaaacattttcacaaattttacttggagcacattcttggacgttatgctcattgcattggcctgttgggtttgaacccacaaggaaccaagttgcgttaaggggcctttatgaaaaggtgaaggcacaggtccccgcaaaaaggaagtatacccggagaaagccctgttaaggggttagagcccaatacttgacttagaactaccttttgtcggggatatn

SEQ ID NO: 629576 - DNA, 95 bp, Homo sapiens
tcgccactccattttcctctctttctcttcccctttccttcgcgcccaagagcgcctcccaacctcgtaggggtggtcaacggagccccttcgcc

SEQ ID NO: 629577 - DNA, 205 bp, Homo sapiens
gcacccaggcgcacttctcgagcctcacctcatggccacggcacctcaggcccacagggagtactgccagactaccaccatgttccctttaggctcaagggctcttcagatcagcttgtgttgaatgctgcctggcctgggactcaccctttagagcagtgaggtcccttctggcctaaggcaagtccagaagtgcgcctgggtg

SEQ ID NO: 629578 - DNA, 428 bp, Homo sapiens
tgcaggattcggcactaggtagtagtagtgtagtagagtagatagtatagatagtagtagtagtagtagtagatatatagtagatagtagtgtgtgagtgagagagagtgttagtgtgagactttgtcatagccacctatatcctctcgttctgtcatactccctccctcctctgtctcctccttctccttctctctttcttctcctcacctactactctctcttctccgtccctccttcacaccttccccccctttctccaccttggtccgttgcttcttcttgtcctcactctttacttgcctctcattcctgcttccctctgcccgccttcaccctctccatcactgtctgtatacctccttctcttctccccttctctcccttccttcctctcatctctctctctccttctttcttcctgttct

SEQ ID NO: 629579 - DNA, 795 bp, Homo sapiens
  misc_feature (1)..(1): n is a, c, g, or t
  misc_feature (454)..(454): n is a, c, g, or t
nttgccccagcatctcagccaggaccatacttccgggtctcttaattctgaccggctttggagattcgaaccgacacgtccaaatttcttccccaacttggcccgccccaatgggtcctcgccaccgtgaagaccacattccccccattatgcgatcttccggaccacatcccaaggcgcccaccttttagcgccccacccacccaccagggggcccacccctcctggccccacctgtctgttgaaggggcccacagctgcacatttgctggtgtaagcactttcaacgtgttaactattcacgagaccacgagcgtctgtttaaacacccacagaggagaaccacgttcttaaagtaatgaaatgctgctcaccaccgtggaaactaaccggggggagctcctcgccccaggagcccgaataaaccttgctctgccttattaaaccccggacngttcaggccccggggcttgggaaacccaagaacggaccgatagcttgagcccttggattccgccggaaaggccttccttctggcctccaggagcctaccccgagccttcaccaggctgagttcttgcctctgtgtcctgtccctcctggaaatcaggactctgcttcctcagggagccccgggaaaggcggagctcactggccacaagccgagggcacctggggccgctcagtccccttggggttgtcctgaggttgagcctgggggggcccgtcctgcccgcctaaagagaatgcccccaagccccgcaccatcgtggtccccataactctgccttcgcc

SEQ ID NO: 629580 - DNA, 912 bp, Homo sapiens
tgaccctgcaacctctgggtgaagctgcttaatctgctgatgagtatgatgacacgtagagtattaacgtaattgctgcccggctctatagtagcactaagactcgactggatctcactagcgtactgtaccgctaactctctatgaatctcaagtcacttggtgctacctcatgaccctggagatacgttgacttggagaagaaggtggtgcggttaaattggctaggagctatcgaacgagtagcgactagggcaccgacatcatgagcgaaaacgcagacttagtaatgacgtggctcgtacctaccccgctatggctctgtagttgatgcgaatttgatccaattatccattacctgcatcggtacctataaccatttaagggggtctgatccagtctgggctataaatggtgtactcttaatcttagcacagactagaatatccatgaacactaccagttattgttctcccatcgagtaataccttccaaggaggagacaagagtattgtctggcgcccgtataattatgatagtactacgaatgccgagatacgcacaaatcatggatagctgcattctgggtatgggtctgatatactataatctggtagtagcatcatacttagcggacaacccattggcttgaactaaaggatgattgtaactcaatcttgatggcttctgaaccttaatgttctaggagttcacagctctcgtaatatgaattctgttgctccactcctgagtcctagtcccttctcatgggatgcttgggagaggaagacagattgtgtactcggatggaggatcgccagaaactgtaccgttgtttttacgcttaaaacaccctaacgttatactgggggtaattccgacgggaactgttgcaggcgtgtccaggacaac

SEQ ID NO: 629581 - DNA, 465 bp, Homo sapiens
caaaaatgtgtccctgagataaatttattaattttggcactggtccttttttcgctctgtatatgccacagtcttgtcctcaaacttgtgagtgagatgtaaaggacgaaataagatgataccctctccattatcatcatactcgttcaacagagactcaacattcgtatgtgcaaatcggtagttatccctcaagttgctggctgcttttaggaactcggagtgagcctcactgaatgaatcatcgaaaaaacctactatagaggcttctttatcactaatgaatttcttaaattcttcctcagtcctgagaggcactgaagctggtcctgcctgcttcttcaggtggctgacaattccatcagcagtcctaggtccatcataagcgcctgcttcttcaccatctctaaatatcttcagggttggatatccactgactccatatttattacaggtgttagtgtt

SEQ ID NO: 629582 - DNA, 890 bp, Homo sapiens
aaggaggagagccacgagggccttagacgatatacctggtggtgttgtcggcgtaatgttgcaatctctccggggccctccttctaggccggggcccactggaagtctgggacacgttctagcctggacaattcgctccgcgggaggatttccacatccgcgttgttccctctgcgatcccgtcgcattatgtcctctgtcgatattggctctaatctaccggtctaccaaattgcgcgtaacgtttcggtactctattctcgccctggtcacgtgggtggtgaattgtctctcccttcggggaccctcgggctccccattgtgtctgtggacacccccccgctcccaggggggccctggtcaacccttccggcctctgtggtccggacgatatggtcggtgttccccgggcacctctaaggcacttgtgagggctcattctccgtccctcctcccgtgtacgctggggataatcttcggcactcccctctgcgggcgcccgactctttggacgggcccatatggatttcacactggcgcgagcaggtccaccccgaccagactcctggaactcgaccctcccgcaagttcttgccccagcctcccgcaccgttgtggtagttactccaagaaaagtcattgctcccctctgtgtccccagttgcgtgccgtcgagacaggcccgtcacggaacttacatggttgtacttggggggaaagccccacgtatgctgggatctacgcccacttcgcgacccaccctggggtcaggagctctagctggggccaccacgcagcctcagggggactatcatatctcgcaacaagagttaattgggtcctaaaactataaaaaaattcatacccccaggaattaacagcccacaatg

SEQ ID NO: 629583 - DNA, 461 bp, Homo sapiens
  misc_feature (159)..(159): n is a, c, g, or t
ccttcgtggagtgctcccgaaggccaggcccaacatcgccgtttctaccgcaggcgaaggttcccaggcgtactgggatgcgttgaccctatggccgtcgaccacagtattccaaccctcctgtgcagggagaagcgatggagggtgctgacaaccagngtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccaccttaacgtcggtaccgccgcaacttcaattaccgacgcagacgcccagaaaaccctaaaccacaagagggcaaagagacaaaagcagtcgatccaccagctgagaattcggccgctcccgaggctgaacagggcggggctgaagaa

SEQ ID NO: 629584 - DNA, 175 bp, Homo sapiens
tagcgactggatggtagattggtgctagtggagtaaaagagtataactggggtaggtaggtatagtaggtaaactatataatagtagtaggaagctgaataatttatgaaggagaggggtcaggatatgattcgaggaggatcctaataggccatgcgtaggatagccagagagg

SEQ ID NO: 629585 - DNA, 380 bp, Homo sapiens
atacgtttttaaaacatagaatggaattgtaaaggaaggtctgatcaatttggtggatttcggaaggttactatggaatttcaggtctttggaacatgtggtcgttcccaagttactgattcctacccatgcattacactttacactacgccggacagtgtccacaatgccatcctcttctgttgcgattggaatgcagatagtctagtatgtctactcaaggtaatttctaagccgtattgaagcgtttaaatactcctcggttgagtaaaggctcgaattcaataccatgcgtttttatgaggcatcctcgtatctattttgctaggactcgagtgcccaattggatatgcatccgattaacctcttaagtggattcc

SEQ ID NO: 629586 - DNA, 138 bp, Homo sapiens
gtattcacactagtaaacatcgtgctattcagaggtcgtgcgaaaaccaggtggtaggcatagatcacctttgtagcccatccacggtctccacgccaatcatctttggtgaacatccacatcatccgcgttgtcttc

SEQ ID NO: 629587 - DNA, 229 bp, Homo sapiens
tagagatgctactggtatccaccatacagcctagaaaagcacggggtacagaggcagactacaaattaaacaaaataaacattaaaagcctctaagctgggcttggcggcacacacctgtaatccagctacctcgggaggctgagacaggagaatcactttgatcctgggaggcagaggcttgcagaactcaatggccacttgccactccaagcctggcgcgacagaag

SEQ ID NO: 629588 - DNA, 167 bp, Homo sapiens
  misc_feature (60)..(61): n is a, c, g, or t
tcaagctcggttgccttttaattcagcttggcacttcaactcaggctgaacttgcacttnncccctgctgtatatcgtggtctatatccccgatacacattctgcctcactggtctaccttgtctcctgcaccctggttgtcagctacccctccatcacttctcccc

SEQ ID NO: 629589 - DNA, 1436 bp, Homo sapiens
cagcctgggcgatgagcgaaactgtctcaaaaaaaaaaaaagttggggatctcgactgtgttgaccagagctggtctcgaaactcctggcctcaagtgatcctcccaatcttggcctcccaaagtgtcaggattcacaggcgtgagccaccacaccctgcctggttgtgtactctttataaattactaaggcttttcaactgcttacaactgctgccttttacgataccactgtaaacaattaccaccctattcaactgaggcttctctttacttacaaaaccatttgccaattggtacactaacaactcttaaatatacactaagagccaataacatccaacggccttccaatggtcgaggtctcacataaggtataatcctcacattaccattctcaattttccaataaccttctggtcacaacgatgcgacagccacgagttagcttttcccaattttctccccttgaagggcgtgaagaacataacgattgaccccatggaccacacacgtggtacaaatagaggcccacaaggttcacacgctttgaagaactttggacacgcatcctcggaattcctaagatcaccttgtgatgaaccaatttcagcacgagctctgaggtagcccacggctcaaacaccgacgagcacataagtgactccacgcccttgtgggcccaccaacttacgcgcgctaccacttacagcattggtctccaccaacacgttcacaaccactctcgctcaccaccttgttaaacaggcggtctctaaaactccttattacacacgtctgcaatctacacgacacaccggccaacttctccataataaacctcgatatacacactgcggccgccgtttcctaaacgccaagcgcatactacctacattattaccccccaatggataccaacacacgcacatattgcccaattatttgcgttaaccaccaacattttgtccaaccacacaccaacaaacttttagccactttatacccacacattatttctcaggcccaaccgctataaacaaagggggccccctttatgtgcgccacccaatttttggaaaaaggctcctgaggacaacctctgcgagcatttagggacccgccccacacacatgcagaggggacagaccgacggggggcaccaccagcgaagaagacacaacgggcacaagcacgcgacaagccgcacaccacaccagcggggagacaaacaaagacacgatcactacaaccagcgacgctctagacagaacgccggaccgcccacatcccagaccgcacatgtgcgggcgcatcccacaaacacacacaggccgccacacccagacggaagaacagacgagacgactgttacctaaacgcacgcagaacgcccgctactgcacaccacacaacctcacagcaacggagagccca

SEQ ID NO: 629590 - DNA, 232 bp, Homo sapiens
ggtgtggcccaggctggtctcgaactcctgagctcaagccatctgcccacctcggcctcccaaagtgctgggattacagacatagccaccaggcctggtctcataactggctttagagcataccaggtggctgtagtttggcttttttccaacttatcaataggatggaagcatgtataagaatgggactaataaatcagaacttggcatggatagggacacaagtagagaa

SEQ ID NO: 629591 - DNA, 372 bp, Homo sapiens
actgtagggcccattccaacaatctcgtataacatggtggatgactatgtaagtactaggcgtgcagagacatgcctcacccgcgtatatcataaaggcatatcgggaactggcactgaagtggcatccagatcaaaatcctcgagaataaagaacgatagcagagagaaaattcagagcaagtagcggaggcatatgaagtgctgtcggatgcaaagaaacgggacatctatcacaaatatggcaaagaaggattcacatggtggaggaggaggtggaagtcatgttgacagtccatttgaatttggtttcacattccgtaacccagataatgtcttcggggagatcccccggtggatggggcccccacat

SEQ ID NO: 629592 - DNA, 146 bp, Homo sapiens
caagcagagctaactctaccactgaagagttgcataagtatcagaaaatgttaggaacaccaccctcagaccaaggcccttcaccacttgatgtggacaagaggtttaggaggaggggccacaaggagtatatgggctcttgtcgg

SEQ ID NO: 629593 - DNA, 208 bp, Homo sapiens
  misc_feature (99)..(99): n is a, c, g, or t
  misc_feature (109)..(110): n is a, c, g, or t
tgatcccgactttttttagcacgaatgtacttatccgccctggttgagcagttgcacgtcggcatggacttcaacatcagccgcgatggcgcgacggtngcatgtcatnntcgtgaacggtcctcccctgctgcgttactcgcgaaagaagccacggccaaccttttcgacacggcccgggcgcggaactgaatcgtttcccggggaa

SEQ ID NO: 629594 - DNA, 131 bp, Homo sapiens
  misc_feature (5)..(5): n is a, c, g, or t
tgacngtaccaattagaacatacatatttttgggtgtcagtcattatctctgggccatttttgtcaaaaattaacgtatttaatagagaaggtgtttaaaacaaaaggagggtttgttgtacccgagctcg

SEQ ID NO: 629595 - DNA, 223 bp, Homo sapiens
  misc_feature (189)..(189): n is a, c, g, or t
ggatcctcgtcgttctcgtgtgaatgagggttctatgctgttaatgtggcgggcgagtgagcctcattgtgttgacgtaaatatgtacagggagtgtacggctgtgactcctatgtcgagtcccgtgagtcagagagcgatctttgatcatgagaacgtggatactagcacagagagttctcccaatcngttaatagtggggggtacggcgaggttagccagg

SEQ ID NO: 629596 - DNA, 531 bp, Homo sapiens
  misc_feature (2)..(2): n is a, c, g, or t
  misc_feature (521)..(521): n is a, c, g, or t
gntggagagggggttcatgtgagggaactcacgattaacaacagaaagctgtgagagtagaagaggggagactgtatgaacagagcactgacggggctttcctgccagtgcccgaactagggtaagggagctgggcccacagagtagactcagccgtggtggagatgccacctgatgtggtggtagggggaagatacccggtttctcccttcttcctgacctccggcctcaagctcgctctagccctcccccgggccaagcctagccagaagcctacgggcaatgccactggcagggcagcccccaacatgcagagcaggtaagatatctgagggcatctgagggtaagcaggctcaggactggcccagatctgctgaaatccaaaacgtttatatgaatgactcggagtggaatttaagacacctctaaggctgagcaagaaaccgtgactatttgaggccagaagcagagacagggctgtcctcgtgatgagccacaatccagctatgtaagtgactgnctattctaag

SEQ ID NO: 629597 - DNA, 101 bp, Homo sapiens
ggatccctcggagtacgtccaagaagcacatattaggaccaaagatagcatcaactgtatatgaaggaactgtagtttgtgcgcatttcttatgacatttt

SEQ ID NO: 629598 - DNA, 245 bp, Homo sapiens
gtcgacctggagtcttggaagcttgactaccctacgttactcctacaaatggaccttgagagctgttggaggttctagcaggggagcgcagctactcgtatacccttgaccgaagaccggtcctcctctatcggggatggtcgtcctcttcgaccgagcgcgcagcttcgggagggacgcacatggagcggtgagggaggaaggggacacccgcctagccagccatatcagccgaatcaaccctg

SEQ ID NO: 629599 - DNA, 106 bp, Homo sapiens
ttacagaccccacgatcaccagacagagcctccccatctccttgctgcctctccctaaacaggagtcaggagacgaagtctctctctctctctttccagggttatg

SEQ ID NO: 629600 - DNA, 602 bp, Homo sapiens
  misc_feature (59)..(59): n is a, c, g, or t
  misc_feature (171)..(171): n is a, c, g, or t
  misc_feature (177)..(177): n is a, c, g, or t
  misc_feature (189)..(189): n is a, c, g, or t
  misc_feature (194)..(194): n is a, c, g, or t
  misc_feature (201)..(201): n is a, c, g, or t
  misc_feature (421)..(421): n is a, c, g, or t
  misc_feature (429)..(429): n is a, c, g, or t
  misc_feature (438)..(438): n is a, c, g, or t
  misc_feature (440)..(440): n is a, c, g, or t
  misc_feature (508)..(508): n is a, c, g, or t
  misc_feature (519)..(519): n is a, c, g, or t
gccacccagcagtatgtgggcccaggccaacagctggtccctggagaagctctgctgtnaagtcaacgtcccacctcacagggcgccacccttgacgcttgcagcttcggagtcacgggtttgaaacttcaaggggccacgtgcaacaacaacaagctgtcactgtccaangccatntcaaccgccttnccctnacgcagntgcgtgggtcaagcagacaaaccccgagaagaaggccagtgtggtaaccttacctgtctacctgaacttcacccgtgcagacctcattttcaccgtggactttgaaattgctacaaaggaggatcctcgcagcttttacgagcggggtgtcgcagttttgtgcacaaagtaaacttttctaactgcccccttctgtaatagtgaaaggtgggatttaacntttattcntttttaaanantttggaaggtttgagcttgtgaaaaaaaagtggttggttttaggttggaggaaactgaatggaatttnacggttgggantggtggaaattggaaggataccaggaggtatttgggaaggccaatggcgtggctcctttgaggaaataaaacactaagcatta

SEQ ID NO: 629601 - DNA, 561 bp, Homo sapiens
  misc_feature (34)..(34): n is a, c, g, or t
  misc_feature (376)..(376): n is a, c, g, or t
  misc_feature (462)..(462): n is a, c, g, or t
  misc_feature (473)..(473): n is a, c, g, or t
  misc_feature (483)..(483): n is a, c, g, or t
  misc_feature (514)..(514): n is a, c, g, or t
  misc_feature (519)..(519): n is a, c, g, or t
  misc_feature (541)..(541): n is a, c, g, or t
  misc_feature (558)..(558): n is a, c, g, or t
aaagtcataaccatctccattttccatttacttntaatttgaggtgtttgagtgtgtgcgcatattttaacaaccatataacaataatggaaaaagaaaagacacttcattcctgagaggtgaaatttaactccaacaagaaaattcaaatgttggcccaaacaggggctcactttaatattaaaaaccattttacgaaacataaacaaaaacaaaaaacttcacattacataaaattattacagctaataatttaaacaagaaattcatactgtttttgcactggatcgctttttaacacatactaccttgaagtcaaatagaacaagactgtattcctaactctaccagttactaattacaaaacagaaaattncctgaacctcaaaagtttccttgtctgttaaataccggaaggatgacaggaactatcctcacatgactaggtgacaggatgaagtnaaaataaaggnaaaagccctntacttagcccatgacattggattttcatttnatttngaggaaaatttcaacaattttnttgggtttccaaaaaanaat

SEQ ID NO: 629602 - DNA, 228 bp, Homo sapiens
  misc_feature (129)..(129): n is a, c, g, or t
ttatatcaaagagtgcaagttagatcaaacaacatcaagaaaatgcggtcctaaaatattaaggtcttttaagaaagtctaaaaacctccttttttcccacggacttcaaaacttggagttttatatcnagaatatcaagttggtcattttaacctttaccattacattgaaataattatcacaaaatatatcggatggggtctatacctaaatggtgctgggggtac

SEQ ID NO: 629603 - DNA, 144 bp, Homo sapiens
gtggtgtcgcggtcagccatgataccagacacagcgctggctggtgtgatgcaggcctgggtgccacgattcccagcctggagccgcgccaggacgtgggagaccttctcagagactctccgggcacactctatgaactccttc

SEQ ID NO: 629604 - DNA, 791 bp, Homo sapiens
  misc_feature (10)..(10): n is a, c, g, or t
  misc_feature (67)..(67): n is a, c, g, or t
  misc_feature (116)..(118): n is a, c, g, or t
  misc_feature (121)..(121): n is a, c, g, or t
  misc_feature (127)..(127): n is a, c, g, or t
  misc_feature (129)..(131): n is a, c, g, or t
  misc_feature (136)..(136): n is a, c, g, or t
  misc_feature (138)..(138): n is a, c, g, or t
  misc_feature (140)..(140): n is a, c, g, or t
  misc_feature (147)..(147): n is a, c, g, or t
  misc_feature (151)..(151): n is a, c, g, or t
  misc_feature (160)..(160): n is a, c, g, or t
  misc_feature (168)..(168): n is a, c, g, or t
  misc_feature (170)..(170): n is a, c, g, or t
  misc_feature (172)..(172): n is a, c, g, or t
  misc_feature (180)..(180): n is a, c, g, or t
  misc_feature (185)..(185): n is a, c, g, or t
  misc_feature (193)..(193): n is a, c, g, or t
  misc_feature (198)..(198): n is a, c, g, or t
  misc_feature (201)..(201): n is a, c, g, or t
  misc_feature (204)..(206): n is a, c, g, or t
  misc_feature (208)..(208): n is a, c, g, or t
  misc_feature (245)..(245): n is a, c, g, or t
  misc_feature (253)..(253): n is a, c, g, or t
  misc_feature (255)..(255): n is a, c, g, or t
  misc_feature (274)..(274): n is a, c, g, or t
  misc_feature (276)..(276): n is a, c, g, or t
  misc_feature (281)..(281): n is a, c, g, or t
  misc_feature (291)..(291): n is a, c, g, or t
  misc_feature (294)..(294): n is a, c, g, or t
  misc_feature (296)..(296): n is a, c, g, or t
  misc_feature (312)..(314): n is a, c, g, or t
  misc_feature (317)..(319): n is a, c, g, or t
  misc_feature (321)..(321): n is a, c, g, or t
  misc_feature (326)..(326): n is a, c, g, or t
  misc_feature (332)..(333): n is a, c, g, or t
  misc_feature (338)..(340): n is a, c, g, or t
  misc_feature (349)..(349): n is a, c, g, or t
  misc_feature (351)..(351): n is a, c, g, or t
  misc_feature (361)..(361): n is a, c, g, or t
  misc_feature (378)..(378): n is a, c, g, or t
  misc_feature (380)..(380): n is a, c, g, or t
  misc_feature (384)..(384): n is a, c, g, or t
  misc_feature (387)..(387): n is a, c, g, or t
  misc_feature (403)..(403): n is a, c, g, or t
  misc_feature (408)..(408): n is a, c, g, or t
  misc_feature (412)..(413): n is a, c, g, or t
  misc_feature (430)..(430): n is a, c, g, or t
  misc_feature (452)..(452): n is a, c, g, or t
  misc_feature (465)..(465): n is a, c, g, or t
  misc_feature (481)..(481): n is a, c, g, or t
  misc_feature (485)..(485): n is a, c, g, or t
  misc_feature (491)..(491): n is a, c, g, or t
  misc_feature (501)..(501): n is a, c, g, or t
  misc_feature (516)..(516): n is a, c, g, or t
  misc_feature (520)..(520): n is a, c, g, or t
  misc_feature (522)..(522): n is a, c, g, or t
  misc_feature (527)..(527): n is a, c, g, or t
  misc_feature (529)..(529): n is a, c, g, or t
  misc_feature (533)..(533): n is a, c, g, or t
  misc_feature (544)..(545): n is a, c, g, or t
  misc_feature (557)..(557): n is a, c, g, or t
  misc_feature (574)..(574): n is a, c, g, or t
  misc_feature (584)..(584): n is a, c, g, or t
ggaagatcancaccctaagagatgggactaggacctgagcctggtcctggccgtccctaagcatgtntcccaggagcaggacctactaggagaggggggccaaggtcctgctgaannntanccgtgntnnnattcntncntccggcnatantgcgtttgnagttggantntnagggattntgggnttggggtntgggntgnccnnncntcgcagaccaaaactatctaaactcacatatcaaaancctccaancnttcctccaaaaatcctctnanttttntcccttcctntcncnttatagacacttactnnnaannnantcacnacaacnnaaacnnnttttttttntnccttggttcntttttttattttccttntnattntcntccttgcccagactanagggnttannacttggtttgttatatnagggaaaaggagtagggagttnatctggagggttntaagtgggagaaggantatnaacacnactaggaatnccagaggtgggatcntccntnatggntntggnacagtgtaatnnaggggtgtagangggggaactgtgaatanttgaactttnttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctca

SEQ ID NO: 629605 - DNA, 861 bp, Homo sapiens
agaactgggtagcatctgagccagtggagatttgtgacttctccttcttctaggagtgcgtgatcagaatggtgtctggacggttctactgtgtcctgcctgctgctggggtccctgggctctatgtgcatcctcttcactatctactggatgcagtactggcgtggtggcttggccgtggaatggctgtcgatctacatgttcgagactggcaccctagttgcttatggttgctggcatggttggtagttctatggaggtgcgtcactggttgtacgcgcctgcgcccagttcgtgggtggggcccgaacgtgcctggaagactcctccagtgcagcgctgcctcctgcatggccgttcgtcctcactgtccgtgggggctggtttggctgtctttacgttttcacaaccatggaaggtactggccaacgctctactgcccgtttcgacagctggcgtggggcattcgaccactgttcgttcctcttcgcctgccagctgggttcgcgtgggtctttgctgtcattcctcctgaccctgggcgtcgatgtgggatgcgcagtgctcctaaaacctatccacgttctgtcttgggagccgccagtccgtctcgtctgatcgcatcggcagtccggtcatttcggggcatctagagtgagaagctatgctctcagttttgaaaagacaccaccaggtccataccagcagccgtgcccagtgaggcggtcttatgccaatcagcaccgggatgctggtgggtggcctctgggctgctggtgctctacaatcctatctggcgttcatctgagaagacgccagagcggggatcctgaccgaaagagaggccctgactgcatgatg

SEQ ID NO: 629606 - DNA, 1530 bp, Homo sapiens
ctgcaacaaaggcttcaccacggcagcataacctgcgcactcacgcggtgaatggaccacgggctccaggccccgcgggttgagcgcatcatgtgcaatgctgtgcatgcgtgcactgcaaagacccctgcccagtctggccggccacatgcagacccatctggcgggggagccggccacacatgatcccgggagacgcaccaccagccagaagcccacacatgctgaggggagaccccacggcaccacacgcaggatacgtgcatgaggtcatagtccaatgcgcctggcggcagcgtgccagctggtgccgcgaaaggcaggcaagacgagcctggcgccaggccacgccaacggcaatgaccccgccatcccccacaagaaactagctcgcgcggcatccccactccatcagagcggcgagcaggaacggcgagcgattagcccttgctcgaaaccctcctccagacaccatgcaattatccacttcccaccaaaacaccgcgtcgcggatgagaggctctcccacacacgatccgggcgacatacggcggagagccagacagcaagaggggccaacgaacatcggcgcacgctaaaggacagataccgccactacaggggcgacccaaacagcccgtcgcacgtgcatcccccgcgcacactcacattctatcccgcaaccgccaacaagacctcccacataacatactctcgccgcgcatacaccccaacacaccgccaacaccgaacagaccccgccagccagaaagcgacacacgcgcccaccacccgcgagcgcgagagccacaagcagacccacaccacacgcctcggcccaacagcccactaccagcggcaggcagacacaacatacccgagccgctcaccaaggcctcgcccgaacaacccgaccaccagccacgacaacctaccactcccacaactcgccagcctcaccaccatacagcctctcccctcccaactccgcagcaccaccctctaggcgacgacccacccacacagccaaacaacagccatgacaccaccgcgcaccacacgcggcacgcccggtcgagcacagcaccaacgcagacccaacaccgcacttgcaacgaccacgccatcgcgagcgcaccaaagagcgagaaagacacagcgcgcccaaagagggcacaaacacggcaaggccaggacacaccagcaacgacaccaccgagcaatacagcgcgccgccgcatccaatcgaccaccgacatcgagggcaaaacaagcaccacgacaggacggcagcaccactcggacgagatatgacccgcacaaacggcagcgacaagactcgacgcgtgagcaaaagcaccgcccagcacaacgaccgcacaccgatcacggccgaagcgacgggcactacccagcacgaacacacagatcgacccagcgcacatccgcagcagaaaccaccttacgcaaccacccctgccccatgcaacagagtgaccaggtaggacgccgagcaccgacaccacccag

SEQ ID NO: 629607 - DNA, 441 bp, Homo sapiens
tttgcctgctatatatatttacatacttctttcaaattttccatatccttaggttttagttgtcatcatttagaatagccaatgtaaaatatcatttttgctgatagttagcccatcttgcataagcttctggacacatggacgctggaaggtccatctggaccatctggaaaacagaccttgaggcaaaagttcatgtgttacaactttcttgaggcatagaattttcagaaacgcaagaggacacggaaacattcaagactaaggagtctgtccctagaattttttattcgcagccttgcttgacagttgattgctaattgttgtaggaagtctccagagaggctatatgcaacatattataaaaaataatttacaggaagggatggcaaacatttatttgctgcccccctctgttttctccctttgattggttaacgt

SEQ ID NO: 629608 - DNA, 188 bp, Homo sapiens
tcatccctgcatcactcggaatgcatttcacacgtgctgcatggcacagtgcattcaatcaccctgcatggaatccactgcattcaatcggtatcaattacaccaatgctgcatggaatccacttcattcaatcgagatacattgcaccacatctgcatgtgaatccaccttcacatcaataattgcg

SEQ ID NO: 629609 - DNA, 229 bp, Homo sapiens
gcctataccatctagctcgccatgaggaacactacagtaacaacaccacggtccatagaagcataattagtaactatacagctaggataggctagcaggcccacccaagggtagcacataacactaccccaccctactactagcaggcaagcaaacaccgataccgaccgcaccccagcctacaagcgggaaggcctatatatcccctagacgctagtaaaactagggg

SEQ ID NO: 629610 - DNA, 311 bp, Homo sapiens
cccatcgcttgaagtagcgaatggggtttggtacttagagcatttgcagaaaattaatttttaagctgttgtaaacctgtttttagcaattactttgataaaaggtgacttatcatgaaacatacgggaaaaaacgtcgttgtccttggtagccagtggggcgatgagggtaaaggcaaaatcgttgacttattgactgaaaaagccagtgcggtggcgcgctatcaaggcggtcataatgccggtcacactttagtcgttggcgagaaaaaaaccgtattacatttgattccatcgggtattctacgtga

SEQ ID NO: 629611 - DNA, 454 bp, Homo sapiens
gaacccctgggaggctctcgggttctccccaaggccccaggggtttttttccaatttgggcccccggcctttgcctcttcccctatgggggcccccaaagggtgagggcccgggcaaaaaggggctttcctccctgggggaatcccataaagcccctggttgttctcagggggcccctttccccaattgagtgaactgccttgtgccaaggggcttggggttcctgaaaacttcaagctccgggaaaatgggtgggggcccgttttggcaacccttttgggcaaaaatttcccccctggggggcgggcttcctggcaaaaaatggggattgggggggccagggccctgtcccccaaaaacccttgggcccccggcccatgatgcagggctttcaaggatgggtttttttttgcaacccatcaaataataaattttttttgttaagggttcccca

SEQ ID NO: 629612 - DNA, 464 bp, Homo sapiens
  misc_feature (114)..(114): n is a, c, g, or t
  misc_feature (139)..(139): n is a, c, g, or t
  misc_feature (141)..(141): n is a, c, g, or t
  misc_feature (207)..(207): n is a, c, g, or t
  misc_feature (235)..(235): n is a, c, g, or t
  misc_feature (250)..(250): n is a, c, g, or t
  misc_feature (255)..(255): n is a, c, g, or t
  misc_feature (277)..(277): n is a, c, g, or t
  misc_feature (300)..(300): n is a, c, g, or t
  misc_feature (312)..(312): n is a, c, g, or t
  misc_feature (374)..(374): n is a, c, g, or t
  misc_feature (408)..(408): n is a, c, g, or t
aattttagtttttagacaaacacaggatctggttttccatttttgctctgtatacaaagtgacgttaaaaccatttcaaagtcaaacaggtctcctctccatccctcagccctnaagaattcaaacagggctgggtttngnttggcagcagggagtggcagtagctgtgaaaatgcttgtcaaatgtaagaaggtgtgatatgcttnaggaaagaaaattgccaggagcaagaanggatagaaaacatgnatacnaattgaaacagctgcagaaganacatccagtttggtatatccatntggtgatctctntatcagaactaagtgtcttaacagcccttttgaaattgaaaatggatcttccatcgattcanagctatcactggctcaaactagctcttggtcaangaggtcatctggtaggttactgcccactactacacactggagtctacatcaaactt

SEQ ID NO: 629613 - DNA, 698 bp, Homo sapiens
taaagtctgcaggcccaaatgaattagttaaactgtagactctttattggtagatttgtctgggagttttcaaagggactccagagcagctcccatggagttccccttccagcaaatcagctatttccggaagttccaccctttacagctctagcctgtctcttttttccgtcaactaactcccgtctcaggcctgttacatttgctctccaaacattagactctgaatcacattgggcatttgtctgtctaggacagtgttttaaactgaaattcaggaccattaataaatgatgaaatcattttggtgggcaacaactaaaaaaaatttttaatgttttatttgaagtaaaacatacagaaaagtaaacaaatcataagtacagcatgatcatattttcacaaagtgaaagatacccatataaatcagcacccagatctagaatcagaacataccagaactccagaaagtccttgtgtcttctgttcaattcctaacacacttagaactacattataactggagtccataccttttcttttaacattggtttcatttattaagtgagaattcatccaatgtcgttgcatatagttgtcatttttaccattctcatgctggggtaggattggcgattataaggcatttaccaaaaagtctatcatggtgaagggacattggggtatttcagattggg

SEQ ID NO: 629614 - DNA, 199 bp, Homo sapiens
gcgcatcataggtcaggatctcacattctgtccagataaaaccgtcatgtctctgcaatgtcgttcccaactaagtgttattgaacccaatgtctggatacagtacgagcactccctcgatgatactcagttcagttcacgggggaatcagacgtttagtcccctactctgtctactgaagctgctggtgccacgggtc

SEQ ID NO: 629615 - DNA, 276 bp, Homo sapiens
gataagctaaacccaaaataagcagaaggaaggaaataaagattagagccaaaataaataaaatagaaatagaaaaccaatagagaagatcaatgaaaaaaaaatgggttctttgaaaagataaacaaattgacaaacctctaagtagatagataaaaagataagctaaacccaaaataagcagaaggaaggaaataaagattagagccaaaattaataatatagaaaatagaaaaacaatagagaagatcaatgaaaataaaatgggttttactg

SEQ ID NO: 629616 - DNA, 100 bp, Homo sapiens
gatagaaaaaagactgccagtttttccttgactctttccgttgcagaagcgatttaacagtgactatctcaaaaaataaaaaatggttaggtctacctgg

SEQ ID NO: 629617 - DNA, 124 bp, Homo sapiens
ttttgcattcttttggcctcattccagaggctcacgagctagcaggcataggagccagggagttgcaggttgagaagagaagcaggttttgtacacgtgggatggagtgtgcgtgacataggga

SEQ ID NO: 629618 - DNA, 199 bp, Homo sapiens
  misc_feature (77)..(77): n is a, c, g, or t
  misc_feature (92)..(92): n is a, c, g, or t
  misc_feature (154)..(154): n is a, c, g, or t
  misc_feature (168)..(168): n is a, c, g, or t
  misc_feature (172)..(172): n is a, c, g, or t
atgtgcagcgccaggtgatcggagcgcgagaaggcacgatcgcacagatggcactggaacatgcggtggcccgtgtnctctcggtagtggcncgtgagctcgtctgagcgcgcaaacttccagccgcagccgtcccagttgcagtggtagggcntctcacctgtgtgncgcncagatgcgccttcagatgcgaactctt

SEQ ID NO: 629619 - DNA, 1434 bp, Homo sapiens
tgctatcaacagtagcttggacggaacccggcgctcgttccccaccccgtgccggccgcccatagccagccctccgtcacctcttcacctgcaccctcggactgccccgaaggcccccgccgccgctccagcgcctgtgcagccacctgccggctgccgccggctctccttagtcgccgccatgacgacctgcgtccacctcgcaggtagcgccagaactaaccaccatggactcagaggccgcacatacaaccgccaggatacaacctaggagctactaacgcctaccgtacgtaataacctagtacccatgtacttaactaactatattgaccgcggatgatagtaggctatacgcacagcaacgttatgccaaataactattccttcacccaactactaccatgcaggcagagcgcgaacgatagcttgacgaacactagactagaagcctgcgagacaccaacgcaggtaggcgcgaaatactatacctatacaggccataatacaacgaaaaccgagactagtagatgcactagcggagcagcgggcgctgacatagcaataggagtagttgcatataccatattgggacaaaacaaatgtagacctccactcacctaacgtgggaaactggcacgaaactagggcgacttgaccaaacacattgacccccccattattggtgtagactatacatatgaagcaccaacaattaacgctgagattagagcacgcgtgaagagccactcgacacggactatggcgtgacccaacgtagagccgaagctttggtgccgctgattgggcacgcgccccgcacatctaggctatgggcggcgccatatactctttctgcccaggccacacccgtgggggagcacagcgtgcatacgtctaccgagcgtaaggcgctcgggcctacagtaatcccccgaataggccgcggggcgttgactttcccgctgggtctccccgcagggcccgtgggccatttccgtgatacgggcggcattccctttaaccccattcaccaaagtcacgactggatccgcgacaaaccaattcccccttcaagcatctttggcggcttgggacccccgtactccttcccgactacggcaacttcgggctcaccccccgggaaccacagtcgaaacaccaccaccgacacacaaccaacagcagcagcaccacataacatgcggggcgtggccacacctgaccacaagacagcgaccgagcccgcacacacacagctgacccctactatataccaagcggacaacacgcgggcccccatgggggagttacagaacggcaccaccccacaacgctgaacaccgcacacccaccaactaacaccaacaaccaccaaatcctacgcaatagcgaaccacatcacaccagcacccacgactgacacgacaacac

SEQ ID NO: 629620 - DNA, 993 bp, Homo sapiens
tctcctgcctcagcttcctgagtagctgggattacaggtgcatgccagcatgcgcggcgtaatttttatatttttatgagagacgggatttcgccatgttagccaggctggtctcgaactcctgacctcaggtgatctgcccgcctggctcccaaagtgctgggattacaggcgatgagcccaccagtgcctggcgttatggcttagtttttaaagttatccgtccagaaagatttgggccttttggtctgtggggaaacaagtgaagctgctcttcagcatagacactaccgtttatcccatcattgtagtaaaaactaggtggtttcacttctgaggtgtcttattaattgtacttcatctgagaattggtgatcttaatgtgcgagcgtatataagaactgccattaaaaaaaagtgggataatagatgatgtttatcagtatacctgtggaatatgtacaaactggatctatagatatttggaagtggacaggtgggtatttgaagtaacccatcaaaatatgctctgagtgattccgcttaatgtttaaattcagtaacgtagtttgaaagggaatttcagtgctttgttatgttggaggagggttagtgatgcgtgtaagaagcgatttctgatgagggatgaacttgggcttattgttttctgggtgaagtctcttctttaggaaaatatggggttggtcatttttgagattcgtacctttttgaatgtatcaggtctcagtaaccaggaaagtcaattgcgggttagtaaggtgttacgacgttagaatttctttggtttggtaggccaggtgagattacagaacattttgttagcgaggtatgtataaggagaatagcagttggggtggaacgagtaaagtttgttgtacggtgttgcaaatcgatgtgggagggtattggtaactgagtcgaggtgtagggagattgcagggcaataacttttgtgtttatctgtgtgtttgt

SEQ ID NO: 629621 - DNA, 119 bp, Homo sapiens
ccatactctcgacaggttgagactgtatcaggttgcgatatcttgcgctcaggtgtctgggattcgctcaggtacttctctgagttcttctgtacagcatccttcactgtcttggtcag

SEQ ID NO: 629622 - DNA, 365 bp, Homo sapiens
tccaccacggcatgtaatcgccccttctgtgaatagtacttctatcttatgctcatcttttattctattgagtttcttttctttttcttgttgattagcatacatccgtaggaatagttacaggaaacaagtccagtcatgggtttggtgtggacaagtcgctgcagtcagtcccatctgtgtgaaacttgatctgtggggagcatgtgttctctcatcgtttcgagggaatactgatattatatattcgagtatttgtcggattacatgcagctggtaacctgaacttgttttaaagcctgatgtctttggagtactgtgtcacccctgctgtcctggctgagtagtggtggaatgtgtcaatg

SEQ ID NO: 629623 - DNA, 205 bp, Homo sapiens
acacgacctggtgggcaggagaatggcttgagcccaagaggttgagactgcagtgagccaggatcatgccactgtactccaacctgggtgaaagagtgagatcttgtctcaaaaaaaaaaagagagagatttactgggcttttggctatttaatggccaaatctaattataggctttaccacccgagggttaacgctttttacta

SEQ ID NO: 629624 - DNA, 353 bp, Homo sapiens
tttttttgcctttcccatattatattaaattcgtgttttattttaaaaaattacagcaacactatcaaagacaacatatgtacaaacattttaaaaaaagaacattaccatatcagtggcagtaaggcaagctgaaaaataatagactgagctttcgggaaatgttgtcctaaaagacatccaactgcgttcaagcagcttgaacaggcttctttccagtgaccagcatatgttgttagttatacaacgatggtaaatgaggctactacatagggccagttatcaaaactcctcttctcctcgggtaggccatgatacaaagtggactcatcaaataatttaaaaccaaagcg

SEQ ID NO: 629625 - DNA, 1074 bp, Homo sapiens
  misc_feature (526)..(526): n is a, c, g, or t
agcggggtgtgcaggcaagctgggccggcgcggaccaggctctcttgtcgtcaagcgcgctgtccgcttctcctggtgacggacgcttctgagaggctaaattattctacccgtggcgtggcgggctggagacgcacgcggtgtagacgttggccgtgcacaggcggcggggaggaaggactgaccattccgcttggcggcaaccgaccgggtagaggcgtcgtgtgggcgttgttaaccgttggtgttcgacggatgcgatcactatggcttagtcgctgttagcgtccggcggacgtctctgtggattgccagatgcctaggggggcgcgcatcatgacgtaccatggcggcgaatcgtacacgggcgtgctccggacagggccggcataagaagagcgcgtgtgcccgtgtgctgtagagcaaacctcgaacgtcggcgcgccagggcttttttccaaccgacgtttgtggaccggacgaaagcatgcgtgccagccttgatggcaagctggaagaaatggcnctggaactgggcgcctgatcgtggggcgcgcacgcgtaccactaggacaggatgggcggcactgaatggcacggcactacagagtgctaacatagaattacatgcaagtttgtaacccgaaatggtctgacgtactaagcaagtagcaggcgttgcatgtagcacaattctagttcgggggttgttcacctccaaaaacactctagagcagctaacgggcggaaaacctgaatttgggttcgtccgaaaaggccggcgaggttggccgctacgcggaggaacgcgtctttcgaattagccaaagcgcttggtgctagacagtagtaaccgatttctgccgggaacgactttggcgaatgggcgggagacccacgaaagggatcgaggacagtagaagcttgaggtggcctggtaggaagagccttcgtttttattgaaacttccggcaagagcggtgcgttagacttcttcgacagcaaacgatttagtaagcaatgaaactggccgcctctctataaggtcttctttgccacgaagaagaggaatcc

SEQ ID NO: 629626 - DNA, 981 bp, Homo sapiens
cccaacgtcgtcgggacactagtgcgtcggatccatcgcgtgccatatagtaactgtacaaacctccggcagacaataaatgcaaccatcaggatacactagagtaagtggtctgagctatgatatctaatcgggttccgtagggttaatcgggtgagcaccaccatatatttgatcagtaggaatatacgtagcacgcggcagagcatattctccaccgtccgctaccgataattcaatcggtcgtaaccccaacgccgagcagtcaaagagtattttaaccatgacatcggcacgatcgactcgctacagcgaagccaaataattcgacaatggatttggcctgcgagatgcttcatgcagtctcactcacagactaccaatcggttactatattacaactgctgaagctgagcctgcacatggactgttggtatttaggcgaatagcttcgagttcaacatataacaattccgctacatactactgaacacagtactgtacggtgggatcacgcatcactttcccaagtgatggtccgtcatccacaataagcgcagcatggtaaatatatgccccaatcaaatatgagacgggcttcatttcaacgagtcactagtccacctgagttcttccagcgtgtgaacactccctgaagagaaatcagctttagggcctatgatattcaatttgacaacttatccaataatctctattcagaggcggtcaatatcatataacgtattgcatttcccacaagcataggaagcaaatgtctcccgagccttataacagcgagtatggcgcgccgaacgtttgcttcgggaggaatcacccggatggcaatattacctacattgaaacatctatcctgatactatctggtaggctccattctattttacgtcctagaacagctgaagattatttacccctattttgcgaggacaccgaggaaaacctttttgtcttgaaaaccta

SEQ ID NO: 629627 - DNA, 180 bp, Homo sapiens
  misc_feature (14)..(14): n is a, c, g, or t
cacgttacctaaangtatctggggtactaggcatgggagggtttcaaggctacctggcactggacgtaacagccaagggactcctagtcctggggtctccgaggtcactataccccgctgcgccaatggcagtgtataggaatgtaaaacatgcataatatgtggacaaccccaccatga

SEQ ID NO: 629628 - DNA, 237 bp, Homo sapiens
gaccgaacaagtcagacactaccgatgtcacggcggcaatgacgttagcctttttctaccaagcctgtggtccacagaaaccagcggttaaacccagtgcaacaagtgttcttctgtgcaaaagttaatggtgatgcgatacgtggatgtttctccgctttaatttcattcagctcatgatcgccacgtaagaacaatgccactaccgatgttgcttgcgcttcttcggctgcaata

SEQ ID NO: 629629 - DNA, 839 bp, Homo sapiens
  misc_feature (496)..(496): n is a, c, g, or t
gtactcttaagctcctagcccagcctagcgtgccctggtccctctggccactgcgtgcacacacctgccttaacacacactacgcaaaaaaaagaagtacaacaaacacaaaagaatgaagttggaaaaaaatcgggggcggggcgtgtgaaaaatatacctggcgaggcgatcgctatattcgtgataggccaggcgagtatcttgctctgctacaaggtgggggtcccttggatacgcggatagatctgattatgccagtgagagggcgtccgtgtgctctccaagaacctgtgctaccacttggagatccctgatggatctttaccatgatgttacacgactactcactttggtagtaggaacgacgtcgtgcgcctatgcacccttgagactgatagtttcctttcgaactacctccgtatactctaatagcgcactctcagagcgacagccatccatagatcaattcgcgatcttatacgcgccgatgttnccctacgccattgggcggcctcgatccgttcgcatatacccggtaaaagaccctatgttagttgcgccaagtaaagacatccgtttcgcgacgcgtgttccacttcccgatatctttctataagtcttctggcttccagcaaattagcatgggagcgctacgacagggatctaccaacttctttaacaaagaccactgggctcttgtggaatgaattaacgggtttagctcccactctttaacggtaccatcgccgtaccagaaggtaatttcaaaaccacggacgactagggttgggaatacgggctgtcactggagttacactcacataaggggaactttg

SEQ ID NO: 629630 - DNA, 903 bp, Homo sapiens
tctggttcgcaagagtaagaagcatagaaacagataagaaaaagacggatgacaaagtaagaaagatgtaaagctggtgtcccgttgtaatgccgcatatagacgcctggtgaacgcaagcccggtgaccaccatggtgttgcggtagcacaccactgttgtgggcgccaattctgccttggcactttttagccttctatgattccataagggccacaagggttcctacaaggggctaacaattgtcacgctggtaaacccacaaattgcttctgttgtgataatacttgcacattggcaagagactttttgcttgctaaactctggcaaaatttgtttccccctggacagtgaagtgccctcttccttttgacaacttccccaatgcccccccctaggcataatacttttcccgttgaagggcaaaacaccttaggttctcgcgaaccaactaaattttcgacgagagaaattgtgtcacccccccctatgggttgaggttttctgaacccacttcttcccaccgatttagtggtcgtatacttcacaacctcagtatgactccttcaaaccctcattgtgctctgcccaattacaccgtaaccacaattacgtctcgacagttccaatgtcaataagcccagtgtgtcaagcaaaaaccatgcttacccaccaggcctcctcactttcacgccccgtcaactacacatttcgagccctagctcaccacggtctaattatgtcttcatccatacttgaccagacgtgtctcctaccttgcgacatacttatttttcaactcggcgcaaaaaaattcgtatccttttctagacgccaaaaataaaaaaccatggtatatgcggaaataaaaaaattggtacattgtggccgccccaacatagc

SEQ ID NO: 629631 - DNA, 981 bp, Homo sapiens
gaggtcagtcttgatatagccagagagttgcgttttccttgaatgcttgcatgcgtgctagggctgtgagcccacataggccagaattttgcaataactttcagattccatggggcatctacctctgcctgctgaaataattagttaccatccatgaattggtgttccagttctctttagttttcaggcaaaagtttccagacattacctgagtaaaaccagcttatattatcacgttttcagagcatagtctagtggtcaagagtacggactctagagccagaccatctctgtttgaagcctggctattctgtttactagttttatgggctacatggattaagttatatagcctatgtgtgtctcagttctcctctgtaaagcagaaatacacacctagtaggtatgttgtgaggttttaatgaaatacagtaagctcttaaaacagagccctacgtatagtaaatggcattttatgaagtttttaataaagttgcaatatgctagtatgtccagaattggttccttctggtgggttcttggtcttgctgacttcaagaatgaagccgcggactctcgcggtgagtgttacagttcttaaagatggtgtgtctggagtttgttccttcagatgttcagatgtgtccggagtttcttcccttctggtgggttcatggtctcactgacttcaggagtgaagccgcagaccttcgcagtgagtgttatagctcttaaaggtggtgcatccggagtggttcgttcctcctggtgggttcgtggtctcactggctttaggagtgaagctgcagaccttcgcagtgttacagctcataaaggtagtgcggacccaaagagtgagcagcagcaagatttattgtgaagagcgaaagaacaaagcttccacagcgtggaaggggacccaagcaggttgccgctgctggcttgggtggcctgctttttttcccttatttggccccaccc

SEQ ID NO: 629632 - DNA, 156 bp, Homo sapiens
tctgcgtttctagaggatcccggaacacccgctacgtgagtccatattgatgccgaacttagtgcggacaccgatcggcatagcgcactacagcccagaactcctggactcaagcgatcctccagcctcagcctcccgccgtagcgggatgttgcg

SEQ ID NO: 629633 - DNA, 446 bp, Homo sapiens
caaaggttagtcattcctgtgattatgttttgtcatataagactccaagaccagccagttggccttgaagaccaaccaaacagctgtgcagtgagctaccatgtcctaaaagggccatttggctgggacttcaggaacgctctaggagttgagagtgacccccagttgacagccagcaagaaaacagggacttcagtgctgcagcctcgtggtactggattctgccaacaactacatgagctttgaggacccagaggcttacaaaagaaccacagcccctacagtgacaccttgagttcagtctggtgaccccctggacagaggacccagttaacctgtctggagactcctgacttacagaaactgtgagataatacatttgtgccgttgctgtatattctcatgtagtaaaataaagacataaataaatttatgttgctttaaaa

SEQ ID NO: 629634 - DNA, 466 bp, Homo sapiens
tgctgaagaagcccgactggttgtcccaggcgaaatcgccgttgtagacatacacatcgtcgaaatcacgcgcactgagcaactgcggcaggcccgacagcttgtggctgcctttcgggagtctgcatcaggtattcgaaacccgggcaggttcgggaagcagggcattggtagcgaacataccctggtgggtgtgggtgccgttggagaagaagcggtcgaacagcaagccctcgtgggtcaacttgtcgaagtacggggtgatattgcccggacgtcccaatgcgcccaccgaatgaccagcgaagctttccatcaggatcaccacgacgttcttgatcggcagggttttctcggccggtggcgtgaagtcacggcgcacggcagcggtgtcggtgtctaacagcttctcttgcgggagcaccagcatgttacgcacggtctgggtggccagcggttgttccag

SEQ ID NO: 629635 - DNA, 301 bp, Homo sapiens
gtgaacatatttttgaaaggaaacaaaattgacaatcctttagccaacaactagaaaacagagaaaaagcaaatacaatcagaaatgaaaaaggagacattacaaccaatactgtagaaaatcaaaggatcattagtggctattatgaatgagtatatgccaattgattggattatttagaaaaatgagataaattcctagacacatacaacctaccaaaattgaagaaggaggaaattcaaaacctgaacatacccataacaaataccaagatctaaagcataatagaaagaatcctagc

SEQ ID NO: 629636 - DNA, 977 bp, Homo sapiens
  misc_feature (316)..(316): n is a, c, g, or t
  misc_feature (975)..(975): n is a, c, g, or t
  misc_feature (977)..(977): n is a, c, g, or t
ggtccccacggcgggcagcagcggcggggggggtgaacgcgagggggcggagggagcccgcggcggggagaagtacagcgaaatggcggaagaccggtggctgacaccccggcgggtgattcaccagagccgcaggaacccttgaattgagcgcgctaagcggacccccccaggcaaaacttccctcgaagatctgatggtgaagcaacccgcgcaaaccggggtgggggttcaggcccggggggccgcggtttacaccacactttaaccgaaaacattcgaggggttcaaaggaaacaattcctttcctattttncagggcgtgaaaagaaatcctacgtgtcagaaagaaggatacgggtgaccttgtgaaagtgcgctggcgaaggtggaaattaagaaaagggaagaagaacgcagggttccgtaggtccccccgcggctcccctgagagaacagcagtatttgggggtacggcttccctttttaagaaggcaagatgaatggacattattcgtggatgaaccacttttattgtgagggacaacgaaaaccaagggctggacgcagtttataaacaagggtcggtgttcatccttcttggcacagaccgaaccgtttgtcttcacttggtttttcacgaggatgaaataatagataaaggctatacttccattctaaaatagactgctgaattgtgcagaggggcaaacgtgactatatgattgtaagccagtggagaagtctaatttagattgtgaaggaaatgggtaaatgcctaagttataactcaatgccagttgttgttggcgtgcacgagtattggttgaaaatccatcagcgttataaaagcttggggaggggcaaagcccacggttcggatggggacagaggggttagagggggtgtgagagaatccttgtgagtgggagtcgtatttgttttttggtgtggaaatttattattgattatttngn

SEQ ID NO: 629637 - DNA, 478 bp, Homo sapiens
  misc_feature (103)..(103): n is a, c, g, or t
  misc_feature (178)..(178): n is a, c, g, or t
  misc_feature (309)..(309): n is a, c, g, or t
  misc_feature (341)..(341): n is a, c, g, or t
  misc_feature (343)..(343): n is a, c, g, or t
  misc_feature (383)..(383): n is a, c, g, or t
  misc_feature (476)..(476): n is a, c, g, or t
  misc_feature (478)..(478): n is a, c, g, or t
atgatcccaatacgcaaaattaaccccctaatttaattaaccactcattcatcgacctccccaccccatccaacatctccgcatgatgaaacttcggctcacnccttggcgcctgcctgatcctccaaatcaccacaggactattcctagccatgcactactcaccagacgcctcaancgccttttcatcaatcgcccacatcactcgagacgtaaattatgggctgaatcatccgctaccttcacgccaatggcgccttcaatattcttatctgcctcttcctacacatcggcgaggctatattaggntcattctctactcagaaacctgaaacatcggnantatcctcctgctgcaatatagcaacagcttcaaaggctangtctccgtgagggcaaatatcattctgaggggcacagtaatactttatatccgccatcccatacatggggacagactagttcaatgtctgggngn

SEQ ID NO: 629638 - DNA, 127 bp, Homo sapiens
tacaaaacttatgcagtttgacttctttggacaaaggactttaggaaaaagaggaacaaagacattatttgagaattaaattatatattttgaatatgactgtgacctggactggatagattagaga

SEQ ID NO: 629639 - DNA, 105 bp, Homo sapiens
gcggccgcctactactactactgctcgaattcaagcttctaacgatgtacggggacatgccgttgcactccagcctgggtgacaaagcgagaccctgtctcaaaa

SEQ ID NO: 629640 - DNA, 455 bp, Homo sapiens
caggcattgggcccgcagcgactcccgcctgcaggccagaggcacagtcgctctcccagtccccgagggacagagagacacctgcagcacggcaatcccctacacctgtgaggccccctaagcccgcaagccccctacacctgtaacctcccttcacctacaagatccctgcacctgcaaggacccctacacctgcaacttccctacacctgcaatctccctacacctgcaacctccgtacgcctgcaacctcctttcacctacgagatccctaaacctgcaacctccttacacctgcgtgacgtcaccccggctgaggcgctggcagaaggcggtgcgggtggagccttcgccaacgtcctgggccccctgagtgctgcatgccagtcctaccagccgctcggtcatctgccaccgcccagcaatggcttcagcatgcagtccctgctagggga

SEQ ID NO: 629641 - DNA, 135 bp, Homo sapiens
ggaaaaaaagtttttgccgggcccggaatttggttccagccccccggcccccccctttttgggggattgggattcccttttgggggggcccaaggttttccctttccccaccaaaaaaggaacccctttcggcca

SEQ ID NO: 629642 - DNA, 485 bp, Homo sapiens
  misc_feature (74)..(74): n is a, c, g, or t
gttgagcttgccgggatactgtgactttttaactggtttctggagttctcataaagtcttttcgggccatatgntgttgttaagtcagtatctctgtgggggaatgaggtctggggattcctattccaccgtgttttctcttcttataaggatgccagtcatgttggattagggccgcacactattccagtgtgatctcatcttaacttgattatatctgcaaagagcctatttccaaataaggtcacattcacaggtgccaggggttagggctttaacttatcttttaggggtacataactgaacctacaatagcttccaccactgctcataaaaagattgaggctggatgctcactctgtgatcccagcactttgggaggccacaaggtggtgggtggatcgcttcagcccagaagtttaagaccagcctgggcaacatggtgaaaccctgcctctacaaaaagaacaaataaattagctggt

SEQ ID NO: 629643 - DNA, 311 bp, Homo sapiens
  misc_feature (228)..(228): n is a, c, g, or t
  misc_feature (252)..(252): n is a, c, g, or t
  misc_feature (277)..(277): n is a, c, g, or t
ttcatcctgggcaaaatgagatcacagtccccgactctcatttgccctcttttctgcttttattttattttatttttttagagatgggctatttttacgttgcccagactcgtctcgaacacctgggctaaagcaatctgcccacctcggcctcccaaagtactgggattacaggcaggagccactgtgtctggcccaatgcttaagatcttttgagacaaaaaggangaagttggagatagttttcaatancacaaggaagctcagaaaaaaaaancaccccccaacccccccaaaaaaacacacttgta

SEQ ID NO: 629644 - DNA, 492 bp, Homo sapiens
  misc_feature (455)..(455): n is a, c, g, or t
  misc_feature (492)..(492): n is a, c, g, or t
cgcgatcgtaagggctgaggattctaggtccggacgctactgctcgtgactcaccgatgttcgctctagccgggtaacatgtagctcagtaagcccgaacgcaacaggcatggcttgtacggataccgtaataacacccgtggagacgaaggtggcagttcaccgcattctaatcaccctgacaagccggagcgttctcacagtgaacggtccagttcgcatgcctaccaagactttgagaatcactacaagacaaactcgttgtggtgaagcttctaagactcacagatcgttaccagattagaattcacaagcgagtcatagacttgtacagtcgttgtgagattggtaagcacattactatcatgcagatcgagccagaagatgaggcggatgtcagcattgcagatgcttaagtccactattcgaatcaatagatgactagttgtgatcantgtccctacagacctcgagcagtttctttatggcgtn

SEQ ID NO: 629645 - DNA, 209 bp, Homo sapiens
tgatagcacgcacccagctacttttgcattatgtagtaaagatggggttcaccatgtggccaggttggtctggaactcctgacctcaagtgatctgcccgctcggcctcccaaaatgctaggattacaggcgtgagccacggcacccggccagtgacttttaccttcactgatgaattcacaatctcttacagagctctcttacgctct

SEQ ID NO: 629646 - DNA, 308 bp, Homo sapiens
taggattatcctcagctggaaaaagacacagagtattgcaagtgagtctgcttctctccaccgccagtgctagtcagagcctccctacggtgctcagcaagaccccggctttacagcaattcactctgcaaatgaagccttcaccatgagcagctttcccagtgcacaactgtgggatttttctgcacggactcttggcctgggcccatccgacagtttataaatgaaaggctccagccggagctgcaggagagcagagacaggagcggagacccttgagtcatccaaccccctgttctgtgctacac

SEQ ID NO: 629647 - DNA, 387 bp, Homo sapiens
tctagaggttcccctggcgtggtcgggctacatagtgtacatttaactacgctcttttggcttttgctttatttgaaagtttttttatcctatgctagtctcacagacatcgatttgtgatagcatttgagctgatgacatctcttcctttttctgcaacatatctcagtggctcattatgttgctcttcatcactcatatgtgcagcgataacttacccagcacattctaatcactaacacctcaaacagtagcctgtgaaccttattggctacaggtagtgggatctgatacgctgccctgctgtagcattccaaacctaggtacagtggatagaacaggatataagacaatttataacttttagctgcaagctggtttcaattc

SEQ ID NO: 629648 - DNA, 325 bp, Homo sapiens
  misc_feature (217)..(218): n is a, c, g, or t
atcgcggccgcgtcgacagcgtccgttcggcgtcgggccacaagcgggcgcggtcataaatatgggtcagttcgtgaagaacggtggcgagcatttcctcgcgcacggtgccgtgggaccgattggtttttttcgtcgcggccgaaccgtccaccaggccgggcaacagcctgcgattgaggtccacttcggagaccaatgaggcctcgccgtagcnntgtccggcatctgggtcgaccagacaaaatcaatgctgcggtccagctgttcgataaaacgcggcggcagatgggccgtcgacgcggccgcgaatttagtagtagta

SEQ ID NO: 629649 - DNA, 326 bp, Homo sapiens
cgcagacaacacatttcccactgacttcatgcctcgacaatacctgggaggttaacagtggaaataaagagaaaaacatggaataagaatttataaaaccacaaaagaaacctcatgatctttgagagaagttatgtgcaccacatgtatacgtaaactaaatggactgtatatataagaaagaatttttaaaaacaaatgggaggaacaaggtgaagctgtgaaggacctactgatatcttagcagggggcacaggctccttctagcaatggaagagagtctgtacacaccaggactaacctgtatggagacaggctcgccaaat

SEQ ID NO: 629650 - DNA, 389 bp, Homo sapiens
  misc_feature (52)..(53): n is a, c, g, or t
  misc_feature (271)..(271): n is a, c, g, or t
  misc_feature (342)..(342): n is a, c, g, or t
  misc_feature (345)..(345): n is a, c, g, or t
tactactactaaattcgcgggcgcgtcgaccataggcaaaggtaatgaaaanntccaagatgtctctgaatcctcctcacagacaaggagccttggctgggcacagtggctcatgcctgtaatgcccgtactttgggaggccaaggcgggaggatcgctggagcccagaagattgagaccaacctgggcaacatagtgaggccctgtctctacaaaaataaaattaaaaaataaaaaactagctgagacatggtagtatacacctgtggtnccagctactcaggaggctgaagtaggaggatcgcctgaacccaggagtttgaggctgcagtgaaccttgantgngccactgcactccggactgggcaacagagggagactgtgtcttt

SEQ ID NO: 629651 - DNA, 221 bp, Homo sapiens
actggctggccagactggcaccgtcctgggtcgtgcagtggctgagcccggggcccgtggctgttactaactgactccagcccttgaaggatgggctttggccctgcctttgtggcccaggcaggaggcggggcaggaaaagggtaattcgtttccttcctggatcccaggagctgcctgaggaccaaggaagcggcctctgtggccagcgcctggctgcc

SEQ ID NO: 629652 - DNA, 320 bp, Homo sapiens
tcagcttctgagtgtctgaagcaggaggatacttgagcccgggagtttgaggttacagtgagctacgatgatctcaccactgcactccagcctgtctctattaaaaaattaaataattttagtctgggcgtgttggcatgcgcctgtagtctcagctactggggaggctgaggtgggaggatagcttgagcccaggaggtcgaagctgaactgagcggtgattcacgcctctgcactcaagcctggattacagagccagaccctgtctcaaatgaagtaaaataggccaggcacggtggcccacgcctgtcatcccagca

SEQ ID NO: 629653 - DNA, 1775 bp, Homo sapiens
  misc_feature (671)..(671): n is a, c, g, or t
  misc_feature (1292)..(1292): n is a, c, g, or t
  misc_feature (1693)..(1693): n is a, c, g, or t
gccgcaaggaaggtaccggttctactgccacctcttccagctccaccgcacggcgacagtagggaaaggcaagaggcaagaggcggctcggagtagattcatgtcggtgaaagcaaggatgcaggataagactggctcttgtggtattataagataatcaaacattatcaatgatatgaacggagcaatggaacatgaacgttagttcaaggatgtgctttgtgtggtcatgtgtctgtaagaacgattcgcgtcatttgcaagagtattaaccaacataggcttctcctctgttccgcgctgcaggcatccagcagtagtgattgaatcgacttgatctctatggaatgaaacgatccgatacttattcagggagtaggaacacactagaataggccggaggacgcgtatactgcaccaatgtaacacctatttagatccactcttatcaacagtggtggctctagggctattcgagttcacgacctatataatcgtaatcgagcctctaatctctgatgtaacccctagtgtgctaaccatccgttgggaacgtctgtcaagggctataagtgtacgcacgacagtagcccatatttgttaaaacgcaaatcctagagtccgagtgtcattccacctttatgaggtgtacctctccctagtttataaanataccgttgggcccccagaggggaggtctctctgtcttgcaccgtgaaaacgtgtgccaatgagcagcaacttgtgaacctcccgtaaaaaaccatgtaggtgcgccaaaggcgttgtggcttaatagggcagccacatgcgccattgtttctatccaccacgtgggaaatgccgactttggcaccccacaagagatggcctaatacactaattgcaacccctttttgtggggaggataaacccattgggttcttggaacaaccgaaaaagttggcccctggaagtgtggcttaagttctccacaaccatatttgtccaccatttccctgcattccataaggggtgtcccctacaattggccggcgggacacaacctttgggaccagacgagaaaagctcccaaagctgtggctttggccagtgattcccacaacctttgggatatatggacgtcccaaaagccttttgggctcagtgcccagacgacacttcgcatcttggggcgggcgcagagacatatgctttccaccgttcggctctgggatatgggaacaacgaatctggcgcgtgcgcaaacatgggaaggccccacaatatatatacgtctcccacataactcngcactccttttacctttgtccggcggatactgtccggcttaaaagcaatcagaggcgggagcgaacaaccaagatccgctaattaagcaaggggactggccaccggagcggcaaaaaatgttactacgggaacctaattgcagagggataaataaccggccccccgttggtgggggagcggcttcacaacatctgtagtgaacacaagacgtcgtctctggcatggaggtgtcggtccacacgcgagcacaattctaatcaagtgagcgagaccacagaagcttgtgcttgatcaccacattcacgcaccatgctgtgcgccacggctcggatgatacaacacacgaacccttgcaaggcaacaattgatatgatagacccgcgcgacgtgcttacagaanaacggggttcggttatatgacggaagagcgaggtcgaatcatccctatcttctactttcatcatcatcgacattgatgacca

SEQ ID NO: 629654 - DNA, 434 bp, Homo sapiens
gggggggtgtgccccaaataaacttaggaacgcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaattttggcccgttttgcccaaagaaatttaaaattggaaaagcttatgttatgggccccaatttgggcctaattgggcaaattccccataagggggtcttttttaaaaaaaaaggcccgtcttttaaaaactgtaaaatgggaaaaaccttggtttacccaaataaaatggtttggaaaaaaatccctttttccacagttgggaaaatcctaaaaagccccacccagatggtctttccatttgcacccctggg

SEQ ID NO: 629655 - DNA, 266 bp, Homo sapiens
tgaatgctatccattatagggctcgcatatataatctaaaacggcagcacggcatcggacatgggttaacatctcaaaccaaaagaacctacaaacgttccttgtgcaagactcaggcgagggtctgagggtaaaagcaccagggggcataacctcatctcatgctacctaacatgcataagaaaagctaacatggctttgaagatcgcccttccgctgatattacgcgccagcctactacacttcaatatgcagggttcacaaaa

SEQ ID NO: 629656 - DNA, 425 bp, Homo sapiens
  misc_feature (183)..(183): n is a, c, g, or t
aaaatatttaggaaaaaaggtttggttggcctatacgagatttgatctgtacttgttaacaaggaataactaaatctagtcttagttttcaaaaataaatctgttattacagaacagataatctgatctctatataacaaaaggtggaaatctcacgcctgtaatcccagcactttgggaggntgagtagattgcttgagcccaggagttcgagaccagcctgggcaatgtgataaaaccccatctctacaaaaatagaaaaaattagcggggcatggtggcatccacctgtggtcccagctacttgggaggctggggcagaaggattgcttgtgcctgggaggcagaggttgcagtgagccgagatcatgccactgcccttcagcctgggtgacagagcaagaccttgtctcaaaaaaaaaaaa

SEQ ID NO: 629657 - DNA, 665 bp, Homo sapiens
  misc_feature (9)..(9): n is a, c, g, or t
  misc_feature (464)..(464): n is a, c, g, or t
  misc_feature (478)..(478): n is a, c, g, or t
  misc_feature (481)..(481): n is a, c, g, or t
  misc_feature (500)..(500): n is a, c, g, or t
  misc_feature (504)..(504): n is a, c, g, or t
  misc_feature (516)..(516): n is a, c, g, or t
  misc_feature (525)..(525): n is a, c, g, or t
  misc_feature (531)..(531): n is a, c, g, or t
  misc_feature (540)..(541): n is a, c, g, or t
  misc_feature (549)..(549): n is a, c, g, or t
  misc_feature (562)..(562): n is a, c, g, or t
  misc_feature (574)..(574): n is a, c, g, or t
  misc_feature (578)..(578): n is a, c, g, or t
  misc_feature (585)..(585): n is a, c, g, or t
  misc_feature (589)..(589): n is a, c, g, or t
  misc_feature (651)..(651): n is a, c, g, or t
  misc_feature (654)..(654): n is a, c, g, or t
gaattcggnacgagagcccattctgctccgtataccagaaaaaaacacatttgaagcatgaattctcagcagcagaagcagccttgcaccccaccccctcagcctcagcagcagcaggtgaaacaaccttgccagcctccaccccaggaaccatgcatccccaaaaccaaggagccctgccaacccaaggtgcctgagccctgccaccccaaagtgcctgagccctgccagcccaagattccagcaccagcccagcagaagaccaagcagaagtaatgtggtccacagccatgcccttgaggagctggccactggatactgaacaccctactccattctgcttatgaatcccatttgcctattgaccctgcagttagcatgctgtcaccctgaatcattaattcggtcctttgcaccttttaaaaagatgtcccttaacccttaattctggaggggtcctgagnctttggggtaaggnttnaacgttttactgactgagntagnctttcttgttgnttggggtgnaatttnagggatggnntttggggnagggttaaagtgnaccccattcctnagtnttccctnaatnaataactttttaaattcaaaaaaaaaaaaaaaaaaaattggggggggggcccggttcccaanttngcccttttggg

SEQ ID NO: 629658 - DNA, 87 bp, Homo sapiens
aacccagggtgaagctcatcaaaccagggtttctggaggaagacagatgaaagctgagacatgaaaaatgaagaaaacctatccagg

SEQ ID NO: 629659 - DNA, 619 bp, Homo sapiens
  misc_feature (478)..(478): n is a, c, g, or t
acaaactttcagagacaggggggcacagatgcttctatgacaagatccatgaataaaccactcggaaggaaccatctcactgtgagaaacatgacttccaagctggccgggggtctcttgccagactacctgatttttgcaggtgtgggtgatggtgcagttttgccactgcgtgctagggaacttagatgtcatagcatcaagacatactgcaaacctttccaccccaaatcttatgacagaactgatagcgattgagagcggaccacactgcgccagcacaaagacttgttggctgactttctcatggaagagagctttgtctgaacccccaggatatctgagaccagatgggtgtactgaaccatgtgatgatgcttaacagtgactaagcctagtcattctctgagacctccaataatgagagaagatgccagtgaacctgtaagccagctacttaagcatgttatgatacggntctaacagatgaggggctgacacaagcactgactattcttgagtagatttgatttgcagtcaatcaagagtgagtttgcatcgttccatgaaatatccagaacatacttatatgtaaagtattatttatttgaatctacaa

SEQ ID NO: 629660 - DNA, 904 bp, Homo sapiens
  misc_feature (131)..(131): n is a, c, g, or t
  misc_feature (904)..(904): n is a, c, g, or t
ggcagaatggtcctgccggccacagcagcgccctggtggggatttgcactgggcactccaatcctggagaggatgccacggactgtggatgctgacggaagttcagagcagcgttgcgctacaggttgaangaagaactgatgctcttggcgctatttgtgctaaaactaggtgagttgtctagacccaaggcatcttaccaatcagctggtttggggtggtggtttccctggtgtttgtgtgttacctaccctttgtgcttgtgcttgacctctccttgtgagctcacctgagccctcctcagggccaggttcctgacatgtgttggtttttgcatcatccactggaaaggtgtcattaatgacccattgttacgaatgcaagacggtcatggttattctagccctcatggctgaacgtgcccagtcctggctccacctactctctccatgccagagtggtcgtggaccagtccagtgcctgtcctcgccacaggtgcctccagggagcattcgggtcaaatccagagtggacaccctgtggctacaaaccaagggctgctgttcatcccacatcgtgtggggcagtgtccagtcccctgcagctacttgtgtgacttaacaactccaggagccctgtcagctgccctcctccatctaaagcccttcgactcttctgctttgacaaagaaaatgacattgggaggggagggtgctccgccttcccgagctttttctcaggaattagtcctatagatactggtaaatctggcacttgaagaaagtacttcctgtctctggcagctaacttttgccagaactgttccagggaagtatactggtgtaagtattaattggcagaaacgtttgtttcaaaagggtttgtacctcagacttcataccan

SEQ ID NO: 629661 - DNA, 951 bp, Homo sapiens
gaaatctagtgtactttaaatttttttcataaaagtttacattgtatgtaggttaacattaaatgttttatagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcccgaaaaatactaccctcccggggaggcggcacaatcgtccagccaccaccagcccttttgtttcgaacaaaagggcgcccccaaaggagggcccgatataaaaataacacacaccgcaacggggcgcgctgataaaaaaccagccgcgggcgaggagacaaccaaccggcactcgctacaacacaacctgagcggcaagacacccccacgcggggggggggcacaacacctggcagaccaccaccccgacgaataactattactcagcgccccgcgaaggggacaaacaaaacaacatcccgacaggaggaatataggcgcggcacacccccccaaggcgctcaattcagtcgtgcgcaggaagcaaaacagtaccgtgcccactgagcagaccatcttactgccgagcaacacctcaattctcctagccggcgcggcgcgccagtgctcatcatctaccgcggggcggcacacggaccgcacgcaacgatggacaatctcacacccaccaccgaaagtcagaaccgaaggcagaccgcaagacgaacaaacccaccgcgaaccacacacacaacccaccacacccgagaccaaacaaaccacgcaacaacacaaacaccacacacacaacaaccaaacacacaaaacaaaaaccaccaacagacacccgcaacgcaacacacgcacccacacacaccgaaaaccagaaacacaaaccccacaaacaccacaaacacaccaacaatcccatcaccaaaccaaaaacaaaacacaaga

SEQ ID NO: 629662 - DNA, 1020 bp, Homo sapiens
agcggggttgtttgttacgtttctttgaaggtgacctagttatctctttttccttgcattaagaaggcatatcccaagagagggattgatatctttctctttgacagttctggaagaatgtcatgagccccttacatctccgaaactggattttaaaaacaatgtggaaaaactgcttccgtcccagggtcgacatttttctgtgacttctgagtttggctttctattaattattcttgtattcggaacagtgggtggtctcgacatcctggatggcccagagtctggagtaggtgccgcgggaaggtagtatctggtggcttcgatgggtaaccgcatcgcgaaccaccgggggattcaaagcagatatcatttgtgccgcagcccgtctgtgaaaatcgctgtggaattaacaaggacaggtggcccaacccagcacccggggcaagttgcgagttgtgaagggcgagactggaggtagggccccaatcgctaggtgcaaagagctgggatgagaaatgccgaaccctccagtgcaagcacggcccgtctggagggctccgaaagcgccgggtgtaaccaggcggtgaccaccgtgaccagggactgacgggttacaggctgtgaaaggacgccccttcagtttcgaaacataggggcctgggaggaaaagaaccatagtaccagagaagtccgaaggagtctgcacaaggcagcctgcgtgaacagtgtccactggattagacggggtcgggccggacccagtgtgagtttcggcgcggacacaggggaatgccaatggcggcacaatatgacgaacctgacgcctatgtaacccccagggctcccggagggggctggcaaagccactgctcttccggcgagagcactgtgccggaaccaggggccactttcgacggcggtggtgcaacagaacgtcgccggggcccaagagcgacaacgaagcaccgcgacaggagagagaacaaaagacccagacacacgcgctccagaaagcac

SEQ ID NO: 629663 - DNA, 726 bp, Homo sapiens
gggaccctcaaggttttatcatgttcaaaatggagggcataattcctatccctttctgccgcaaccgatttttttagtctatatcagggaggtctatttttggtaaatatacgttctttgagatccgagcctccagatgataggccaagctcctgaaatggttatttcttttagattatgattgtattaaaagtatttaataaaaaatatttaagataattattatatgactatatttatgggaaccccttcatacctctgagtgtgtaccaggcatcctccaccatagcagacagatgttttctgggataagtaagtttgatttccattaatacagggcaattttggtcccagattgtgcttatcccatagcccaggaaactctgcattctagtacttgggagacctgtatatcatataatgtaatgtacatttattaccttgagcccagtaattggtccgatctttgactcttttgcccttaaacttacctgggcattcttgtttccaattccacctgccaatcaagtcctaccagctaaaattagatgaactccaactttgaccaacccatgagacccctgttatccaaactttcttttttggaaagtaatccatgttttttctaggttttaaaaattgtgatcagaccataatgttacattattatccaccatagtgattgatagagtgttatcagtcattacttaataaagcttgccacca

SEQ ID NO: 629664 - DNA, 395 bp, Homo sapiens
ctgcgtcaacctcccaagtagctgggataacggttgcagcagcaccacacctggctaatttgttaaatttttttgtagagatgaggtcttgctatgttgaacaggctggtttagaattcctggcctcaagcaatcctcctgcctcagccttcgcaagtgctgggattataggcatgagccaccatgcccagcctgctgaaagttttttttttttggcaacctctgcctccgggtttcaagcgattccccgtgcctcaccctcccgagtagctgggattacgggcttgtgtcaccatccccgactaattttggtattttccctactaaagttttttaaacagtcacttgacacttgattttcacagagccgcacttagcagccggggcgaaagaag

SEQ ID NO: 629665 - DNA, 198 bp, Homo sapiens
tgcttacacccagtgtgtgtgttatcctgtgtatccatgtgttcagatgctgtagtgaaaggaatcagtgtagtgcctgggcacacagcaagccctcagcaaatggccaggttggggagcacttgcggccaatagtgtccatatacatcgcgtatccatgcttattcatcctatatccacgtgggttaagtagggcag

SEQ ID NO: 629666 - DNA, 493 bp, Homo sapiens
  misc_feature (22)..(23): n is a, c, g, or t
  misc_feature (26)..(26): n is a, c, g, or t
  misc_feature (28)..(28): n is a, c, g, or t
  misc_feature (62)..(62): n is a, c, g, or t
  misc_feature (93)..(93): n is a, c, g, or t
  misc_feature (130)..(130): n is a, c, g, or t
  misc_feature (181)..(181): n is a, c, g, or t
  misc_feature (188)..(189): n is a, c, g, or t
  misc_feature (219)..(219): n is a, c, g, or t
tatagggaatttggccctcgannagnanattcggcacattgcaagagagaggaggcactgcnaaccgacagcaactgcacccacgatgcaganacaacgtgcgtggtggtgggtgatggggctgtgggcnagacgtgcctgctcatctgctacacaactaacgctttccccaaagattagntccccanngtgttcgacaattacagcgcgcagacagtntcgaccgggcgcacagtgaacctgaacctgtgggacactgcgggccaggaggagtatgaccgcctccgtacactctcctaccctcagaccaacgttttcgtcatctgtttctccattgccagtccgccgtcctatgagaacgtgcggcacaagtggcatccagaggtgtgccaccacttgccctgatgttgcccatcctgctggtggggcaccaagaaggacctgagaagcccagccttgacaccctaacgggggccttaaggagcagggccag

SEQ ID NO: 629667 - DNA, 371 bp, Homo sapiens
  misc_feature (48)..(48): n is a, c, g, or t
  misc_feature (58)..(58): n is a, c, g, or t
gcaagcggctggaaacacgaaaacgtgcaccaagacgcaaatgtaagncgcttagcgncggaaaaccgggaatccaagtctcagggggaaaaggtggaaaagaggcagacgttcgccgcgagaaacaacgcgccgcggcctctatgtctcgatccaactcctcgtcgaacatccgggatagcgcgagactctcgggccgcccgtgtcactcccatgcggcacgttgtgtagggaatcggccaagtcgtggatggcagccatcgtgcttgcagagactggctgtcttgccaaccgtcgaatctcgacgagtgcagcctgagtgatcgccaatgcggaaatctgcttttcggtcaacttaaccatagtctgtc

SEQ ID NO: 629668 - DNA, 99 bp, Homo sapiens
acaggtcaaaaagaacctttattactttttatgattgccgcatatgctttcgtgccagatgcctttggagcaggtgctttatgggctggagctttttga

SEQ ID NO: 629669 - DNA, 502 bp, Homo sapiens
acaggaaagaaataaaagttgggtctcaaaaagatctttgtacatccacatgaatagcagcattactcacaacagctacagtgtggaagcaacccaagtgaccatcgatggaggaataaacagaatgtggtgcacccatccttatagtcagccttaaaaaggaaggaaattcaacatggatgaaccttgagggcattactttaagtgaaataagccagtcacaaaagaataaatactgtgtgattgtccttagatgaggtccctggagcggtcaaactcatggagacagaaagtggaatgggggttgccaggggctgggggaggaggaatggggagtcagtgtttcatgtttgggaaaatgaaaagttttggagatggatggtagtgacggttgtatgataatgtgaatgtactaatacccctgactgtacactcaaagatggttacggtggtcaattttatgttatgtgcattgcaccccaataaaaaagggactctgtga

SEQ ID NO: 629670 - DNA, 433 bp, Homo sapiens
aaatgaaaagaacataccaaccaaataaattaaaacacgttaaaactcatggttttagagctagaatggaaacagcagatggtagaaaagttttagcagcaagaagagcaaaaggtagaaaaagattaacagtatcagataaataatgttaaattttaaaaaagttcgaaaaaactgacaattccaaaatataatcaattttaaacaacaagtagttaataaagaacttattttatactacaaagaattctttcaatttgaattaggaatctcgattccgaaaaaatttgtcaatgctgtaaaaagaaattattacaagagacaaataaaaattattattcaaaattatctaaaaaataaaaaagaatttaatgttaaattccaaataatacttataacaagaaaaagttttttaaacttggattttaaaacc

SEQ ID NO: 629671 - DNA, 974 bp, Homo sapiens
  misc_feature (333)..(333): n is a, c, g, or t
  misc_feature (338)..(338): n is a, c, g, or t
gcatcattcttcaggcttctctcaatcgtgtaaagtaatttagtaatacgagatccttggttgcgagcagcaatacattctaattgacacacacctaacctgtgtcttacgtgacactgatgtgcgattcatagtaaaactagatggtagttcacctacacaagtcgtcggtggtgatgggaaaatttactctatgccacgagtagctggactcctgatgacaccatgtgatggtactcatgatcaagggggctgaccagacactgctgaccgtctctctgatctggttgcaatgaggcgtgctcttctgaagggggacactagtgccgatcngaacnttgtgttctcgtgcatcgagacacacaacatacgtgtgacatcgatcactgatatcgtggccgtgtggttcttgcactgagagacacttacgacgacttaggagaattaggctccgacacgacgagctttgcccgtctagacttttgctagcattgtggtcatctgaactgcacctttgcatgcagactaatcacgacatagctacatagagcgctcacgactacaagtacagtgtcagctccaactcgttcctcctagttcctctgccttgacgacagacccacgtggaacgactccgcttgtacgaacgacggcgactagggcttggcatacgaatctccacctggcccgagaccgttcgaccaacccgttcccatgcttatccaggccgtcaaggtcacagacactcggtgtcggacatacccactcaacgttgttctcctttagagactctagcccttattttgccctgccgagtattagcgtgagaatatgtacctgcgcggacaccttcaagagttggcgtctcacagaggtagtaaagacagaactgtccatccctcaattagaatgtctctacaacgacgccaggtttaaagacagcatttagataatgagagtaggtaggctgtgta

SEQ ID NO: 629672 - DNA, 177 bp, Homo sapiens
  misc_feature (19)..(19): n is a, c, g, or t
  misc_feature (57)..(57): n is a, c, g, or t
  misc_feature (59)..(59): n is a, c, g, or t
tgcatcctgagagcaagtnaggcagaggccacagagaacaccgcatcgccggagtcntntcaaaaatgcatgttgtggccaggcgcggtggctcacgcctgtaatcccagcactttgggaggccgaggcaggcggatcaccaggtcaggaaatcgagaccatcctggctaacacagt

SEQ ID NO: 629673 - DNA, 294 bp, Homo sapiens
taacccatggctgagtgatgtggcacgatatcacctccgtagcagcctcaaatacccaggttccagtgatcctgccaactcagcctcctgagtagctgggaaaacacgcactcaataccatgcccgggtaatatttgtattcttggcagagacagggtttcaccaacattgcccaatgtgggtctcaatactcctgtagctcaacgtgatccaccgcgccttgggctcccacaagtgctgggcattacagtgagtgagccaccgactcctgtgccatctataagtgattcttta

SEQ ID NO: 629674 - DNA, 847 bp, Homo sapiens
cctgcgcgggtaatgtgctctggagaccagttgtcatttcttatctccgtggcgccttctctcctatccctaatggtgcgtgccgtctaccacgagtgagaacgatatctactggagcactggagcatgtagacccctcctttgagaccaccagaatctatctatttgcggttgctgaaactgataagagtccgactaaaggattatcactttaaggtggagttctgatgaaattgtagcacctgtttattctttaagcaacgcgtcagtttcatggcgcgtctgggttgcatataggcactgacgattgctactatcggttgcacatgccgagggcgacaatggaattcatcgaagagctggtcgctatttacacacagtatacatcgtaggactaagtttctgcacacctgtcttggtaatcaggccatacgagttttgcctctgggggggctaaggaagttcctcgacccactccgatgtggttctaaaaagggttggaaattgtggtagggattcaagggcccgaggtggcgattatttgagttggaacatggagtttgagattagcctggatgggagggaacgcaatgcctggcaagttcggggacaagaattgacatgcaccgcacgggacagtcgactgttggtaaaacttcctttcacagtttgtttttcctgggtggaacagcgggggtcctggcgtacccccttggtccgtgtttgggttagggcccctgggtttcccaaccttgaaggtaagggcgtcataaaaacttttgcgctgcttggattgcagggagtgaatccaacttattgcactggctgggacgcactggacttgggc

SEQ ID NO: 629675 - DNA, 745 bp, Homo sapiens
  misc_feature (18)..(18): n is a, c, g, or t
  misc_feature (90)..(90): n is a, c, g, or t
  misc_feature (112)..(112): n is a, c, g, or t
  misc_feature (223)..(223): n is a, c, g, or t
  misc_feature (260)..(260): n is a, c, g, or t
  misc_feature (306)..(306): n is a, c, g, or t
  misc_feature (344)..(344): n is a, c, g, or t
  misc_feature (579)..(579): n is a, c, g, or t
  misc_feature (651)..(651): n is a, c, g, or t
  misc_feature (708)..(708): n is a, c, g, or t
  misc_feature (737)..(737): n is a, c, g, or t
  misc_feature (740)..(740): n is a, c, g, or t
  misc_feature (744)..(744): n is a, c, g, or t
gctcagttgggatttaanatccgaggaggaaaggcctcccagctaggcatcttcatctccaaggtgattcctaactctgatgcacatagngcagaactgcaggaaggggacnaagttctagctgtgaatgatgtggatttccaagatattgagcacagcaaggctgttgcgatcctgaagaccgctcgtgaaatccgcatgcgtgtgcgcttctttccccacnattatcatcgccaaaaagagaggactgtgcactaganagttgccgcccacagcccttcatgtggactctgtcatgacatgctnactagacttcaggggagccacttctgttttcagccccnccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagnagcaaaaagaatcttggggattttccatctgacttccctggccatcttatcccatccttgcactaccagaanattcatacacttttgagactccggtgagaggcgggttttaccccttcctcctcctancctctctcccaaaaagtaaaacacaatcnacnaaana

SEQ ID NO: 629676 - DNA, 905 bp, Homo sapiens
taaaaatttccatgctgtccccttagatttctgcatttgagtgtttgaaaattaaagaatagctcatatatattacacattaatttcccaaatatattgcttccacaaagcttaaaaaaattagcagcacataccaaatagtcaaatattaaaaatcttgacagtgtcaagtgttggcaaggatatgaatgcaggaactctcatgttgttggtaaggagataactgatatgatcactctttagaaaaatagtttggcagtatctagtaaaatgaatctaagagattccatttctatgtctgtcccctagagaaactcatatatgtgtaccaagagatgtataggccaggcgcggtggctcatggctgtgagcaactttggagccgaggcaggtagatcacttgagcccaggagtttgagaccagcctcagcaacatggtgttttatctctacaaaaaagtaaacaaaattagcctggcatggtggcacccacctgtagtcccagctattttggggagctgaggtgggaggatcgcttgagcccaggaggcagaggtaagtgagccaagattgtgccacttggaactccagtctggttgaacagagcgagacctggtcttaacaaaaaagaagcaatgtggctgggccggaagtgatcacggcctgtaccccaaattgtgggggaacgaggctgagcaaccttcaagacacgagtcgaaacaaccaggtaatggggaaaaccgtctacaaaaaaagaaccacagaaaaaaaaaaaattaagcgacgccaagaaaaaacaaagacggcagcacaaaaacagaagccaaacgaaaagggaccacaacaggacaaaacgatagcataaacagcaaccccaaaagacgcacaaaaaagaaaaatactccc

SEQ ID NO: 629677 - DNA, 620 bp, Homo sapiens
  misc_feature (460)..(460): n is a, c, g, or t
  misc_feature (497)..(497): n is a, c, g, or t
  misc_feature (519)..(519): n is a, c, g, or t
  misc_feature (537)..(537): n is a, c, g, or t
aattggaaaagaaaaagtcaaatttgtatgccctgtatatattataatcttatatttgaaaaatcctaaaaaccctgccaaaaaactaatagaactgataaacaaattcagtaaaatggcaggatattaaaataaacatgcaaaaatcagtagcgtttctatatgacaacaatgaacaatctaaagaagaaatcaacaaagcaatcgtatttatgatagctacaaataaaataaaatacctaggaataaacttaatcaaagtgaaaaatcactacaatgaaaactataaaacattggtgcaagaaattgaagaggacacacaaaaaatggaaaggtattccatgtacatggattcaaagaataaatgttgttaaaatgtccatactacccaaagcaatctacagattcaatgcaataccacttaaaatcccaatgacattcttcacagaaatgaaaacanaaaatcttaaaatgtatacagagcacgaaagacctgnaagagccaacacatcctgagcnaaaagaatacaactgtangaatcacattacctaaacttcaaatacattacagagctatagtaacctcagcatgacaatggcatttagacacttagaccaca

SEQ ID NO: 629678 - DNA, 304 bp, Homo sapiens
atttgaagtcagggacggacggtccctcgagggcactcgtggtgtgagcacatgctgcccgtctcacatgaagtctggcatggaaacataaactaatgcataccagtgctacccagaagcagcaacacgtgtgttctccattccaccaatcacagaccagtatctactccaaacatccagtaacgaaaactatggcatcttcccaggaacagcaaggcaggcttcttactcacgatgaaccagcacgaataaacccagcaaaaagagaactgcatacttaaatttaggatagtcattcatgagg

SEQ ID NO: 629679 - DNA, 1265 bp, Homo sapiens
accactccagcttactaccagacaaacttagccaaaccatttacccaaataaagtataggcgatagaaatggaaacctggcgcaatcagcatcatagtaccgcaaggggaaagcatgaagacaattataacctacagcatcaatatagccaaggactaaccccatcataccttctgcatcaatgcaattcaactcagcaaatcaactttgcaaggcagagccaaagctcaagcaccccacgaaacaccagcacgcagctacctcaagaacagcataaaagagcacacccgatcatatgatagcaaaatagtgggcaagcatttatcaggtcagaggcgacaaaacctatcgagccatggtgatagctggttgtccaagatagaatcttagtatcaactattaaagttatgcccagagacccctctaaatccccttgtcacaatttaactagatagatccaaagaggaacacgctctcaggacactaagagaaaaaaaccatatgtagagaagagtaacaacacatataacagcaccatacgtaggcctaaaagcagacacacaataaacgaacagcgtaacaagactcaaacaacacacgtagccataagaacaatcccaaagcaatataaagtgaagacaccatacacaggccacagaggggaaacaaaatcaatccacgcgtatcagacaagaactaaagggaaagacaaaaggacacagtgaacaaacgacaacacacatcacagaataacgccatgcagacagaatcaagaaaaactggaccacgaacgaaaaagcagcccacaaaactaccacaccacaaccaagcaggcacagcatgaacgaccaatggcaacccacacacaaggaacaggaccaaaaaggacaaagggtatagaagacacaggacaaagggagaagcggacaaaactatttgaccagagacagtgtaaaccagatacaaataccacgcgacacaacaacaagagatatcagaagggacgacgccgggcgcccgagggaaccacgtgatcacagacggcgcgcgcccgcaaacagcgagacaagagacacaatcaacaccggcaccataaaacaagaaccgaaagaaagcgaacccacaggtgagcgaaggagcacacaaacatgaacgagagaacaacagaagccgacaagtaaggcgaaacaaaaaggaaaaagcaaagagagaagccacaacgacaacaaaaaacggccaacaagaagagaccatggagccaacac

SEQ ID NO: 629680 - DNA, 227 bp, Homo sapiens
ttcgtcgaagaacaacggcagacaaggattatgggtggcaaaacattggctcttccttggggagtgatgctgggcgaaagggaagagatgtggctcacgcctgcaggctcaatacggctagatacagccaaggcccacaggctgccagggcgagaggacatgtcagcatgtccagccctggggctctggagtgtagggcttactcccttctccctgctgcccttccc

SEQ ID NO: 629681 - DNA, 124 bp, Homo sapiens
cactcgtactgacgcaggattactcgattgtgactacagcatcatcagtactggtatcattatcctggtctcatcgacgtgttctaaacccaggctcaccgtgccctggtccattccagcgcct

SEQ ID NO: 629682 - DNA, 378 bp, Homo sapiens
  misc_feature (1)..(1): n is a, c, g, or t
  misc_feature (28)..(28): n is a, c, g, or t
  misc_feature (80)..(81): n is a, c, g, or t
  misc_feature (103)..(103): n is a, c, g, or t
  misc_feature (157)..(157): n is a, c, g, or t
  misc_feature (294)..(294): n is a, c, g, or t
  misc_feature (320)..(320): n is a, c, g, or t
  misc_feature (347)..(347): n is a, c, g, or t
nccagccgccctcgccatggccgcgcgncaagggctcatctcggtgttctcgagttcccaggagctgggtgcggcgctannagctggctggcccagcgcgcanatgctgctggcaggggccgcgccgtttcgcgctcggcctgtcgggcgggactcngtctcgatgctagcccgcgagctacccgccgccgtcgcccctgccgggccaagctaagcttagcgcgctggacgctgggcttctgcgacgaacgcctcgtgcccttcgatcacgccgagagcacgtacggcctctanccggacgcatcttctctccaagaatngccgattccaaaaaagccaaggtgatnaacaatttaaaccccgaagttgcctttggaa

SEQ ID NO: 629683 - DNA, 593 bp, Homo sapiens
ggcaacccgtgtagagtgcacaattaaatatactcataactcaagacactgttcaattaatggcacatcgggttgttctcctattagagttattctatataagaacgcattgaatatttttacacataaaacctaatgtacacgtgtatatatatctcaggtctcattcccaagagcgcatttgctgggttatagctcaagcacatatctcaatttgtgttaaataatttccatctattttccaaagtagttctccatatatatcctattctcctcaatttatgagaattacacttgctccacatcctcattaacacttgttaacgtcagcccttttaatattgcgcaattctaatgggtatatagtggtattccattgggtttaaattttctttaccttgattaccaaaaggttgtaccttttaattggtttgtttttatagccacttgaatctcctcctttgtaaagtcgcctttccaataatttgtccaccttcctattgggtcacctgtcttttcttacacaatttaaaggtattttctatgtatgtgtatcatatttgtctttatgtcctataaatatattttcccat

SEQ ID NO: 629684 - DNA, 296 bp, Homo sapiens
acgggtgctccggattacagatcccgtagatatcgacgtcgttggattcgacggtacggaactggcagaaatggtttcccctcagctttcgaccattgagcacgccctcgcgggatataggccgccaagcggtagcgattgctgactgaattaaaagtagaagaatcctgcacgcgcagtacggaaagtggtgatgtatggactggcgctgatatttcacgcagccagatacctgagacgttatcgactgacaatgcgccagacacgtgcgcgaactatcgtttccgcgtaggcga

SEQ ID NO: 629685 - DNA, 348 bp, Homo sapiens
tctttgactttcatctcaaacacttgctctatctctatctctatcttcttaatttaagctactggctcctctctttcttcttccatttgtgccagaggtctctaagtgaccctgattccatagttctcgatagtgcacattattagtaacttctttcaagtcgtgcgtgtgttctatatcaccatatttcttaaacctgtaaattcacaatgtctcaccattttcaacttcagcaactctccaagaatactgccttcatatgccctttgtgccattaacttcaatgatagtattactacccaccacagcaagaggtatatggtcctatatctttttcacgagttttct

SEQ ID NO: 629686 - DNA, 682 bp, Homo sapiens
tgtcgtacccccaaatggatcacccatcagcacgactctctgggtcgaagcctaagaacacctgctcgaacgccggccatttggcatcgaccacgctgtgcttcaaaccggcgcggaacactctgcagcgccaaggtcgacaggtaacggtcatccgctatcttgcgcaattgcgccggggtcttgggcaccggcaggtgggcttccaacttggccgccgaaccgaagcggttcagacaatattcgtgcagccacttgtaatcgcgcatgccctctcctgtcagtcgaattgaaaacggcgcccgcaaagcgccggtgtactagagcctcgggaagactcagaggttcactacatttgacgaaacgcgatgcggcggtctcatcgattttcaagctggtgaagtcgaacaggttgcggtcggccaaattgcgacgggatcacgtattgcaggctgcggaagatactttccggtaacgcccaggggtcttgcgcacccagtcccaccagcatctccttgaccacctggcgctgcaggttaccctgggagccgcacaggttgaacgggatgatcgagaaatgctgaaatcggagtacgcctggatgtccactcgtggaataagccaccgggcggatcatagttgcgccatcatggaagcaactgggggatggcctgagcagcgc

SEQ ID NO: 629687 - DNA, 908 bp, Homo sapiens
  misc_feature (566)..(566): n is a, c, g, or t
  misc_feature (602)..(602): n is a, c, g, or t
  misc_feature (608)..(608): n is a, c, g, or t
  misc_feature (652)..(652): n is a, c, g, or t
  misc_feature (656)..(656): n is a, c, g, or t
gagctgcgcgggcgggcgtggttgccggggacgcgcggcccccggtcgggcactgcaggcggcgaaacgacttgggaaggccctttcgggacggagtcttgctctgtcacccaagctggagtacagtggtacaatctcggctcactgcaacctccgcctcccgggttcaagcgattctcctgcctcagcctcccaagtagctgggattacagaagtgcaccaccacacctggttaatttttgtatttttagtagagacgaggtttcaccatgtcggccaggcttgtctcaaacttctgacctcaagtgatccacccacctcggcctcccaaagtgctgggattacaggcatgagccaccacgcctggccagaggagccaccacgcctggccagagttgtcttgatagaggtcttgtaattatttgaattagaaaattttctgttaaaatatgtccacaaattctttggtaaccctcccttcaagaagtgaagcctaaatcccttcccttccagtgtgagctagacttagtgactcagttctatgagtaaaagtggtggaactgatngtgtgacttctgagactaggtcataataggcattgnggcttnctccttgctctccctctcagatcacttgctctgggggaaacagnagcnatgtgtgaggaacccaagcagtctatggagaggctacatggagagtaaccaaggtccctatcaatagcagcaggaacagaagctcctgccacagtccgtgtgagccatgtgagagcgatctccaggcccgtcagacttccattatggtagcctagtgagaattgctggaattccggaacccttgcctggtagcatcccaattgtaccccgaacagaatctcatatacaagggttgtccaaaaaaaaaaaaga

SEQ ID NO: 629688 - DNA, 269 bp, Homo sapiens
gctgtgccgcgtgcgcgccagtgctaactcatgtgccgagctctagagcagtgggagaattaccccgcgtgcaccaagctcaagtagcttcaccttgtgtatgcaggccccatgttatttgatagcaatcttacgagtgaaatgtactggtgggtagacaaacgttcttattttaacgaaaggtagtgctcgctacacggctggtgtgtgcatactgagaactcttgtatacactctgagcaggatatgtgtataactcgggtaccgag

SEQ ID NO: 629689 - DNA, 308 bp, Homo sapiens
agtgcagtggcgtgatctcagatcactgcaacctctgcctgccaggttcaagtgattctcctgcctcagcctcctgagtagctgggactacaggcgtgcaccaccatgcccagctaatttttgtatttttagtagagatggggtttcatcacgttggccaggatggtctcgatctgttgaccttgtgatccacctgccttggcctcccaaagtgctgggattacaggtatgagccgccgtgcccggccctgctttgatttttattatttcttttcttctacaaacgtcaggtttggtttggtcgacgc

SEQ ID NO: 629690 - DNA, 1473 bp, Homo sapiens
  misc_feature (395)..(395): n is a, c, g, or t
tataagattattagttataaaaggggaaataggtaggagtagcgtggtaagggcgatgagtgtggggaggaatgggggtgggttttggtattgttcaacactgtggtcatttatattttacacgtgtgtcagcatagtggggagataggtggtgatgtgagggtggcagtaaatataggcggtaggtagaaagtagaaggttaaggagggtgaagtgggtggctatattgagtgggtggggaatgaatgagggcatatatgtggttttgtgggtgaatttcttctcgattaatgtggcccatttgtggcgcaaaaacgccggttaagcgggggcaaggcctctccatagggagaaggagagggtggaagtggacaattacgagggggtggttagncccagtggtatagacgtgtgtgttctcagaggtggcgcaaaaatagatagatagggtctcggtgggtgccgtggaaagattaacagtttgtgagtatagataggaacagtggcgggaaagatacgttgtagagaatacacttataaaacttacgcttaaaactttaaaaaaagtgggtaaagtgttaaagggggttggtagcgggtaaaacaccgtggctaataaattacattcctaattggtggggtaacctgggagcggaggaatgggctaaacaaaacctgagggcgagtcaacccagcgagcggctcgggagtgcaaaattccccaaccctacaaattgggcgccgcgcaaataacgacggggcatacaaccagatctcggcccaccacggtcaccgcggacccacccggggctcccaccctcaccacagtcagcacgggaccacacactcgggcgaccaacacggcacctggaaccaaagaggggggcgcaaaaaaatattggggcgccaaggttggacgaaacaacaacaaaccacgatccccgagtagtgtccacaagagaggggcgacgccgactagcgagagtaacccccccccctggtgagcacccctacagaaacagagtcgcaaagaggcgggggcgacaaagtccaccacaaagatgcaaaacgcagggagaaaaacggccccaattaagatggagctaaactaaccagagtggagggaggaacccccataatacttaacttcgcggacactactaatgtaccagccgccacccaacaccccccccataggggggcgccacaaaaaagaccatcacatcaaacaccgaccaccaccagtgggccccaagaacataattccaaccctcctcggagacccacaaatcaataacacaccacgcgtcaccacacaaagcgcctatatcagcaaagcaacctgccatcgaggagcccccctctgtaacgccccacagcgcgagctaacagcacccccacgatgggtcaaaagaaaagcccggaacacacgcaacaaggagcagagccaaaacagacaccagagaatgaca

SEQ ID NO: 629691 - DNA, 321 bp, Homo sapiens
gacttagaggatcccattgatagcggataggggcacatgctgaagacattcactgttttgctcttttgcattcggatgagtctgggtatgacatcgatagtgatggaccctcaccggagttgtggatagagtccaactacccccagggcccttgtgagaacatcacgctttggtgccgaagcccctcttggatattaaagcacgtcctgctgctgaaggataagacacagatgacctggatgcgcccttcccacaagaacttaccaagttccattccttataggtgccctcatccgcttattctcagggggaccgcgctcg

SEQ ID NO: 629692 - DNA, 175 bp, Homo sapiens
ccctcttaccttgatgatgccctagagctgaggctgagaagacacagtgctgactttgactgagggccatggacgctgacagtgcctgtggccctgcccatgctgaaataactggaacccagcctctcctcctacacctggcctaccctatctgggcctctagtgtggcaccctg

SEQ ID NO: 629693 - DNA, 675 bp, Homo sapiens
atccatccagtccaccacactccactcctgtcctcatgactcctttccaacctctattcgtctcttgatgttgtcatcctacccctggggacatcagtgacttgtcccctgcaactacgtggataatgacccgggcgagacggtcactcggagcacactgcgcctaccctgaatatgttaaagggacaccggatacccaccaagcgcatatcgcattgcaccacccacgtcacatcacaccaaacatagacaacgtgacgacaacgcacctatcttctactacgagacaccaacatcgaacaaaacagcaaactggcatcactagtcgcaacgcacacagcgtcgccacctccggtccaacgcccactgagacacccgcgcaaacagccaaacaggccgaccacagaccagacggagagacacgccacagaacacaaccgcgaacgagaacaccagacaccgaagcacgaaacgaaccaaactgctcacctgcaagcgaccacagaccacacagaggccgtaaaacaaagaccaaaccacgagccacaagcacgcaaacacgacgacacagcaccacacgacaaaactaacgacgacacgccaggacaccacagaccaacaccaaacgcacacacgcgaaacagcggagcacgaacaacaaaacaagacacggaa

SEQ ID NO: 629694 - DNA, 291 bp, Homo sapiens
cccatctaggatatgggtctagagtccaggatccaagaaccacagctcatctgccaccaatcccaccatgggctcattttaggactatgggttatttcgtttccgtctctatcttcctttgcagatgttcctgcctttggggtctacaagcttgtggggatgaaatgggacccctgctgattctttctgcttcttacactttgccagacgccctgcgtctaagacagaaagagacccgctcctccactttcaggtgtaattagcttccgctagtctgagggcagataaggt

SEQ ID NO: 629695 - DNA, 165 bp, Homo sapiens
gactagatatgaggcagaatattaggctgtgatccgctgtcaccacctcgcccagcctggggcagttgagcctgattgggcacacacgtgataattgtaatcatattgtcataacatccctgagactacattaattacacattgagtgttctcgtcctattatag

SEQ ID NO: 629696 - DNA, 133 bp, Homo sapiens
taacaaaggcctatagacttcttagacatagaaacctgacagtattcttcacagcagacctacactacaagaaatgttacaggaagtccttcgaccagattacacaaaaaaaaacaccagaatgaaaatatgg

SEQ ID NO: 629697 - DNA, 457 bp, Homo sapiens
atgatctagaggatcccgcccatggcagcgaagcagaacactggtttggtggagagatctgataacaaaaagttgggaaataggtaaaataataacttggggtagaggttatgcttgtgtttctcccaggaccgaatcaacagctgatttggataccattaagacacctgaaaccttattatgagctagatgcccaggaagagattctgggaggatcccgaggaccccgtagttgcagccatgtcgagattgacactgaggaggatcccaactgtcatgagcaatacccatcgaacatagccacctacttggggacagatcaagaagctgtcacagatggcggaataaaaacctgaggaaagcaggacaaccagtcacaatgagtaatttgatggtacctatgatagcagtgattaccattgccgtgagtattccttcaacaacggctgccattggg

SEQ ID NO: 629698 - DNA, 617 bp, Homo sapiens
  misc_feature (14)..(14): n is a, c, g, or t
  misc_feature (16)..(16): n is a, c, g, or t
  misc_feature (22)..(22): n is a, c, g, or t
  misc_feature (24)..(24): n is a, c, g, or t
  misc_feature (26)..(26): n is a, c, g, or t
  misc_feature (30)..(30): n is a, c, g, or t
  misc_feature (34)..(34): n is a, c, g, or t
  misc_feature (39)..(39): n is a, c, g, or t
  misc_feature (61)..(61): n is a, c, g, or t
  misc_feature (67)..(67): n is a, c, g, or t
  misc_feature (69)..(69): n is a, c, g, or t
  misc_feature (76)..(76): n is a, c, g, or t
  misc_feature (82)..(82): n is a, c, g, or t
  misc_feature (95)..(95): n is a, c, g, or t
  misc_feature (99)..(100): n is a, c, g, or t
  misc_feature (108)..(108): n is a, c, g, or t
  misc_feature (115)..(115): n is a, c, g, or t
  misc_feature (121)..(121): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (146)..(147): n is a, c, g, or t
  misc_feature (153)..(153): n is a, c, g, or t
  misc_feature (157)..(157): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (186)..(186): n is a, c, g, or t
  misc_feature (197)..(197): n is a, c, g, or t
  misc_feature (202)..(203): n is a, c, g, or t
  misc_feature (261)..(261): n is a, c, g, or t
  misc_feature (263)..(263): n is a, c, g, or t
  misc_feature (278)..(278): n is a, c, g, or t
  misc_feature (289)..(289): n is a, c, g, or t
  misc_feature (298)..(298): n is a, c, g, or t
  misc_feature (300)..(300): n is a, c, g, or t
  misc_feature (304)..(304): n is a, c, g, or t
  misc_feature (323)..(323): n is a, c, g, or t
  misc_feature (330)..(330): n is a, c, g, or t
  misc_feature (337)..(337): n is a, c, g, or t
  misc_feature (343)..(343): n is a, c, g, or t
  misc_feature (354)..(354): n is a, c, g, or t
  misc_feature (356)..(357): n is a, c, g, or t
  misc_feature (360)..(360): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (373)..(373): n is a, c, g, or t
  misc_feature (387)..(389): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (400)..(400): n is a, c, g, or t
  misc_feature (404)..(404): n is a, c, g, or t
  misc_feature (407)..(407): n is a, c, g, or t
  misc_feature (409)..(409): n is a, c, g, or t
  misc_feature (412)..(412): n is a, c, g, or t
  misc_feature (589)..(589): n is a, c, g, or t
ctctctccacacgnanggtggntntngtgncccntgatncacagtatggaataatggcaangaggananctatatngaaagnacttgtcataggnaatnnggtggctnccttaangctccntgaggnanacacttnatgaatgctnngagtcngganaatnancggncccatatagagataggttnatgaagcggantctgnnggatgagcttcatcagcaatcctcagaatgtcagttctactagctaaggatgcaggtnantatgttggacaccangagaacagganggaagtgtntngaanactggaggtgggtcatgangaagctnatacatnttcacnttgtgaatcantnncanggacngntnaacnaagactgggcgttnnnaananacnggntttngtntngtntttcccctaaggcaaaaggcagaaatgagtgggtacaccatgattaagttgcattctgtagagataggatcatttaagtcaagtcagcaacaaaaattagagacattgaagatgatggggtagaaaaggggtatcaaataggttagaaagatggcttgaaaggaaatgagggaaatnccagtgtggagagatggtaccgagctga

SEQ ID NO: 629699 - DNA, 140 bp, Homo sapiens
ggggccccttgggggtggggttttaaaccccccccctttctttccggccttttgggttttttttccccggcccccccttccctgggggccctttcccccttttgggggggccccccggcccttgggtttaaggcaggggc

SEQ ID NO: 629700 - DNA, 383 bp, Homo sapiens
gcgaagtcgtccttctgccccaaatagtgactgacatagagaaggtacacagtaaacactataaaaggaatgcctgcctgactgaagcttactgatgtgaggcttctagttgtgataccctacctagtgtaaaccggaagtgactcttccttagctaagagagccagacggactccatcgtgactccttcactcgcagccccttacccacccccttcctcaaggactaaactggtgcaagctgactcccagcacatcaagaatgcaattaactgataagatactgtggcaagctatatccgcagttcccaggaatccgcccggttaatagcacccagagcccctgcgtttgtgtccggttgataacgcccaaagcccgccctc

SEQ ID NO: 629701 - DNA, 102 bp, Homo sapiens
  misc_feature (1)..(1): n is a, c, g, or t
nttcggcacagcccaagaagaaataacagcaacagtgaaagtaaatttgccatttgggaggcctagggtactgcagaagaacgtggaccactgtctccttta

SEQ ID NO: 629702 - DNA, 102 bp, Homo sapiens
  misc_feature (84)..(84): n is a, c, g, or t
ctgagatccggccactaaagagggagcagtgacatttcacaggagatgacccagaaaactaaacaacgtgtgagtgttgtgtgncgtggtttgcgcgtcgcc

SEQ ID NO: 629703 - DNA, 852 bp, Homo sapiens
  misc_feature (260)..(261): n is a, c, g, or t
  misc_feature (274)..(275): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (289)..(289): n is a, c, g, or t
  misc_feature (291)..(291): n is a, c, g, or t
  misc_feature (299)..(299): n is a, c, g, or t
  misc_feature (319)..(319): n is a, c, g, or t
  misc_feature (322)..(323): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (361)..(361): n is a, c, g, or t
  misc_feature (393)..(393): n is a, c, g, or t
  misc_feature (401)..(401): n is a, c, g, or t
  misc_feature (407)..(407): n is a, c, g, or t
  misc_feature (416)..(416): n is a, c, g, or t
  misc_feature (442)..(442): n is a, c, g, or t
  misc_feature (553)..(553): n is a, c, g, or t
  misc_feature (555)..(555): n is a, c, g, or t
  misc_feature (557)..(557): n is a, c, g, or t
  misc_feature (609)..(609): n is a, c, g, or t
  misc_feature (641)..(641): n is a, c, g, or t
  misc_feature (669)..(669): n is a, c, g, or t
  misc_feature (671)..(671): n is a, c, g, or t
agcggagtcatcaggccaggattccagagagcgtgtgtggctgcagcctgcaccgttgctgcccgctgcccaggacgcggggtgggggacaggagccagagtggtgcctcctgcagaccaatctggggccccaaggtggggggccctacagagatgctccgaggcatgtacctcactcgtcaacgggaacctgcagaggcgacacacgatgaaggaagccaaggacatgaagaacaagtggggatcttcagacggcgganntgagtccctgganncnctncngcgggcnangcagacanaatgatgaagtcattcaagncanntcagaggaagccntnangtggggcgagtcttggagaangtgtggtttacaaatacgggttagcagtgttncaagcttncttcgnactgagttnagtgaggagaatctggagttctggtnggcttgtgaggacttcaagaaggtcaagtcacagtccaagatggcatccaaggccaagaagatctttgctgaatacatcgcgatccaggcatgcaaggaggtcaactggantncntacagcgggagcacacaaggacaactgcagagcgtacgcggggctgttcganctggacagaagcgcatcttcgggtcatggaanaggatcgtacctcgcttttccgtttgantntaactggacttattaacagaagaagatgagttccccggataaggggccacctggaggtcgatgctcagagttcacaccaggcagggctaggggtcccttggccatcttgctacctgcccctgtgacggaggggcaagcaaagcccataaggtccggtgtctctcgacagacggagtaaaca

SEQ ID NO: 629704 - DNA, 632 bp, Homo sapiens
  misc_feature (304)..(304): n is a, c, g, or t
catactgaggtgtcttctctttctcttacctattagaggcatttctgggcaagtttgaggagcatggaattaacagtcatcaatgcattgctggatttgaaaatgatttatatcaatcagcagaggacctccactggtgatgtcagcaggatctgaggatgttcaggtagacatgctatgctttgaatctccaaacttgaacgacattatgactgtgctcatagccaggcttcccttgcttgtggtcattgctgtggatcaaggttgttttgccttccatgcagtggatttgctgaggtgcttnccaatctgtatctcagaattgagatgtatgagaaagaatcttaagaggggaagatatatcctcttgggaccacgaccatgggcttcctttggcctcattgagtagcagtgaatatggacagggggaggagaggcgcaggactcacagggatggtcttagcaatgaaggatggtggccaagaagtgaggactaagattcaaaagaaccttgcttggactgtgccttgtgcctaaactgcacacttcaaaggtaataacttctttgcctacttccccttggaaaccaagaagagggaactacaagcttgcttgctaccaagtagcttacc

SEQ ID NO: 629705 - DNA, 120 bp, Homo sapiens
agtcttgatcgcaatcagcagccattaggtaacagacatttaggtaacagacatttaggtaacagccatttaggtaacagcacatttaggtatcagccatttacggtaacacgccattta

SEQ ID NO: 629706 - DNA, 311 bp, Homo sapiens
ccatccagaaatggacatggtggcacaaagctacatgaatcaaatggcctcgggagtgaccttagctatcatctgtgcacatcgcagctagtgaattcaagtttgaaatcctttttactctgtacttcaaatctatgatcttcctggaaacacttggtaagattagttctgaggagtatctttaggggcacaagtaaaaaatgggattgtcatgccttgatttgatcattcacacattgtgagcatgtatcaaaaaccaaatgtaccccataagtatgtacaattattatgtatcaaaagtggggttgtaa

SEQ ID NO: 629707 - DNA, 110 bp, Homo sapiens
tgttagggaatagactccactctcatttccggagctcacgctcacagacgggagtcgagagtacagcgggcagcaccggctaagccagaaggaagacggcaaacttacaa

SEQ ID NO: 629708 - DNA, 241 bp, Homo sapiens
ctccatcatgagaaaacttgagtgcaagcatggcctggggtgaccatgttgggcttcagaaagggtgccttccaggtagatgtggtggtcacatcagagccttgtagacacgcagccagacaccttctcggtcacatactggcagcgctacaagtcatggtccccatcagagcggatctcaggctccatgatgggcaccatgccattctgctggcggatactgcgcattgagccaagcggg

SEQ ID NO: 629709 - DNA, 158 bp, Homo sapiens
ctgctgaccctttatactttatgccatgggctacatgacgggcaccatttccagtatgtaccaaaccaaagccgtcatcattgcaatgatcatcgctgcggtggatatccattatcagtacaccatcttctgctttcagacccaaggatggacttcac

SEQ ID NO: 629710 - DNA, 173 bp, Homo sapiens
gtgggttcgtgtgtgcagagacttaccttctggccattgacacaccctgcacggcatttcttctgcggacgcttctgggacacggtacgtcatgtactttcacaagggacccctggacgaccgggatacttttacttttgtgagatcctgggtgtgccgcggccatcttgctg

SEQ ID NO: 629711 - DNA, 758 bp, Homo sapiens
tatctgtgagaaagctggagttcataagtattctccccctcccccatctccagtctcctaggtattcccttactgtgtgagtttttctgttggtttatggagacagagtcttgctccattgcccaggctgtattacagtggcgcaatctcggctcacttgcaatttctgcctcccgggttcaagcgattctcctgcctcagcctcctgagtagcggggactacaggcatgtgccaccatgccgtggctaattttattgcatttcacagtagagatgaggttcaccttgttggtcaggctgtctcgaactcctgacctcaagtgatccaccgactcgtctatgggtatatggaaagacaatttttaaaggtagattgggaacaaaatagacttgaagatgggaaatctgttttattcaaaaaggtgctagacgatgtttcaagagacaatattctgatttaatacgctgtagaaggtaggtgtggaactccatgtaacatgtgcaaaacctaattatgcttttgggtcacttgtcagtcgagtaaatcttgccttcatcttctcccaactcatgtcatctttaggttgtgcacctgaagcttggttaagtgatttagtttctttcagattgataacttacaaggagaagtttggttgagcagtgaccaaaaattattaacaggttttgggcaaaggatcaatttaagagtcttaaagatgttgtggaattgctttaagaaaacggagtttagaattgga

SEQ ID NO: 629712 - DNA, 107 bp, Homo sapiens
tagaggatcccgcggattgtgtccgcagtacgtcgggagcattccggataggccgagaaagtgttgtggagaagaaagttagatttacgccgaataatatgatagtg

SEQ ID NO: 629713 - DNA, 319 bp, Homo sapiens
  misc_feature (19)..(19): n is a, c, g, or t
ttacaagccacgtatggtngtcacacctgtaatcccagcactttgggagggtgaggtggaagggccatttgaagcgaggagtttgagattagcctgggcagggagaccctgtctctacaaaaaaatttaaaaattagtgggctgtggcggcacgtgcctatagtcccagctacttaggaaactgaggtgggaggattggttgaggcttcaatgagccataattgcaccactgcactgcagcctgggcaacactctcaaaaagaaaatttacagaataagccaattcctgggtagagagaagtattaagtttccatagag

SEQ ID NO: 629714 - DNA, 270 bp, Homo sapiens
  misc_feature (193)..(193): n is a, c, g, or t
  misc_feature (250)..(250): n is a, c, g, or t
tactacgggatgctgtaatccttcgatagcaagcaggcagtctatctacaaaacgatgtaccctcttttagagtacagcaggaatagcactggttattgtgtggccaatcccatacgagtatataatgggttcttctgtgcttcataaatattgccaggcggtcttcccaatccaaatgaacatccaatgtgncataaaatcctctgggtgcgcacagtccccacgccatacttctttagcagatgctanaagctgtggctttaaccgag

SEQ ID NO: 629715 - DNA, 689 bp, Homo sapiens
gtatcaacgcagagtggccattacggccggggctgactctcttcgaactcagcctgcctgcacccaggtgaaataaacagccttgttgctcacacaaagcctgtttggtggtctcttcacacggacgcacatgaaatttggtgccatgactcgaatcgggggacctccttgggaggttgggggatctcccttgggagatcaatcccctgtcctcctgctctttgctccatgaaaaagatccacctacgaccttgggtcctcagagccaccagcccaaggaacatctcaccaattttaaattgggtaagcggcctcttcttactctcttctccaacctctctcactatccctcgagcactttctcctttcaatcttggcaccacccttcaatctctcccttctcttaatttcagttcctttccttttctggtagagacaggagacgcattttatctgtggacccaaaactctggtgcctgtcacggactcgggaagacagtcttcccttgatgttatcacgcgaggacgcctgcctgattattcacccacatttcagaggtgtccaaccacgcagggacgcctgcctggtccttcacccttagcagcaagtaccgcttttctggggggcaagaacccccaacccttctcttcacctgagtggaagtgcgcttttctagggggcaagaacc

SEQ ID NO: 629716 - DNA, 293 bp, Homo sapiens
tgtccctatttagagccatattgtaattactgtcatgcaccatgggacaatgtcgtggtcggtgattgactgtgtctataatggtgtcccttgtcccataaaattatcacgaagctcaaaaatttctattgcttagtgtttgtggtgatgctggttgttaagaccagcttacttgcatctgtctgctcatatcataatctagcacaggctgggcgtgttggctctcgccttttttcccatcactttgcgtaggcagaggcagtgcgatcacacgaaacctgagcaagcccagg

SEQ ID NO: 629717 - DNA, 571 bp, Homo sapiens
  misc_feature (571)..(571): n is a, c, g, or t
ccacgcgtccggaaggactgacaccacagatgacagccccacctccttgagctttatttacctaaatttaaaggtatttcttaacccgaaaaaaaaaaaaaaaaaaaaaaaaaaaaaaaaaaaaaaaaaaaaaaggggggggggggcaaaaattccccgggggggcccatagggctaaccgcgattttcttggtgaaacaaggggggtctccataggaggggctgtttattaaagagcacagcacgaagagcgcgcggactaaaacaagcctgctggggaaggagggaaaacaagtggggacatggaggagatgtttgtggagggaaggacgacactcatttgtggggggggtgggaggatattttgtgggaactaaatactactgaagaagaattttaaagccggcttgtagggagagaattattaacaaatttggaaggttaggtatttgtgggtgaaacccaaacgcggggagtattagtcggggcggggtaagaaaatattttgggtattaggagagattatattttagaaaaattttattaacgggggggtatgtataataaagan

SEQ ID NO: 629718 - DNA, 1211 bp, Homo sapiens
agcggctagttccaaaccacgtggacgcgtactagggctagctaggagtgcagcccgagccgccgccgtcggtgtcttcctgtcatcaccaccattctgtgagtcacgagtcccgcgtctgtccttaattcgccgctctcggtgctactacactgtctcttacggagagcgcgcatcatggctgacttcatgtatctcatctctctacattctaatcgtcagaggtagcaactttcttatcgccaatcttactaggtacctagttctaacccctgagtcgtgtcggccctctttcaataatccttatatagattcgggccaggagacgacaacccgggcctccgagattttgaagcctagctatcataagtactaagatatactaataaaatacgaataaggttctcggaattttgatatattaataccataatcattgatacaaacctaatataatatatacattccaaggtcctacctaagttaatgggtagtgcatacttggtggacacatggaactagtaagtcgactctaacagttattctatatatggaaaaataccttggacgagtctttctttagctttgtagccaccatcttaattgaaacagccaccccggtttaaaaacaataaggttttataacgaaggtgagggtggtctcaatgaaattcgatagggatagaactctctatactaggtttggagttgtcatctattaaaggagcaacacaatctcttctctctattatttatttgacaatcaaatttttatgggaattttgattatgtgtatacactcgatttttctgtcactgccttatatccttaatatctatctacccgaactgtggtcgcgacattggcctcccccttttcaggacattacatgacctgaatttttgacgttattttcgttacccttatagttctttatgtagagcgggcagacgttcttcttttataatgcctctcaaatatcatagtttacattatttattattcttttctatctcttcctatcggcaacaaattttattataaatatagtctgaacttcctatcaactttatgaattaactccctcttagaaagttcttcaacatctcttcatttagtagggtcatttctattctttttagcttctttcctttttattttattttcccttatccctgtaccttttcatatttctccctccggaatccgcg

SEQ ID NO: 629719 - DNA, 266 bp, Homo sapiens
ccccccccaattttccccctaggggggggtttttttttttggttttttccccttaaaaatttccaacctttgtgggggtgggggaggggggagggaaaacctttgggaaatttcccaatttttaaatgggggtttgggggggccccccccccccccgggccctgttttcattttttttttaccccccccatggggccctggtcccccaaactttaaggttttttattaaaattaattaattaattaaattaaaaattaaaagggga

SEQ ID NO: 629720 - DNA, 428 bp, Homo sapiens
gcgtactcctatccttaggcagatggtccagaactcagaatttcccagttgtagaaagatggggccgggtgcagtggctcacgcctgtaatcccagcatattgggagtacagggtgggcggatcacctgaggtcgggagttcgagaccagccagtttgagaccagcctggccaacaagatgaaaccctgcccctattaaaaatacaaaaattagccaaatgtggtggtacgcgcctgtaatcccagcaactcaggaggccaaggtgggaggatcacttgagcccaggagttcgagaccagcctgtgcaacatggcaagacctcatctttacaaaaaattttttaaaacttagcccaccgcgcctggacaaaaattgagtttttaaatcattcattacttggtcacatcaggagaacgcgtcaaaatcg

SEQ ID NO: 629721 - DNA, 181 bp, Homo sapiens
ccgggttgggacgcactgcactccagcctgggcgacagaactagactccgtctcaaaaaaaaaaagactttacctaaaaaatgagagggctttgagtccttggagagcctccacgggtcctgagtcattggtcatttctcagtttggaagaacatgggtgctctggtagcctgcttatata

SEQ ID NO: 629722 - DNA, 1157 bp, Homo sapiens
gagatcacaccatcgcactccagcctgggcaataagagcaaaactccatctaaaaaaaaaaaaaaaattagacattaattattgaccaccagatttcaaaaaaccaagcaaattctaaaaaaaattgcaatctcgcaaagagttcattaattcaaaccttcttaaagacacagagaaaaaatttctgtgaaagcgcaagttatgccaggaagggaaaccaatataagggattaacgatttacgaacattacaatgtgaacatgtgaacatgtgacaacaacaaaacaacaccacattaggagaacaacatctcaggtgtgagaattctaacagagatgtgtgtgtgtctctttgtggacacaacacaagactctcaagtacaaacttgtgagcacacaaatcgtgtctttagccaagggggtgtgtgacaaacacatgtgtgagtatacacacgcgttctatatgacacagggggctgtgagacacagacatactagagatatacacaccactttttctgtaaagcgcacagaggggggtgtgaacaacagagagaaaaaaacagaggaaacacaacagagaaatctataactatttatctgacgagaacactgtggttgagagagcgaggggaaaatatctcacgcattatagttgaaagaacaaccctctgtggtgatcgcagaaatattattctcctgagagcacaccacaacaatatcacactccttacagggggggggaacaaatcctaattattatcacagtgggaaacacgcgagaacgctgatgtcttctgcacaacaccgacttttcgtgctcaaacgaccctgtttattacgacacaccacgactttgttacgagtcacttttatcacagcacgacataacgcacagaggcggggacacacacgcccaacaagtatgatttactcccccctgcttcagtacattgcaagaaaatatgcccgtacccactaacaactatgtttcttcaggccccttaatcagaacaaagtctcttcccaacgctcgtttcccaaaagaagtactcgttaaagcacccagtattacaaactattacgttgtagggagaacactttatacagcgcccccccccctgcgggttgtaacacagagccgtttcttctatcaga

SEQ ID NO: 629723 - DNA, 170 bp, Homo sapiens
tttttcctcagaaatctcagtattttatagctctgacgtaaatgaaattcaatttcatagtgtctctcagcacccgaacgtaaaatcctttcttatttcacgactagcgactacacagtaaaagcaacatctctgttcgaaatttcagctttctagtcgtagctatcacg

SEQ ID NO: 629724 - DNA, 146 bp, Homo sapiens
caatgcaacgtgctctttcctccaagactccaggatcaccctctatcagattgcttttcccggcagcttctctgatcaagctatgccaagctctgttgatcctgtgaccgctactttgtctatatccatgtgagaagaaatggctg

SEQ ID NO: 629725 - DNA, 596 bp, Homo sapiens
aatgttaaaaagtccctgttttgtcctgaaattttagtttattttggggaaataggattttttgacccaaatatgaaaagttgtagctttgaagtttagcgggagtctccttgatttgcggaatgcattattttaatttgcttttttgggaaagcagttttgttaaaaactgtacagacttttttttttggtcctagcaggactttatatagtaaagctttgggccatgtagccttttaagactcaattttaaaaaattattaatctggtggggacttttaattcctatttcaaaaaggggttccttgaagaattcaggatacaactttttgggtatgacagctttccttccccccctatttttggggggggggaaaaatttgatttgggaagaatttaaaaaacccatagctttttaatttgtttgaaacaaactttttgcctgttacatttttggttttaaccaattaaaaaagccaaaggcattttagttttatattgggttttcccctaggaaatccccgttgatttgtttgggccttttattaactgcccttttttaaaattttttttcaataaaaggaaggaagatggta

SEQ ID NO: 629726 - DNA, 345 bp, Homo sapiens
  misc_feature (26)..(26): n is a, c, g, or t
  misc_feature (35)..(35): n is a, c, g, or t
  misc_feature (43)..(43): n is a, c, g, or t
  misc_feature (50)..(50): n is a, c, g, or t
  misc_feature (107)..(107): n is a, c, g, or t
  misc_feature (110)..(110): n is a, c, g, or t
  misc_feature (159)..(159): n is a, c, g, or t
  misc_feature (173)..(173): n is a, c, g, or t
  misc_feature (177)..(177): n is a, c, g, or t
  misc_feature (184)..(184): n is a, c, g, or t
  misc_feature (233)..(233): n is a, c, g, or t
  misc_feature (260)..(260): n is a, c, g, or t
  misc_feature (278)..(279): n is a, c, g, or t
  misc_feature (287)..(287): n is a, c, g, or t
  misc_feature (290)..(290): n is a, c, g, or t
  misc_feature (308)..(308): n is a, c, g, or t
  misc_feature (323)..(323): n is a, c, g, or t
  misc_feature (343)..(343): n is a, c, g, or t
aggatgctgcattgcgaggacccggnaattcatantggtgccncgttccntcccgtatttctaacgtgtatgtttctggtggaaaccgagttcaccctggctgggancanctctgatgaggcattctggcgactggatggataatcctgtgcatcaccnttgtgtcctgtgcncccncctagcncagtggccaagccgggaaagccgctaacttgccgttgctgctgctgccntttttttcttttgtctctgcctttccntttgttagatgggggccnnctcttccntanctctgtctctgagttacngggtggaaataagcntataaatgaaatactcttcngg

SEQ ID NO: 629727 - DNA, 613 bp, Homo sapiens
cgtgaaacaatatattgatccaacgtatagttggctggtcagtgaaatattatgaacttgaagaaatagtatacgtcagtctgactcaagatacctgttagtctgctctctcatggatcttccattctgaatctattgtcagtgcctctagactgttgcttcccaacatctcacagtctagttgagctacattttctgtactacgatacatattccagcgaataatctatagccatccttaccgatccagatggaaccgggacagagccgattcgcagagcttaccttgtccacttgtctctaggtaaataattaccgagctcaggtcattgtccgacgaaggaactataatttctgattacctactgcagtttcgatattgactgcaggatttttcagatacaactctctgattactatgaccactttattcgttgaatccacatgagattgattgaccgtgtccattgccaaactaccacacatttctgatatacatcacggagttactgaaaaagctgcaatcaaccacagtcatgaaccccctacatgaagcttgctccaggagaacttactatcatcctctaattttttaaaagaaatcttcatttat

SEQ ID NO: 629728 - DNA, 188 bp, Homo sapiens
gtctagcctcgcgtagtggctgggtattacagatgcacaccatgccccattacttttttgtgtttttagtagagacggggtttcgccgtgtggccaggctggttttgaactcctgacctcaagtgatccatccacctcggcctcccaaggtgctgggattacaggcatgagccaccatgctcggccta

SEQ ID NO: 629729 - DNA, 391 bp, Homo sapiens
cgaaaatacgatataaaattctgaaggataaataaaaaaacaggcgaacattaaatataagaataataaagattaagaagaattataaagagaacaagaatactaaaagaaacaagttcaaaagttaagaatatgataataaaatgataaaatatgaaactataaatcataaagaacaatgtagactgaggaaatattaataatcagacagaaatactaatccgaaggtagattacaaacaccaaaaaaataacagaactatcagacaaccagcaaccaaatataactatatctataactctctctctctctctctctctctctcgctctctctctctgggtctctctctctctctctctctctctctctctctctctctctctctctctc

SEQ ID NO: 629730 - DNA, 106 bp, Homo sapiens
gagtgataccatgaaggagctgtgtagagtggtgcggggaatgtggaccctatgctggagaagaggtcggtgggctgccggcgctgcgccgttgtgggcaatcggg

SEQ ID NO: 629731 - DNA, 338 bp, Homo sapiens
ctccacagtatccagtgtcagaagacagtggagcaatatatacatatttcttaaggagataatatggttaattaaagttaaatataaatccattctctccttcaaatataaaagctacagtaaaagcatttctgtggggttattgtttctataaatttctcagggaaactaccatcggctaaatgcaatgcaaccaagagttaattgaagaaactgtcaaagaacttatgtgagcatttattatatttaaatctagaaaaagactaaaacaaaagtgtaacttagggtgacagatgggattgtaaatattatagcttctgacaatgcagaaataatta

SEQ ID NO: 629732 - DNA, 483 bp, Homo sapiens
tctagagatcccccggagccttcacctatcggtcggctcgctgggctggtgttggtattcgacttccaccaggtaaggtgggcggtggtgcttgagccaggtcttgatgcgcacgcgggtcaggccctgggcgacgaactgcagcttgccgttctcgcggctggcgtggtgcaccttcaccagggtgccgtacagcggcagggcggaggtgtcgaagtgccgtgggtcttcgggcggcgtgtccatgaaaaacagcgcaagggaatggtggtcggatttgctcaccagctccagggtttcggcccagggttcttcattgacgatcaccggcaacacttgtgccgggaagaacggccggttgtggatcgggatgatgtagaccttgtccggcaggttttgcccaggcagggccaggccagtattggacgagggggtttcagcgttttcggggtcgggataatcgttgaggtcggtatctggaaa

SEQ ID NO: 629733 - DNA, 195 bp, Homo sapiens
  misc_feature (32)..(32): n is a, c, g, or t
  misc_feature (53)..(53): n is a, c, g, or t
aggttgcttggcctgcctttctgtcctggggnagctcggggagacaggtgganggagtagatgtcagagacatggtctggtgaagatgccaggaaacacgagcctccagcccattttccaacaaccacccatcaacaccaaagaggttcccaagacatcccacaagggaaaagggacccgtcaaggaagttccag

SEQ ID NO: 629734 - DNA, 552 bp, Homo sapiens
  misc_feature (130)..(130): n is a, c, g, or t
  misc_feature (139)..(139): n is a, c, g, or t
  misc_feature (289)..(289): n is a, c, g, or t
  misc_feature (324)..(324): n is a, c, g, or t
  misc_feature (333)..(333): n is a, c, g, or t
aatccacgtgcctgcttctgactgagattctctttctctctggcccttggctcttcccccatctcctctgaagcgcactgcagcctagtggctctaagtgtaggctccggcactagagtggattccagcnctgtctatnccgtgtagggattgtgttttctgtacaagtctctgtgcccctatttcacctgtgaaatggggataatgacagtatctgctgatggggttcctgtgagggctaaacactgcttagaacagtctctggaattgagtaagtgtgaagtgttgncagttattgtttgggagggaagagctattggttgnccgtgtggnccacatgttccctgtgaatgtgagtttccatgatctttctctgcagtggtagactctcgttctctcagacagatgctctcctcggggagttccggtaatgctattttctatgaaacagtcattctcacttctccgtgttggtggagcctctgtggaccatgggcaggggctccagagatcctgtgtttctctgctttgggaaaatataatttcaaagaa

SEQ ID NO: 629735 - DNA, 441 bp, Homo sapiens
  misc_feature (4)..(4): n is a, c, g, or t
cggnccccccaggctctctacctgctctttccttcctcctgggtggaggaggggcgggctcccggctcgggcttcatttaccagagcggccggctgcagtcacactcaggtcatcttctctcacctttctccttgggccgattaggggccgtgacagcgctgtgaatggggcaggcatgtccttggagggcatcaagactttagcttcgtgggggcgctgtgtcccagctctgatttcagtggcagccggtgatggacagtggcagggaagcggagatctcactggacagtgaaaccctcaaatgaacacaatccctgctttcctgccaaggtatcctggtagggtcccccagcttccccaattttgtgcggtgtccggacaaagcaaacacagagtcattggcatggcccggtgaccgggccagttggatctcccgggag

SEQ ID NO: 629736 - DNA, 370 bp, Homo sapiens
gcacacatgagcccaacaggtacacgaatggatccaccagtcccaaccccagctattcctttcatctgacccagaatgtgcatttatggaagcctccctcaatctccaagctggcagagcaggagggagagtgaagtaagagatggcagagggagatggtggcaaaaaggtttacgatgcaggagaacagtcaaggaggatggttccggccagagtcgatgtggggaggaacagagggctgcagggagagggggctgactgttccattctagcttcggcacaaatcagcagaacgggggaaaagccactagacatttccttagcttccccaccctatgtatattctaggatttgagaggcaagagaggca

SEQ ID NO: 629737 - DNA, 362 bp, Homo sapiens
gcgttattaacttttatatcagatggtcccgacctatgatggttcaacttatgatttttcacgtttactactgagtttactgggacttgaaatgcattttctttctttttttttttggagacagagtctcgctccgttgcccaggctggagtgcagtggcaccatcttggctcactgcaacctctgcctaccgggttcaagtgattctcctgcctcagcctcccgagggcagctggattacagccatgagcccttgtgtcccgcctaaaaagttgtttaaaagaagtttggactctgaagcctaacagaccagggtttgaactctggttcctgtcattcactacctgtgtgactccagacaa

SEQ ID NO: 629738 - DNA, 149 bp, Homo sapiens
  misc_feature (26)..(26): n is a, c, g, or t
  misc_feature (36)..(37): n is a, c, g, or t
  misc_feature (80)..(80): n is a, c, g, or t
atcgctgtatcgaggggagtgtgatncaacgggagnncaggaaagtaaagcaagaagtttcagtcccctgcgtgactatnttaaggaaagtccttaggagtgataaacagtgagaagcctttttttattttttagagaacaaagtctcc

SEQ ID NO: 629739 - DNA, 200 bp, Homo sapiens
ggggaaaatggacaataacccttgtgcatctaaattgttcatctggggcagatttttgaatttggaaagcccaatattcaagccaatgtcagtctttagataaaactcaaatgtactcttgacgcataatctagtcttgtgttccaattattaattttttagtgagaaattatcaaacatttcctttaagaaaaaaaaaa

SEQ ID NO: 629740 - DNA, 400 bp, Homo sapiens
  misc_feature (36)..(36): n is a, c, g, or t
  misc_feature (49)..(49): n is a, c, g, or t
  misc_feature (114)..(114): n is a, c, g, or t
  misc_feature (124)..(124): n is a, c, g, or t
gggaaacaggccttttgatgttaaaccttttgaggnacctttatgaggnttaagaataaccttgattcattcctactttgagtatatgttttcgcattaaaaataaaaatatgncccaggcacnaggtgtcacgccctgtaatccccagaaatttgggaggccaaggcgggcggatcacctgaggtcaggagttcaagaccagcctgaccaacatggagaaaccgcgtctctcctaaaaatacaaaattagccgggggtggcagcgcatgcctgtaatcccagctactcaggaggctgaggcaggagaatcacttgaacccaggaggcgagaggttgcagtgagccaagaactgtgccattgcactccagcttgggcaataagggcgaaactccatctca

SEQ ID NO: 629741 - DNA, 151 bp, Homo sapiens
aaggagaaaaagtgggtgagatgctggagaagagaggagaggagagaggcagagagcggtttcaggttggtgggaggggagccctcctccccacgccctcccctcccctgatgcaggggctctggagagaaccaataaagagattactcac

SEQ ID NO: 629742 - DNA, 987 bp, Homo sapiens
aacgcttcaggctagtacgaggcgggtgttgagttcggcggaggcgcgtgcggcgaagtgcggggctgctccgtcggcacaatggtcaagagcgtggctatttctacggtaccccgactgtgggcgaacttccactacggagctggacaccctatgaagccccatcgcctggacattgacccatagcctggtcctgcattacggtctctataagaagatgatcgtcttcaagccataccaggcctcccagcatgacagttgtgccgcttccactccgaggactacgattgacttcctgcagagagtcgagtcccaccaatatgcaaggttcaccaagagtcgttaactgccttcaattggtaggcagtatgactgcccagtgtttcccgggctcttgagattctgctcgcgtaacgcaggcgcatctcgttgcaaggagcaacccagctgaacaacgagatctgtgatactgccattaactgggcatggtggtctgagcctatgccaagaacggtttgaggcctctggacttctgctatgtcaacgacattgtgattggcatcctggagctgctcaagtaccaccctcgggtgctctacattgacatttgacattccaccatggtgacggggttcaaggaagctttctacctcactgaccgggtcatgacggtgtccttccacaaatacggaaattacttcttcccgtgcccggtgaccttgtatgaagtcggggcagagagtggccgtactacctgtctggacgtgccctgcgggatggcctttgatgaccgaggttccaagcccttttccgcgggtattcacaggtagtggcttcttcaaccccgtgcgttgtgctcccgtgggagcgacccctgggcggacccatggggggtttaccacaccgccggctgggggcgtgcgatttgaggcatccccccggcggggggggactctcccgggcgcggggtaaacacgcgggaggccg

SEQ ID NO: 629743 - DNA, 326 bp, Homo sapiens
acacaggagtgctgtcaccactggaccgtgcgtgattaacacgtgacgcaggtgcagagcacgcaagatcgtaaagctggagcctggtcaacgcgagagcgatcctccagtagccgagcatgcatccctgactgaaggacgacgtgtatacagcaatgcaaatgcatgcctccctgaacaagtaccggcgagacgtgagcacagtgatgagctccaaatactcgttatgcatggagcctggacgacgagtattcaccactgcggtgcatgcctccctgtacaatttccgtagacatgtgagcaccgtgctgacctccaaatatcgt

SEQ ID NO: 629744 - DNA, 129 bp, Homo sapiens
aactaagttaagatcagacatctaatttaagtcacacagtacccatcaagcaacaataagtagtaatgaaaaataaagttaaaaagacaaacagggtaaaagtcaggctgagaaatgaaagctttactc

SEQ ID NO: 629745 - DNA, 325 bp, Homo sapiens
gacgcttcaacggaacttaggcgaggatacgaggtgccggtgagcccgagtctgactccggggacgaggaagaggaggggccattgtgctgggaagacgacaaaaagctttggggaagaaccgcagtggtagatttcaaccctgatttcgttttcacttgagaaggaggggacgtacgataggcagctgggccctaggttaatgtcatgtagccatagtcagagatagaagagggcagccacttacattaggatgagcaagattgaggaaagttcgagaagaccaaggaaaacaggaggatacaagaagccaaggtctgggaagg

SEQ ID NO: 629746 - DNA, 361 bp, Homo sapiens
tgctcgttctagcacgatcccccacattagctcttccgtcgctgccccaggagcaccttctcccgggcccctccattgctgtgactatgacctcagcgtgcacagccaccctggccaggctctccccgcctcttcatctcgaccggtcaacctcttcgaccagaatttctccacctttggcatactgagctctgacgccctatggcagctgtcagggcagcatcccttgcctccactcactagatgccaagagcatccccttgatgtgacaagccaataacctctcttgacattgcccagcgtcgcctgggcacctcaatcaccatacagaaccatgcgtctaaacatgagtcaaacaact

SEQ ID NO: 629747 - DNA, 102 bp, Homo sapiens
acacccacaccacaaaccccacaccgacccggggcgaacagtgtatcatagtgccgctgggttgagcgaagacgacgcaggagctagtgagcgaggaagcgg

SEQ ID NO: 629748 - DNA, 322 bp, Homo sapiens
actctctataagtaggtgctgcaaatccagttcttcccaaagcactttatttagggtttattcacaagtcatatccatttggtacaggttggttctaatatttaattaaccacttattacaaatgtcttgcaaagaaatgttattaaaaccttgaatttttaccaatgtaaaaaaccaaaagtgtattaatgttattgttcaggaaaagctacgtaccgaagggcttttgtatatgaattctgtggtggggagcaccatttgtaatctatatggcagttccatctgggttttaagtttagatttcaccgtgtcttagtgctt

SEQ ID NO: 629749 - DNA, 137 bp, Homo sapiens
gcggtctgcaggcggcatggggttgtatggattctggatgcttttgaaggataaacataacatgatgatgatgaagatgacagaacagatacagggtactagagaaaactgtctgcactgctgataaatcaaagggg

SEQ ID NO: 629750 - DNA, 417 bp, Homo sapiens
tggctctacaaggtggaccagccataccaattagatggcaagcttcttgaggatagggccaatctctctctctcttctctcctcttccctttctttctttctctctctctctcgctgtctctttctttctctcccctctctgcatcccacattgcttctgtcccagtgtatggtataagtaacaagtgattaataaatactgactcagtgacctgtttatgacagaaaatctcaaattatagttcatgtaaatgaaaaggagtgaaaactgtgcttggtcccatcctataaacaaaatgtgacagtgttatgatttgttaaaagcaatgccaccaggccaggtgcaatggctcacacctgtaatccaagcattttgggaggccaaggcaggtggatcatttgaggtcaggagttcaa

SEQ ID NO: 629751 - DNA, 109 bp, Homo sapiens
acccaggctggcctcaaactgtgtcctcttttaaaggacacgttttcatttctttatctttacttttgtcttttttagttagagacggagagtggctttgctgcccaga

SEQ ID NO: 629752 - DNA, 228 bp, Homo sapiens
ccttcatgggccagccctgcctccagccctccctctttcaccccaactctcccccaagcccctttttactcaacgggggtagcccctggtgctttgaacccttttgtttttataaaatggtttttgcaaggggcccaggttctcttttccctgggcccctgcaaggaggggagtgctctcctggtttttgtgcaggcgggttgattaaaaatggtgtttttttctcta

SEQ ID NO: 629753 - DNA, 486 bp, Homo sapiens
acaagagacaaaggacatcatatattaataaaaggttcaggccgggtgtggtggctcacgcctgtaatctcagcattctgggaggccaagggtgggcagatcacgaggtcaggagattgagaccatcctggcaacacagtgaaaccccatctccactaaaaaaacaaaaaaaaaaaaacaaaaaaaaatttagccgggcaggggggcaggcaccttatgtcccagcttactcaggaagctgaggcaggaaattggtgtgacccggggaggcagacctttgcagtgagctgagataacgccattgcactccagccggggcaccattgagcactgagtgaacgagactccgtctgcaatcccggcacctcgggaggccgaggtgggcgggatcactcggggtaaggagctggagaccagcccgggccaacagggcaaaaccccgtttccaccaaaaaaaaacgaaaaccagtcaggcgttgggggcgt

SEQ ID NO: 629754 - DNA, 736 bp, Homo sapiens
cctcatttcactacagacctttccggcacactggtgccacattcacctgctccgtactagccatagccagctatgtctatgtttacccagcgaactataccctgccaggactctcccttcgacggtgcaaccttgatgccactcgacaagccgtattgtctgacatgtcaccaacttccgtcccagtggctgctgcacatatcactgtccaggcgctgaaccgatcagcgccctctgaccggatgcatccagtctaagcgcgctaacgcgatacgtgatgactatagtaccggatgcgaattcttgttccgctgaacatataggcgacgccttcaagcgatgtcttcggttacttctcagactacatggcctgtagagatggttgtccacggttagccagcaatccactatccgtgcatcttgcacggtctatagcttgtacagcctcatcacattcactactcgcctgctaatctgcgttcgcagtcgccagctgggaatatgcctctacggcccactttgagcatctactgccgcacgtaactgggaatcttctctcttcccctcatagacgactgatgcccgctcgacttagcgcatacactcgacgcgcattcctgtcttgcgcatgatctcatctccatccgctagtcaattcgctcttcaccctgcttcggcgaactctagtgctcgtataggtcgctccggtccccactctgccgtctctgcctctccg

SEQ ID NO: 629755 - DNA, 102 bp, Homo sapiens
attttcaatggcaggaagagtcccgttctgggacagctggagacagtagtggtgactcaaataacctttaccaaaggaaagctattttttcgcaactattct

SEQ ID NO: 629756 - DNA, 240 bp, Homo sapiens
aatcaaaagagacttctgtatgttggctgaaactggcttgtttgaagatttgactgttaactcactctctcctgatcttggaaggtcagatcgacagctcagttttggcttggtggcgtggaacttcagcttgagggactccatcttggtttggtctcttgggccttgtgcaggagctcagtcccaaccaatggcctcctagaaatattatttaacagttctccccttttggtcaggttg

SEQ ID NO: 629757 - DNA, 329 bp, Homo sapiens
  misc_feature (74)..(74): n is a, c, g, or t
ggcacaggcaaagcattctgggaagggctccagaagaaggtccagcctaggtcccctgcatagctggcagcccncacccccaccccccaggccgccttgagaagcacagattaactgagctctgtctcctgagctgcttctgcctgctttccacctccccagtccctttctctggccctgtccatgtgactttggcccttggttttctttccagattggaggtttcaagaggccccaccgtgaagtaaccaagggcgcttcttgtgggcagctgaggcccatgctctctcctctctggagcccatcctggcagaggggctggggtgggc

SEQ ID NO: 629758 - DNA, 408 bp, Homo sapiens
aaaaaaaatttggcctcttttccctcccaccccaaaaaaggcagaacggggggttttttctggtggtttcctccccccggggttgaaaaaaccagcccaaagggaaggactagggggcctggaccggtttaaatttttttggggttaaagggccccttgggggttttttttcccccttaaaaccttttggaatataaaagggttccccccccttttttaccaagggccccggttaaaataaaaaaaaaaattcccaccttggggggttttcccccccccgttattgggccttttgccccaaccttgggggggggggcttttgggaagatggggcttggggttccggttggttcccttggtggctttttttatggaacccctccaattaaccccccctggtttggttga

SEQ ID NO: 629759 - DNA, 110 bp, Homo sapiens
ggggcacgggttcgtgtgtctttttgaaacatccacctctcacaatttaggcagaagctgatatcccagaaagactatatattgtatatattttttgtttgttttttatg

SEQ ID NO: 629760 - DNA, 1469 bp, Homo sapiens
cgcgctcgcgggttcaaccatgcgtatcgaaaagtgtctcatttccgtacggggaccatctatcctggcacacggcatgatgttcgtccgcaacgatagcaaggtgttcagatttagcaaatctaaatgtcataaaaactttcacaaaagaagcgcaatcctcgcaacagcttaggtggacccaaagcattccggacagcagctggtacagagcttacagaggcatacatacattctgcacactctgacaacacgtagcaaatgcaaccatatccaaatcacccagcgcagaagctcatggccacatcaacaactcatccgatgcgcatgcaagaagcagctcgcaagcaaatcgaaaaccagcacagcgccaaaagctcaaattgtactaaactcgacaccaggactacggacacgacacaccaaatacacagcaggcataccaggagacagattccacggcactaaatcacacacgcaaagatcccaaggcacacaaaaccaatccccagtcctgcactcccagcgagccacagccatacaatatgccacagagcaccacaaaggcgcggcaacacccacagccgaggagacacacgaaagaaaacaaaccagggagacaccacggccaacgccatacagacacggacgagcccatcgctcgggccccacaatcgccaacacacaaatcggcaacaccgtatatacacacaaaaacttccatgccaagggcacacaacacccccaagacgacagcccaggcagcacacacacatcggactaacaggcaaagatagcaccggccaccaacacacagtagggacacgcaccccaacgaccacaagggagcgccacacccctaccaccccatctggcgagcacacacagccccacagggggacgccacagcaagacaactaccccaagcttacaacacgacgcacgcgtagcagcgacaaccaatacaaaacgacaaatataacaacaaggaaggagtaacccaaacaccacgactatacaccaaaccccttgccacacaacacaaccaaagcaacggccacattgtcaggacaagacacaggcacacaacaccatgcacgtcactgcaccacaccagtgacacaccaacactatgggacccacaacagacagcacacaaccagccacacgcataacaccaaacacaatacgaaccgcgccaacagcacagtacacacaacaggcgaacacacagaggaagatcgctaccgacacaacaccagggcgccacaccacccacagccaagagaaccaggcagcacaacaaaacaacatcggaccaacaaaacactcgggcagcatcacgcaacagcacgcacacaacagcacacacaacagagcacaaacaaacaccacactcggaaacaccagaacacggcacaaccaacgcccccaggaagtggacaacaaaccagaccaacagaagcaca

SEQ ID NO: 629761 - DNA, 600 bp, Homo sapiens
atttggggggaattaaacggggggggtgactcttcgcatgggggttgcatcttggtggggagagaaacagtctctctgtggtgggtgggataagtaataacccaccacgtggtgtttttgtacggcactacgatttttttataatatgaagttttctttttttccactaataataagttctttttgttccttttttgttggaacagtaaacgctccctgcatcatggtagggataatttagcggtcctctcgtttgttggtgtcgcgccacactgtgtttatttagatgaatggtgcttgttgatggtcgtcatgcattgggtgtgtcgtctttgtgttgttttttcccccgactcttgctcgattcatggtgtgtggttgctgttgtctgtgtagatgtagttttgctcgcgcgtctttgttaaacaccacagtggggttgtttttgtttgtggtaatgattggtgttgcggcgtcatcacctatgattgtttttttttcccccctttgggcttctttttgggggggtagttttttttgggttttttttttttttttttggcccccccctaccttatatttttttgtgagtagaagaga

SEQ ID NO: 629762 - DNA, 365 bp, Homo sapiens
gtcgatctagaggatcctatgcgggagctggagctgaaggagaagagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacgggtgccgcggtct

SEQ ID NO: 629763 - DNA, 977 bp, Homo sapiens
  misc_feature (265)..(265): n is a, c, g, or t
  misc_feature (285)..(285): n is a, c, g, or t
  misc_feature (293)..(293): n is a, c, g, or t
  misc_feature (299)..(299): n is a, c, g, or t
  misc_feature (306)..(307): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (324)..(324): n is a, c, g, or t
ttcaaatgatgttggtctacttgctgaaaaatgctgggtttgactggaatttaatagactttccacagcacgtggaacttgcaaaaaaaaaagttcactccctaaaaccagatcagatgaaccctttaccaatctgggggttgctgccactgcctttaaacaattgggatatgccttagctatggggtctaattgcaggccatgatatgtgatgggcctgtgctttcccaactatgttcttttttatgtatgtatgtatgtattnattttttgagatggagtttngctcttcntgcccnagctggnntncagngngngactcgnctcgctgcaatctccgcctcccgggttcaggtgatcctcctgcataagcctcccgagtagctgggattgcaggtgcccgccacagcccagcttatttttggtattgagttggagatggggtttcaccgtgttcgtcagggctggtctcgatctcctgacctcaggtgatccacccgcctcggcctcccaaagtgctgggcaccaactatgttcttgagtaagaactcctgatgcctgattgttatgttttatgaacaaaacaaggtgaaggttcagtataagttggaaatccctaagaaacatatttgttattcccatccctggtcatattgccttaattagactgtgaacgttccggatgaagtcctttttaaaatgagccggttactggccatttctgtgtctgccgggtttcccaggtgtggttctaacaggaggcctattattctgaaaccggccattttctttgggccccggatttgtgttgggccccagttttggtgcgaagcctgggtgatttgaaatcttcccctttcatcctgtgcccctcgggttgagggcgctgatcccggggggacctgtccttgcataagcccgcttgtatatgtggaacaagcgtgacgtgagcaactcaccgagagctcttgcataac

SEQ ID NO: 629764 - DNA, 1031 bp, Homo sapiens
ggcttcttcggcggaagcaaccgtgttgcttgatgtcccagcggcgccccgcgtcatcactcgtcggtgcatgcccggaggtcttgcttcatctgggtggactgtggctcgccgaactttgagagccaatactctagcgtcgggcctgcatccagtgttccgacggactgttcgtgggagactcatggtgggcatatctcttgtctgcaccagccgtcgcgtggactgtttaccccagatgttgctacctacgaggagcgttgcgtagcagcttgcaaagcttggccatccaggagattttgccaaagcagggaatggttgcaggtgttgattagccctattcgagataggaccaggagtagtaggagccatatcttgcaccttggaaagcaaaggatgattcaactggcttgacatattcgtcgcaaggaagacgcacacagtaagacaggtataccttctttcccgatcatgcgatcgatcccggcaatcctgggaggcttgatccaataccttgtgtttgggcatggcttgcgaataccacgactatgagataggattggaagagaggggcgagtggcacttgttgaaacgagacatgcgttgatgtgctgttggagtattataggggtgcactgagtaagcacaggcttgaaatgcgtggtgcttatccttgctaacaccaatgggtatcacttgggcaggagaacagttaggatgaggattcatcatggggtatgtcaatcttcttctcacgagacatgacaaggagatacaacaaggggttggccaagacaccaagtttgaatttggacaaggggaatggggaggattaaagctggtgcatgggtgttacatattctaagtctaataggctgtttaaacgaaagaataggacctataacaaaatttttttacgagaaaaacgggagttcctttaaccaaaaggaaagagtcgccgaattcttgggacatagaaaattaacatcaggattatgacgagtgcacgaaggcgttcaagagtataatgg

SEQ ID NO: 629765 - DNA, 245 bp, Homo sapiens
ccctcctataccagttgcaacagaccccccacccttccggccccatgatatttaatctatttaatcttcttgcatctatttctcaagaattactggctttacaagaagccaaagcactactagctttttttccatattggtatttttgatgctgcttccaattttaaaagggaacaaagctgccataaatcgaaatgttcaatactaaaagctaaaatatttctcaccatcctccatggtgctga

SEQ ID NO: 629766 - DNA, 842 bp, Homo sapiens
cgaccacgcgtccgtgattttacttgaatgtgcctcagatggaaccatttgatgtgagaaacaattcgtttttaatttacagcaagaatattgaataaccattgagcaaaaagactattatttccttgtaccaagataatacgttagagaggacctcatgaacgcacgtcttcttactatttaacgaatagttggctgttttgtgaactttattcagaagcagttagtcaataagattccatataataatgtcatgggtatttaagaaatgaatattaatataatgaaatggtttgccgtttgtgtcaggcagtaataagccaaatacgtttgtgttacccaatagataattctcttcagagacaaggtgatgtaatgaagagaagttgtaccatgagttcaggcacgccatagtgctcttctccatttcaacgtcaccattacttacaaagatgattgattattgctataccaaatcagcatgaactctgttcatcacttttcttctctgtccccaaacaattttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtcttattattgggccagcccttttttgacattgcttccagcagtggaaaatgggcatttgatggcaataggccaaaatcattgtgtccagagagtacactttttcaaaatgctcacctactggcaagtgtgaatccacttgacaat

SEQ ID NO: 629767 - DNA, 726 bp, Homo sapiens
taacggggacggcgagtggctggtgcccatcgggcgctgcatgtgcaaagcaggcttacgaggcgcgttgagaatggcacctgtctgccgaggttgtccatctgggactttcaatggccaaccaatgggagatgatggcctgtacccacattgtcccatcaacatgactggaccacttctgaagtggtgccaccaactgtgtcttgcctgcaattggcgtactacagatgcagacctgtgaccccactgtgacatgccctgcacaaccatcccctcctgcgccccaggcttgtgatttccagtgtcaattgatgacactccactcattgactaggaggttggacccctaccccgatgacatacctggatgtgccgacagagtgacctcgatctaacaaacatcattcttgcaaagacgcttggtgtgctcgggccgtgtgggtagcactgacaccctggcaatgcagggcgaaccaaattggtaacatagttacgacacccaacgcgcaagcttagggcactgaccctggaggccaccggccatttttaccatcacgtaggaccctggcaaggggaccacaccaacccaatgattacacccatttcgacgaattccagggctggtgaacgcgcgtaacatgacccagagtcccctttatcgcccttcaagtcgcgctctgtagaacatcaccaccaaaccaggtcgcaccatcggagctgccatcc

SEQ ID NO: 629768 - DNA, 420 bp, Homo sapiens
  misc_feature (9)..(9): n is a, c, g, or t
  misc_feature (42)..(42): n is a, c, g, or t
  misc_feature (179)..(179): n is a, c, g, or t
  misc_feature (211)..(211): n is a, c, g, or t
  misc_feature (313)..(313): n is a, c, g, or t
  misc_feature (380)..(380): n is a, c, g, or t
  misc_feature (382)..(382): n is a, c, g, or t
  misc_feature (386)..(386): n is a, c, g, or t
ggtttctgnctaaaagcctggcccgctaaggtgaaaagggtntggcaaaaggagcctactcccaaaaatggaggctgtaggaatataacctcccaccctgcaaagggaatctcttgcctgctccatctcataggctaagtcagctgaatcccgatagtactaggtccccttccctccgnatcccgtcagctggaaaaagcctgtggcccanaggcttctccaaagggagggtgacatgctggcttttgtgcccaagctcaccagccctgcgccacctcactgcagtagtgcaccatctcactgcagtagcacncctcctggccgtctggcctgtggctaatggaggtgacggcactcccatgtgctgactccccccatcncnctgncgctgtgccctgcctggctagtccctgcctgaat

SEQ ID NO: 629769 - DNA, 404 bp, Homo sapiens
  misc_feature (304)..(304): n is a, c, g, or t
  misc_feature (369)..(369): n is a, c, g, or t
ttcatcatactggaggaacagatttaagtatgcccggacaggagatgaagtaaagaagattggcatgcagcggttcattaaaatcgagggcaaggtccgaactgatataacctacccggcgggattcagggatgtcatcagcatggacaagaggggagagaatttcggtctgatctatgacaccaagggtcgcttggctgtacatcgtattacaccggaggaggccaagtacaagtggtgcaaagtgagaaagatcttggtgggcacaaaaggaatccctcatcgggtgactcatgaggcccgnaccatccgttacccaaatcccctcatcagggtgaatgataccattcagattgatttagagacggncaagattacggatttcatcaagttcgacacgggta

SEQ ID NO: 629770 - DNA, 313 bp, Homo sapiens
tggaaatggattctcgctttgtcacccaggctgacgttgcagtggcgcagtcttcggctcattgaaggcttcgccctcccgggtccacgcaattctctgtgcctcatcttcccaagtagcgtggaaccacaggcacccgacacaagtggccatttttttttccttggtattttaagaaaaaaggggcccccacggtgcaagccaggattgctctaatcttctaacctcgtaatccgcccacttcagcctcataaagtgctgcaataccgggaattagataccgaaaaaaagcccaaaagggttcccgagctca

SEQ ID NO: 629771 - DNA, 417 bp, Homo sapiens
  misc_feature (1)..(1): n is a, c, g, or t
  misc_feature (7)..(7): n is a, c, g, or t
  misc_feature (94)..(94): n is a, c, g, or t
  misc_feature (116)..(116): n is a, c, g, or t
  misc_feature (121)..(121): n is a, c, g, or t
  misc_feature (139)..(139): n is a, c, g, or t
  misc_feature (144)..(144): n is a, c, g, or t
  misc_feature (159)..(159): n is a, c, g, or t
  misc_feature (201)..(201): n is a, c, g, or t
  misc_feature (209)..(209): n is a, c, g, or t
  misc_feature (242)..(242): n is a, c, g, or t
nccctanacttgacgtctggcattgtttaaaaaaatccgattgataggtcagagtattgggggattatagaatccccctttcacccttgtgtangtctttgttaacaactgttatncttantctaaaatgagtctcaancggangccttgaagacagangcttctatagaggttccttgacctaaatagttcagcattgtntttttatnctggtatctaatcagattcctaatcatagcccntaagaaggaatgttactttaatattggactttgctcatgtgctcgtgtccgcattttttttttcttaaaatcatagccatatggtaaattttctattttgttatggttctcttttattgatgggcatgcagtgggtgttacttggaaatggccaatttttattaaaatatttctg

SEQ ID NO: 629772 - DNA, 117 bp, Homo sapiens
ctcctgctaccgacttttgctcttactttatgcctgctatgactccggctctgggtttcccgacattgtcattgtttttcttagtggagaataaagaccaaggggcacagtggagga

SEQ ID NO: 629773 - DNA, 300 bp, Homo sapiens
  misc_feature (18)..(18): n is a, c, g, or t
  misc_feature (173)..(173): n is a, c, g, or t
  misc_feature (283)..(283): n is a, c, g, or t
  misc_feature (285)..(285): n is a, c, g, or t
aattcgcggccgcgtcgnacacggctgcgcagaagacgacagaagggtggaggttgccgtgagttgagattggaccactgctctccagcctgggcaacagagtaaaactctgtcccaaaaaaaaaaaagaatacaaccttgcaggatgtctctcctggagacagcaagagcgnagacgagggagagggctctttcttagaaaagaggcctttggtgagcccagaagtttgaaaccagcctgggcaattcagcaagatcccgtctctacaaaaaaaaaaaagananacaagcggccgctcg

SEQ ID NO: 629774 - DNA, 621 bp, Homo sapiens
  misc_feature (258)..(258): n is a, c, g, or t
  misc_feature (279)..(279): n is a, c, g, or t
  misc_feature (285)..(285): n is a, c, g, or t
  misc_feature (295)..(295): n is a, c, g, or t
  misc_feature (315)..(315): n is a, c, g, or t
  misc_feature (339)..(339): n is a, c, g, or t
  misc_feature (343)..(344): n is a, c, g, or t
  misc_feature (353)..(353): n is a, c, g, or t
  misc_feature (369)..(369): n is a, c, g, or t
  misc_feature (381)..(381): n is a, c, g, or t
  misc_feature (384)..(384): n is a, c, g, or t
  misc_feature (395)..(395): n is a, c, g, or t
  misc_feature (397)..(397): n is a, c, g, or t
  misc_feature (425)..(425): n is a, c, g, or t
  misc_feature (430)..(430): n is a, c, g, or t
  misc_feature (444)..(444): n is a, c, g, or t
  misc_feature (459)..(460): n is a, c, g, or t
  misc_feature (477)..(477): n is a, c, g, or t
  misc_feature (479)..(479): n is a, c, g, or t
  misc_feature (484)..(484): n is a, c, g, or t
  misc_feature (489)..(489): n is a, c, g, or t
  misc_feature (512)..(512): n is a, c, g, or t
  misc_feature (532)..(532): n is a, c, g, or t
gctcccttgaggccatgagttcaaggccagcccgggcaacatagtgagactctgtctatatggaaaaaaaaattaaccaggtgtggtggcatgcacctgtggtcctagctacctaggaggctgaggcaggaagattgcctgagccaggaggttgagtcttcagtgggccatgatcataccactgtactccagcctgaatggcagagcaagaccctgtccctttaaaaaaaaaaaaaaagaaagaaagaaaaagaaatntaagaaagggcactagaatantcagtnttatattacntttatttccggtttaaaaantccacacaacgggcaaaaaaaagngacnntacattgancatttattaagacagntgcatttataanttncaaactctcgngntcctcccatattatttggcagggatgantgatnaggccatccaaagntaaagattaattggnnaattggctaatgatggnantgacnccggntgaggtacaagttcccagcaatnctgggaattagcaatagggngtacttctttctcgaaagaagcatgattggtaagcagctatatctgagtgtagtaaacctgaaagtttaaattaaaacaaaaaaaaaag

SEQ ID NO: 629775 - DNA, 491 bp, Homo sapiens
ggccacttccactatgtcccatcaaagagagctggattggccatcataggagggttcattccctgatttcccctattttcaggggaccccctaggccaaacctacgccaaaatccctttccctatcatattcatcgggggaaatttaacttttttcccccaaccctttttcggcctatccggaatgccccgacgtttctggggcttccccgatgcataccccccatgaaacatcctatcattgggggggtccttcctttttttaacagcgggaattttaataattttcctgatttgagaagccttcgcttcgaagcgaaaagtcctaatagtagaagaaccctcccttaacctggaggggctatatggaggcccccccccctcccccccctttgaagaacccggatacataaaatttagacaaaaaaggaagggatcggacccccccaaggtggtttccagccccccccctggcccccctggctttttcca

SEQ ID NO: 629776 - DNA, 177 bp, Homo sapiens
atactgagatccatctctacaaaaaaaaaaatacaaaaaaattagcctcccgagtagctgggactacaggcacgcgctaccatgccgggctaatttttttggtatttttttttttggtaaagttggggatctcagtattgtaacccagggcatacggggggggggtaccggagctcg

SEQ ID NO: 629777 - DNA, 130 bp, Homo sapiens
agtttgttttggtaatcggggtataataggctctgcctgccaaagggatggaggaaaaactgaaaggcttttcccccccaaaactcttttggggttttcaaagacctgggggtgctgtgaagctggaact

SEQ ID NO: 629778 - DNA, 369 bp, Homo sapiens
tcgtccacgatgacgactccatgcttacttcttctaggaaaagtatttaaatcgaccactcatcattcgaccataattttaaaaaactggctattttgtaaaatgtgtcagagactccatgggacagaaccctactttttgtagaggaacttaatctgaataaagtctgagtataacagtaaatctccactgagtatactggtacttttacaaaaacaagcccatcattgtccatacgtaatgagttagacagatagatatactttcagtttatccatgatttcgtacatcttgtcgcctggaattaacatcacaggttcgcaaggggcgtcattggtaccgtcatcaaaagaccatttgcctcccaga

SEQ ID NO: 629779 - DNA, 292 bp, Homo sapiens
tctgccttgctatgcactgttccttttcaatgaataccaggtttccaggagagaatccactctattgttatatcttgggtcagctccttcattaatggcctagaatgtcatctcactttccaactttcctagacttggcaagcatcccctgctgtcccactcttcacaatttgcaagccaactttttgcccacttctgtgcaagttgtttcctttgataccactgcttgactgtttctgagtggctactcaccagccctgcagccaatcaagcagtgagtgcagtgcagtgt

SEQ ID NO: 629780 - DNA, 286 bp, Homo sapiens
  misc_feature (42)..(43): n is a, c, g, or t
  misc_feature (72)..(72): n is a, c, g, or t
  misc_feature (161)..(162): n is a, c, g, or t
  misc_feature (251)..(251): n is a, c, g, or t
  misc_feature (274)..(274): n is a, c, g, or t
ctccatagtccatcgagcatgtccagaggacgcagtcagtgnngttgagtgcgactctgctcatatgcactntccaatcgactctctgtgagcatcgagacagaccttgttattctcagacttggaaatgcattgtatcgatgttatgtaaaggcaaaccnntcagtgtaatagttactccagtgccacaatcctagtgctttcctttttaaaaatgcaaatcctatgtgattttaactctgtcttcaccngattcaactaaaaaaaaaaagtntttttttccaaa

SEQ ID NO: 629781 - DNA, 169 bp, Homo sapiens
ttttcctttccctccggggcttttttccaggttttccaccaatccaaaggggccctgttttttggttcccaaacccaaaaaatttggtttcccccctgtaattaggccgatctgccttgtttggtttcccgggggaattaaggtttcttggctcggcgcgcccaggctt

SEQ ID NO: 629782 - DNA, 160 bp, Homo sapiens
agcttgtgagctccttagatctgtggtctctggagctgtggtatgctgctgatgatatggagaaagaagagctcagagtggaacaaggagagagctactctaaggctgagtggagcgacagatgcccagggatactgagtctcacagactagtcaagcct

SEQ ID NO: 629783 - DNA, 534 bp, Homo sapiens
ggaaggcgtggccatgacgtgatggagcataggcgagagcacaatcgtgctatgcgctgacgccaacgatccgtacagtagagcgtggttaacttacaggaccgtggaatattccaacaggtacgactttaccttgtcagactgctgattctgtaacaaggccttgcacatcaagtttctcctgctgacttaatccacagtcttatttttgtagccagcctgtgagacttaactaatccagtgaaggcagccttggatatgcttgagactaatgacgacagtattgttgcatacatctacaggatacccagaggaacattcctgattgagccgaatggctactagatgagctacccgaatgaatgcgatatgatgttgaaacagtagcttaacatttaccaatggcctcataatattatgagtgtacgcaacgctttaaagtccaaatatgtttagacaattaagagttagtgttataagataacttcagggtttagggtgatcaacaccagttagcgtattttgcttttttgg

SEQ ID NO: 629784 - DNA, 131 bp, Homo sapiens
ataaacacatagcaagggtagtcctcatttaaaatgtattcaggtcgagggtgatggctcacgcccgtaatcccaagacttggggagcctgaggcggggggatcacctgaggtcagagctcgaggccagcc

SEQ ID NO: 629785 - DNA, 150 bp, Homo sapiens
  misc_feature (16)..(16): n is a, c, g, or t
  misc_feature (21)..(21): n is a, c, g, or t
  misc_feature (39)..(39): n is a, c, g, or t
  misc_feature (44)..(44): n is a, c, g, or t
  misc_feature (60)..(60): n is a, c, g, or t
  misc_feature (62)..(62): n is a, c, g, or t
  misc_feature (64)..(65): n is a, c, g, or t
  misc_feature (87)..(87): n is a, c, g, or t
  misc_feature (133)..(133): n is a, c, g, or t
  misc_feature (137)..(137): n is a, c, g, or t
  misc_feature (140)..(140): n is a, c, g, or t
tgatgctagaagcctnataantgttctacctccaaggtnagaantaaaccttaggataantntnntaaagtgattttccccagtgtnttatatgaaacatttccttttggtttaacctcagtataataaaganaaancantcaaaaaaaa

SEQ ID NO: 629786 - DNA, 1064 bp, Homo sapiens
  misc_feature (706)..(706): n is a, c, g, or t
  misc_feature (709)..(709): n is a, c, g, or t
  misc_feature (756)..(756): n is a, c, g, or t
  misc_feature (783)..(783): n is a, c, g, or t
  misc_feature (841)..(841): n is a, c, g, or t
  misc_feature (847)..(847): n is a, c, g, or t
  misc_feature (942)..(942): n is a, c, g, or t
  misc_feature (1062)..(1062): n is a, c, g, or t
acgtattgagtaattgattatttatagcatgttagatggcagagtgccgtagtgttgtgtacaggatgacgacttgggctgccagtatgatgacgggcgaattagtatattatgttgtcaagacagatcttgggttatttgatgcccctcccgttgttagataccatggatccggaaaaggtgttttaaaagtgctttgcgtggaattgtttctcgcccgagatcttgattgttgttttccgaattcggaattttgggtttcctgtgtgaagaagagggcgtgtcgcagccctcggagatatttttattcgaaagttgccgtttgccactgggcagttattttcgggaacacattttggggaaagggttttcgcccactccttccagattgattcttgctttttaaggaggacttaccatccgcgactctgtgttctaattggggccacagaggatttcgcttaagaaaagttgaagagccctttcagcactttctcatctgtggagaagatggaatcttgaaaaacctttggaattttatctgttttaccagtcccttgatggcctaagttccccccgttttctgctgtttgatctctaaggaactccccgttgctaaatatgaagagtatggaacattcaaatagtctctgtgaagcactggggggagggaagacatttctttttcttataggctttatgctcnaangtcatagtctcctttcaaagaattgtgttgcattttaaatgcacccngcttaagtagaagacattaaggatgcntaattttcaggaactattttgaattatgaaaagattcccaattgaaaaaattattcancaagtnaaagctaagaaatttcattgaaatcataaggcagtttaagcataaattgataaaaatagctgtgtactactaattaatagaaaatcattcaaccnagagaagagtcaagtgaatatcgtttgtttatttgctagtgagtttctttgtaacgttgattttattaaatgataatatttggttagtatgtcctatgttaataaaaatgaacaaaattnaa

SEQ ID NO: 629787 - DNA, 754 bp, Homo sapiens
aatgctatgtatgagtgctgtgttcaaatcaggcagaggctttgagctggataagctgaagaggcaggatgcagattgcctgtgactctctataagatcctagacagctgcaaacagctgactctgtgcccagtgtggcaggtgagtgaggatccgatgtggcatgtgtgaccatcatcacatggccttccactggacaaccccatgctgtgctttcatgtgccgccatgcatggcatgccctgcatggcctgcgtgcccacgccatgtgtggacatcaatgaattgttctggacttcgtacaagcagttggaaggaaattaggtttgatagcttgagccaccgcaagtgcgcctgcatgttgggtgcttgacatccatgatctctccgtgcccgtccgcgtggcaagccatgggaaccaggtacagccgtgttaggtcaagcacccaagacaatcacctggccatggagctttcaattgtcaagctgcagacagccatgtggatagttgcacgtggccttaagaccttgagctcaatgcaatgaggccgttggcaccggtgtgcaaggtgtgtgccccacaaagagggtaaggcccccggggtacaatgcgagagacagaggcggcttgcagtgagggatcacacccatttataggcgagtagagccccaagagagaaaacgggcttacaacgatggacaacaacgtgcctgagaagcgggaacaaaaagtgtttggccacatatgtgggagc

SEQ ID NO: 629788 - DNA, 1088 bp, Homo sapiens
  misc_feature (706)..(706): n is a, c, g, or t
  misc_feature (709)..(709): n is a, c, g, or t
  misc_feature (756)..(756): n is a, c, g, or t
  misc_feature (783)..(783): n is a, c, g, or t
  misc_feature (798)..(798): n is a, c, g, or t
  misc_feature (813)..(814): n is a, c, g, or t
  misc_feature (865)..(865): n is a, c, g, or t
  misc_feature (871)..(871): n is a, c, g, or t
  misc_feature (966)..(966): n is a, c, g, or t
  misc_feature (1086)..(1086): n is a, c, g, or t
acgtattgagtaattgattatttatagcatgttagatggcagagtgccgtagtgttgtgtacaggatgacgacttgggctgccagtatgatgacgggcgaattagtatattatgttgtcaagacagatcttgggttatttgatgcccctcccgttgttagataccatggatccggaaaaggtgttttaaaagtgctttgcgtggaattgtttctcgcccgagatcttgattgttgttttccgaattcggaattttgggtttcctgtgtgaagaagagggcgtgtcgcagccctcggagatatttttattcgaaagttgccgtttgccactgggcagttattttcgggaacacattttggggaaagggttttcgcccactccttccagattgattcttgctttttaaggaggacttaccatccgcgactctgtgttctaattggggccacagaggatttcgcttaagaaaagttgaagagccctttcagcactttctcatctgtggagaagatggaatcttgaaaaacctttggaattttatctgttttaccagtcccttgatggcctaagttccccccgttttctgctgtttgatctctaaggaactccccgttgctaaatatgaagagtatggaacattcaaatagtctctgtgaagcactggggggagggaagacatttctttttcttataggctttatgctcnaangtcatagtctcctttcaaagaattgtgttgcattttaaatgcacccngcttaagtagaagacattaaggatgcntaatttttttttttncttccccccacgganncaggaactattttgaattatgaaaagattcccaattgaaaaaattattcancaagtnaaagctaagaaatttcattgaaatcataaggcagtttaagcataaattgataaaaatagctgtgtactactaattaatagaaaatcattcaaccnagagaagagtcaagtgaatatcgtttgtttatttgctagtgagtttctttgtaacgttgattttattaaatgataatatttggttagtatgtcctatgttaataaaaatgaacaaaattnaa

SEQ ID NO: 629789 - DNA, 1452 bp, Homo sapiens
taaacacgcttaattcactttatttttctggttataaaaaccctagtgttgtagccacagcgggagcctgagtccgctgcacggagaacctctgtggtgtgtgtgggttctttgacgaggtgtggtcaggtgaaattccgtggatagggaaactggggtgaatacagtcttcctttccagaaggttcgggggttcaggtagcgtgatagagttttaaaaagtggcatcaaagggtggccttggggaaagttgtgcccagggtgtggcagtgtgcagccccggggctgtgagggtgttaccagctcatctcgaataccagccattcagtgaggcagctttcttataggcacagggtgcggaaacagagtgccagtgtgcccctgtgggtgtgcagggaatagagggcgttaccagacaacagaagccagaagaggcgccgtgtgtcaccttgttgtcacaggtgacaggtgtgtggggtatgatgccggactcttggtgttccccccagataagccctctgtgggcacggggagacacatggcgaagacgctttgggccaaggattgattgtgccccaaggagattggcgggtgggcacacctatccttgtgtgaagcaccttataaacaccacaagaccagacggtggggcccatttgtgtaatgtacaccagcagataagcacaaaaaatgggcgctttgaaaacctggggtggccgctgggccggggacagagggggtcatgggtatcatgggcaatctggggcataaactccttcaaaagacactactatccctttggaggaagatgagcgcccccaaggtgaaaagaacattcaaagttgaatcctcgtaagataccctataaaagtggggccacgagggacgaaaacacaggactacagattcctccctccaaggaggaacttagaactcttatcaacttgtttcccttttgacacaaagtcggggccccaaattaggtgtcagacagaagcaactcacacattcctttaatccctatcggggcatttcggcaccaccaggaggaaaggacatcacaggggaggcgccatctagacaccagcggcgccccggcacaaaggggcgcagagaccccagatgaccccggaaattggcacctaggcggaaaaccactcccggcggaaaagcacagaccggcgggcgtaccgcacaacccaagtggggaacaacaagggcgtccaccggagacccccgccaggtcaagaacacaggaggaacgccagcagctaatagatgggagagcaagtgagaaagagtcatatctgagaaacaggagccggacaaaagaaacacacgatgaaaaaaacagagcaagagcaacatcgcacccaaacgaacatactctgagaaacacaagcaaaacgtagtagaagaaacgagagcaaaagcagaggagcacataagttga

SEQ ID NO: 629790 - DNA, 471 bp, Homo sapiens
tggctctaaagggggtaaagggggtgctatagggtaaatacgggccctattctcaaagatttttaggggaattaattctaggacgatgggcttgaaactgtggttggctccacagatttcaaagctttgaccgtagttataccccccggtcgtgttagcggttgaaaggtggtttgggtttagacgctccgggaaatggcattcgtgttttaaagcctaatggggttggggacagcctcagtgaggtgcaagacgtctggtgatgctaattattatacgaagtggggggctctccaactcgggaggtactacctcgatgtgtcaacgctcaaggagtcgcaggttcgccggggtcataggaataaagttgggggacagctatgtcggagttggaagattagtccgccgtagtcggtgtactcgtaggtttcagtaccatggggggccaatcggatttgatggtaaggcgag

SEQ ID NO: 629791 - DNA, 608 bp, Homo sapiens
gggtttcgcatgtttccccagaggcgctccacatctcaggcgatggcggcgggagagacgctccttacttcctagatgggatggcggcgggaagaggcgctcctcacttcctagatgggatggcggctgggacgagacgctcctcacttcctagacgggatggcggccgggaagaggcgctcctcacttcctagatgggatggcggacgggcagagacgctcctcacttcctagacgggatggcggccgggaagaggcgctcctcactttccagactgtgcagccgggcagaggggctctccacatcccagacgatgggcggccaggcagagacgctccccaattcccagacggggtggccagccgggcagagcgtgtaatcttaagcacgtgtggcaggccaagggaggcagcgaacaatttcctaatgaagtactggaaaagacaacctttttctccattactatttggaatagtagatcacatacatcaagtgttccaacaccacgagtcgaataaataatgaatcttgtgataaagagtatccgtcttggagggatattcccgttgtagagatgttcacttgtggcggatatccacatatcttt

SEQ ID NO: 629792 - DNA, 1556 bp, Homo sapiens
acaaactgtgaagagtgtgcgcaatagcctttaaccagatcctcagcgccttgactcgacataagatgattcatactggagagaaacccttccagatgctgaagagtgtggcgaaagcttcctaaccggctcttcacgacccttacgtcaagcactagagataactctcagtacctagagagagacaacgcctacataactgtgaagagctgtggaaacagccttacaggccgcgctccttcagcatccttacctaacacatagcacgacgagacttcatgactgagagagaagggcgctacaagactgctgagtgcacacctcattgccacaagccgtccctacactggctccatcagccctctcgtactacccctctacctcaggcactacacgatacactctcagtacgtggaacgcacgaaaccccctacaaaagtgtagaagaagctgtggcaacagcgcctcttagacccgggtcctctcacctaccttatttcgaacagataagaatacatctcaataccctgggagtacagcaagacccgcataagaccacactgctgcaaccggacgcctgctggcgcacccacgacccgtactacatccacgacttcgttcaaccacctttctacccctccaaccctagttccccactactctttccactagcctgcgcgcgacgaatggcccccgtagcacaaacctggctcgacaccgacaacacggctgggcccacagacgcccccctactacaccacgcgcgacccttccacccacccgcgttccaccatccacagcctcgtgacccgcaactacaacagtctcgaccaaccctggcgaaccgaaccaacaaaccctccgctaccacaaccggtggctgtgatgagtacacagactagcgcgaacaggccgtagcgacaactccgagcagacacattcaactaaccgcgtcaacgcaggctaacagttaagcggaagaacactctccaccgacccagggcacgcaagagagcccacccacgcccaagcatcgcatgaaacgaaacaggcggcgacacccagagcccatggcagaccaatcaaccgatccacaagcgctccaccacccacacaaccaacatgagctacaccgacgcacgcaacctaggcccccaacagagcgcacggaggagacacgccacctagggtacaacaacggaccgtagccaccacggacactcggcaaacgcaccacgctaccgtagcaccaactaaagcgccaacactacactaccaccacacgagcaaccccgacacaaccccgcgccaagcacaccccgaagcgacgggccgcgtacaacgcaatacagtcgctcacaccacatacaccgacgcgccaacccaaccaccgccgggcgccaaccaacaccaagacaaggagacagaaacggtcgcatagcaacctaaccaagagccggccacaccagcaccccgcagccgctgcctcaacatccccccacacaacacaggggagcacacgacgcagacccagcgacgcaaactgcgagacacag

SEQ ID NO: 629793 - DNA, 1033 bp, Homo sapiens
  misc_feature (126)..(126): n is a, c, g, or t
  misc_feature (195)..(195): n is a, c, g, or t
ggctggagtcgccgatcccgccggaggcgccagtgacaatggtggacccgggacgacgagttcgactacctacttcagaagtggtgctcatcggcggtactcaggcgtggcgctaagagcaacctngcttgtctgcgcttcgacccgcaacgagttcaagcctggtgacgagctaagatgcatccatcgtgcgtngcgaagttctgccacccagtagtcatccagtggggacagtgcgagaccatcaaggcgcatgatcttgggacaccgacttggccaggaatgccgctatcctgcgctcatcaagcctaccggcgttacgtacgcgtgagttgcacgatggagacgacccatggcattggtggtaacgggaccaattcgcgcaaggcaaccttgagcactagtggagcaaaccgtgtgcttggcgctagagcttgacatggacgtctgtccgtgcgcaccagcggaccatgatcgaggccatatcagtcggttcaatcccattggcgttgaggtgcgcggccaaacctaggaggaaagttgagccgtagccagtcgctacccttggcgggcgacattgtggcgccgaccttgaacggaggggcccccgggcggccctttcgggccacaaataggaggaacaccacatcgttttaggtcgcctttctatgcggacgaccagctcatggcccttatgtggagtttccccaccggtagacccggtgaggaaagggaaaccgcacactttcagcaagacacccaggtctctttcaacaaggtaaggtaattccttaacctggacaaatgctgtttgtctccaccggagggaaaaacaccaagtaagtccgccaatcgaacctccgggccgggtcgttagcccgccccagaccgaatcgtgagaggttccccccccggtgggggggaaccacacacagttgggtggtggggaaagcactttccaagggcgagattggccccaggggccccatgcccatgcagggacaacggggcagccaagagaaaaagccccccg

SEQ ID NO: 629794 - DNA, 160 bp, Homo sapiens
cccattgagtgttgagttggtcgtacggaatcggggtatgctgttcgaattcataagaacagggaggtcagaagtagggtcttggtgccaaaatatgttgtgtagagttcaggcgagagtgcgtcatatgttgttcctaggaagattgtagcggtgaggg

SEQ ID NO: 629795 - DNA, 675 bp, Homo sapiens
ctctggtggaagacaagccaggtcatgacccccaacataggccctgttggaactcctaacgacctaactccttgcacttggagtagactgcctatcggttacgctgatcatagtactgctgctaaccgacctgttaggcatatacgaatgatgatgcactgagccaggatatgagtaatgcgatgatgactagacaacagctgtttacgaaggcccttgtggtatcatactaactatttgccatgaacaagttattgacgcaggagattccaggcccgaatatgagtccagcataggctataccgcgtaactagcgctacgctggaacccagcaggtgtcaccttgatgaataccctgggctcatcaacacgtctgacatgcttagatcgttgcataatgcgcttcaagaacccgtgctggctaataccgagaacggaccaaccgtcaccacagaatcgacgcactgtttattgccatttacagggtgacgatggtagcttgagacatgcctcagagtaacttcagttttggtacaagctatatcgacgggcatttgctactcaacatttttttgaggacagaggcctatgatgcacttcaaggcaagtatggaacaagtcttcctgcattatctgagttggccggccatttaagttgtgattgacttccccccg

SEQ ID NO: 629796 - DNA, 417 bp, Homo sapiens
gcggtacagctgaagattcagactaaagtcctatgtagaatgtttcctttaaagagaaataaggtcgggcatggtggctcacacctgtaatcccagcaccttgtggaggctgaggtgggctaggatcacttgagaccaagagttcaagaccagcctgtggccttgaaaaaccccatctttactaaaattacaaaaattagctggggtggtggtacatgcctgtaatcctttatactcgggaggcttaggtgtgagaattgtctgaacccgggagacggaggttgacgtgagctgagatcgcaccactgtactctagcctggatgacagagtgagatcctgtctttcaaaaaaaaattgctggtcataattcactgaattgattcatggctcacaaaatgggtcgtgacccacgggta

SEQ ID NO: 629797 - DNA, 100 bp, Homo sapiens
ttgggtatgtcgaccggccgtcgcggagctcagcggcgacggtcatggtgtcaccatggacgccttcgacgtccacgagttcgaccaggtacctgcccct

SEQ ID NO: 629798 - DNA, 162 bp, Homo sapiens
tagaagggtggtcatccccatgagggcttggggtggcatgggacgctggcggcatggacagtgtcaagccaagagctacttgcccgaaggtacggggagccaggactgacccgggtggacatggcagagcctgagacgcccttctcttgaccccttcgactg

SEQ ID NO: 629799 - DNA, 1283 bp, Homo sapiens
ctcgttgtttgtgtgaggagcgaatgaatagaagatgggttgtcgtttgaagagagaaagtggtcgccgccgatggcccgtgtgggtgacaaaaataactgagttgggtagagcctctgttggttgtgtgtttagaggaggcccggttagattctggcgtcgcacaggtatgaagaaccagatggagggttgttggggggggctaatcttcgtcccacgggttaatgcgaagaggacgtgtgtggtgatgttttccttttgttaggagcgaggttggcaagaccccctttttgggtgctaaaaatggtgggcgctttgtggacgagcgatatgtttcttgtggggacagaagtaccctcccagggaattggggatttatgagtggttcccctgtagatgtgttggttcgggtgctgagcggaaggtttttgtcggttagttggtgcaagccggtgttgaccaacggctgaatgcgtgcttttaaaataggggcgagtgttttagaatgtcttgtttgtagataagacccagtttataccttagtgatctcgagggtagcaagattttggggttgacaaaaggacaaaattttgtaaagtcgcactcgtcaaagtgtaatctctggctataatagtgtaatatataggatatggagactctgtgatgtgttagtttctgaagaagttttatccacatttgggttccacgatatatgtgaaacgccacccacttgtcgccccttctgagttaagtaaaatgcgtaattcttataataggagaatagtgtaaaatttctataatgtgttcttattgtgttctataagggccacaattttcgtgggcgctttctggggttgtttcttctaacaccgtgttcacagataatttattcgccttatataattgggtggtataaataattgtggatagataacaccacggttttccccttgttcttcttaaatgtttgtgaaaatataagcttaccacaatagagtatcttaaaaccacgggcttaaatgggtaaagccacaacacgctgtgtaatcaccacaacctagatgcacgagggaggttcttgccagcactcccaaattctctgtgtgtcccctcttgacacactcacctgtttcccccacgagctaactatcctgacgtatggtaattctccctctgtccttttaagaattattttaccagttatgtgtataacaatatggtttacattttgctcacttttgacttatataaaaactagaataatactaaagaaaaaaaaaaaa

SEQ ID NO: 629800 - DNA, 106 bp, Homo sapiens
ccccgatggcgcgtcctatggacacggagctgccgtgcccgtagtagagatgacaggccaggctccgtctatgatgggacgcatctcctacgctgctgctggtggt

SEQ ID NO: 629801 - DNA, 387 bp, Homo sapiens
  misc_feature (256)..(256): n is a, c, g, or t
gcggctgaagatggagaaggagaaggagggcttcccagatcacgtcgctgagcggagatcaacaccatcctacaaggcccagtcatcccaacatcgtcaccgattacgagagattgtcggtgggcatgcaacataggacaacgatctagcatcgtgatgaagctatgtggatgcacgaacctcaagagcctagatggagaccatgcaaacagccacttcctgaccagggtgacggtgaagaccctgcatgatccangctgctgcgtggggatgaaacacctagcacgaacaactgagatcctagcaccgatgaacctcaacgaacgtccagacctagctggctgagaccacgaccggtcatccctcaagtgtgcggtgactatcgag

SEQ ID NO: 629802 - DNA, 354 bp, Homo sapiens
gtacagtagatagagactaggacatcatatcaccacagagaggaaattatggccagaggcagcaagatgtctatggtagactactagtgccaggagcaagactaacgccagagagacaagactgaacagttatcggtgttaactatcggagaagccaggacaacagcttagcaggttaatggtaaggctgaagagtaagaacaggtgaggtcaaaggacggaaccctgggaaacaatatctgctgtgtgtgtatccggaggacggggcaaacggcacaggagacagactataaaaagaaccagtagcttaattaaatggagggagaggtatgtatcaataataaacaacaagag

SEQ ID NO: 629803 - DNA, 891 bp, Homo sapiens
cggtcccccttttaacaggagggtttctcaccttttcgcggtgtcccggaaaaaaattccccccggatttttttgcgccacttattccgcccccggggggccccacatatttggttacctctctcccttgcgccaaacccagggtatcttaccttctcgccccgcagtgagtttgctggcccccccctcctggcgggtccctacgacgtgatacctctttggggttagcggagttaccttggaactcactctctcttatatttcgcccctctgcgcggatatatatatatttcacgctcgccaagtcgaggaatgtttctccgccgttgacgtccgccgccccgctccctccgagcagagatccggcgcgcccttcagagaaaaaggcgccccatagggtggccgtctgcgcacgaacctactagggagacggcgctttcttccggaggattctgaccccagcagagcacccttcccaccgcccgggccgacccatcggttctacaagacagacgcacaccagagagggcggcgccgcaggcaccctcgcgcccgcccccaacatggtcgttctcgcgccttacatccagtgagaaggcagtcctccacccagagaggtttcgagcggaggcaccacaggggaacagacccacccgcggagagagtccccgagataacccggccgatggtttgtcgaccccactcacagtgaattcccccccaccaccctttccaccaccgcggcaggatgacccaccacggaagacatcgtccccgaagcgctccctccccgaacagaaacaaccccaaggcggcggcatgagaccccccgaaaatgatcaccccccgggacagccccggatcggcggataaaaaaacccccaaaaaaca

SEQ ID NO: 629804 - DNA, 761 bp, Homo sapiens
tttccaaaacgtatatgggagaaatatggggcttggatgtgaggacagcatcaattaatgagggatcctctcccttggatcaaaacaccttccaccaagaaccaactttaacgctgagcattacctctcaaaggtgagatttgggcaggggactaatatcccaactggtatccacatctgaccagggggttcacaacccagaatatataagggagctataacaattctatatgaacataccaatgggcaacagggcatatgaaaagggactccacatcattgatccattagagaaatggcaatcaaaactacagtaagatatcatctcaacccaggttaaaatggcttctctccaaaagacagattataacaaatggtgaagaggatgtggagaaaagggaaacctcgtggcactggggaaatggtattagtacaaccactatggacaacaatttggaggtacctcaaaaactaaaaatagagctatcatacaatcccacaattccactggtagttatataacccaaagaccggcaatcagtatattggagatatatctggcccgggtttcctggagaccaatcccaatagcccagattgggaagcacttaagggctaacagcgatgaaggctcagtcatatgggtcttaaaccaggggtttaatcggctgaagtgaccggcctggcgcctttatggcctagacctagggaaagcggcagagacgactcctgttggagttgtgggcgcgacattagggagg

SEQ ID NO: 629805 - DNA, 476 bp, Homo sapiens
atctatatcgacaggctgctttgaactcccgacctgaagtgatccacccactccagcctgggtgacagagagagactctgtctcataggaaaaaaaaaaatcagtgctgctcccgtggtgcacagctggtggttggtcatcccaaacctgacaaccagggaaaagagaagagaagctcagaggagccagataaaggaggaacccaccttcggggtcgggtaggcctggacccggatcaggggcttgacggactgcagggtgtggctgaggggaagagaggaggacgatgtgatgtagcggagaccactctgcagcaggggccacagacggtcgtctcgagggctgactgcttttgcgggcccatttggtttggcccgtgccgggttctttaaaactgggaactgaatgtcttaatatggagaactcactctttccttccccaaagaggtcaccatccccgtattctatcctgatct

SEQ ID NO: 629806 - DNA, 147 bp, Homo sapiens
atccccgtcaaaaagtagaaaagatgaaaagcaggcctggacgccgttgttcacgccatgtcatcccagctactttgggcaggctcgcaggccggcggatcacgtaggtcaggagatcgagacctctcctggcttaacacggttgta

SEQ ID NO: 629807 - DNA, 176 bp, Homo sapiens
ctcatgagcctaaactattccagactagcccctactcccccaattatgagggtactggcccccaatcaggcatcaccccgtataaatccctctagaagtcccactcctaaacacatccgtattactcgcatcaggattatcagtcacctgagctcaccatagtctaaatgcaatca

SEQ ID NO: 629808 - DNA, 339 bp, Homo sapiens
agcaattatccttaacctttgtggcaccagtgaccagtttcatggaagaccatttttccacgtacctgagatggggtcggggaggggtttcatgattattcaagtgcattatatttgtcactagattctcataaagagcatgcagcccagatcccttacatgcgtagttcacaatagggttcatgcccctatgaaaatctaatgctgctgctgacctggcaggaggtgaagttcagctttgctcacttgccagctgcttacctcctgctgtgctgcccagttcctaacaaaccacagagcagtaccagtctgtggcataggggctggggaccactgtac

SEQ ID NO: 629809 - DNA, 271 bp, Homo sapiens
agactcggacagcagatggccggagaagatcacgctctctgcatagcacagtggaactggggattctccacggcatacttaaacagcattcccctctcgggctccctggcgtgcaccatgctctcttctcatagcagtccacagctactggcgactggactccagtaccccctaactccttctggcgcctctgaagccttgcacagagcctgtggtggctgccagtgccagacctgcaggcgattctgtcaataaagacagtatgaatgcg

SEQ ID NO: 629810 - DNA, 251 bp, Homo sapiens
gtgctttcggttgcaatccagcaccttgggaggcgagacagataatcatgaggtcaggagttcgagaccagcctgaccaacatggaagaaccccgtctccaccaaaaacacaaaattagctgggcgcggtggcatgtgtctgcaatcccagccactcaggaggctgaggcaggagaaccgcctgaactggagaggcagaggctgcggtgaaccgagatcacgcgtttcccttcagtcctaggggtcaatat

SEQ ID NO: 629811 - DNA, 204 bp, Homo sapiens
ctgtctctatccagcaaagtgggcttctgaaagacgcgcaggaattgctttggcgagtgcctgataatcgaatgccgtcgcggcaccggtcgtatacatcttccgcagcgtcctcgagctgcaggcacagttcaagcaaggcattgtggtgtgtttccagcctaatgatgtcggatgcatgaagaggggagccagctgtcatgt

SEQ ID NO: 629812 - DNA, 690 bp, Homo sapiens
  misc_feature (2)..(2): n is a, c, g, or t
  misc_feature (157)..(157): n is a, c, g, or t
  misc_feature (181)..(181): n is a, c, g, or t
  misc_feature (196)..(196): n is a, c, g, or t
  misc_feature (292)..(292): n is a, c, g, or t
  misc_feature (294)..(294): n is a, c, g, or t
  misc_feature (351)..(351): n is a, c, g, or t
  misc_feature (366)..(366): n is a, c, g, or t
  misc_feature (377)..(377): n is a, c, g, or t
  misc_feature (383)..(383): n is a, c, g, or t
  misc_feature (388)..(388): n is a, c, g, or t
  misc_feature (395)..(395): n is a, c, g, or t
  misc_feature (397)..(397): n is a, c, g, or t
  misc_feature (401)..(401): n is a, c, g, or t
  misc_feature (403)..(403): n is a, c, g, or t
  misc_feature (406)..(406): n is a, c, g, or t
  misc_feature (411)..(414): n is a, c, g, or t
  misc_feature (416)..(416): n is a, c, g, or t
  misc_feature (420)..(420): n is a, c, g, or t
  misc_feature (432)..(432): n is a, c, g, or t
  misc_feature (439)..(439): n is a, c, g, or t
  misc_feature (444)..(444): n is a, c, g, or t
  misc_feature (446)..(446): n is a, c, g, or t
  misc_feature (454)..(454): n is a, c, g, or t
  misc_feature (461)..(461): n is a, c, g, or t
  misc_feature (465)..(465): n is a, c, g, or t
  misc_feature (487)..(487): n is a, c, g, or t
  misc_feature (490)..(490): n is a, c, g, or t
  misc_feature (532)..(532): n is a, c, g, or t
  misc_feature (535)..(535): n is a, c, g, or t
  misc_feature (539)..(539): n is a, c, g, or t
  misc_feature (595)..(595): n is a, c, g, or t
  misc_feature (677)..(677): n is a, c, g, or t
anattcatattactatccatataagaacaaatacatttagtcaactatataaggataacacaaaaggtttttgtttgttttaggcttctcagttgaaagaaaacatcgagtaaagaaaatgaatttccagtaattaagtattaacaatataaataanaaaaattacttctaaatgtcttanattttgacaactttnaattatacttacatactaatatttccaaaaatcatttaagtaacaagggtaactgtaagggtgaaaatatattttgaaaagctttttaaagatatntnattattatgctttaacatcatttcatttattcttggcacatacggcatcttggaaantaaaaatacatcttnccaattttctnctattnttcanttacaananaaananaanttttnnnnanaaanaacttttttcanttactanctttntncaaaattnttttgangctngttaattacctttttgtgcttngantaagaataaattaaataatgcatattttaaatgtacagcatnggnactnaataaatgatatactttaccttatttattcacatttatgtaatatcaaaatatcanagtgctatgttgttgtacaatttgaaaaactgaaaaaatttggaaattaaaaaataataatgtgttttgaaaaattgcactntttataaataaat

SEQ ID NO: 629813 - DNA, 107 bp, Homo sapiens
cagagtccacaacagtcccagctcataccatatatcctgaacatacaaaattaatgttttgcttttaatatgaatgttttattcaccttaatttctacatgtctata

SEQ ID NO: 629814 - DNA, 216 bp, Homo sapiens
cattcaagtcatggggtacgtcctgtggcccagataatgagctgcagacggacgggaatgtgcaatgtggagacacgcgagccttatggtcccaggacctggcaggacatgaaatggagtttcttaagagggtgaaacaagattgcatggaccaattcgtcccgtatcgtccaagcgcaggataaacaatatcccaagcatgcgtggatggagccc

SEQ ID NO: 629815 - DNA, 575 bp, Homo sapiens
gctcattcacacagtcttgtagactaagtctatatgtctctgtatctctacaactatcacgtgtcgagcacatggcaggtgctcagtaaaaaattctaaatgggctgggtgtggtggctcatgcctgtaattcccagcaattttgggagtcttgagggtggggtggatccaggagggtccaagaaggtagagaaccatcctgggctaaacaaagttgagacacctttctcccactaaaaaataacaaaataattagccgggtggtggttggtgcggcgccctgccagttcccagcccactacgggacggctgagggccaggagcaatggcaagggagggcggagctatgcagtgcagctgaagatggtgccactgccactaccagcctaaggcaaacaacagcgagacctctgttctcaaaacaacaaattgtgaaggcttctctgatttttttcccaacagttgttctgaatctttagccatgcccagtaatttttacataccttctaataatggtagtacaaccataaacttaatgatcttaaccatatttaagtgtacaatagtgtcaatat

SEQ ID NO: 629816 - DNA, 276 bp, Homo sapiens
catctcaaaaaaaaaaaaatttacaacctacggagaagctaattaaggatttgtaggtcctcaataatttacaaaaacttagaaaaattacctctaattaggtcttaagggggctttggttacggagggacttaaatttggtaaggtcattaattggactgtcatcagacaatgcctgtcctgctctgattctggagtcctctaagggtgtatgcgcctatctccatttcccccgaggttttggagcaacagagtgctggtataaagagctgggca

SEQ ID NO: 629817 - DNA, 183 bp, Homo sapiens
taattacctgtcgctcctattgttgcagttgggtaataagccgaccttttggccatcgtccttgcgtaagattggagggcgttgggtttttgaaaaatcaagtgccacaaagcacaatgctgagcatgatgctggggataaagggagctctcaatgaacgttgagtatgactggacagtgaag

SEQ ID NO: 629818 - DNA, 879 bp, Homo sapiens
gcctttcggccggtaatcgccatctttccagtaattcgccataatgacgatcacagagggaaagaggggaggcactccgatgtatgtcctctatggcctctattactatacatagctgtggcacgtggttccttcgtgcctactatatatgccgaaatcttttaagcataagggtgactatagtatcacatcataggtgaaatggtgtacgtgttctcatagggatgcctccctacaagggtcatcatgtgcaaatacatggtaacagtctacaatgttaccctacgcatgcggtacgagtattagatggtaaagctagacaatagttgcatgggcatatgatgtcgtggcctagagaattaatgtgcagtctggagcactttatggactcggggagccgaaataccgtcgtgaatgcgttgtgaggggaacatgattgcacgtaataagagcacaatgcaaacgtcctctgagatccggtgtctgggttcaaactataacggctccatgcccttagctctcatgccaagagaagctgactttgtgagaagcaatgggaagggagcctgagtctggatggtacttctatggccctatgtaatgccctgggattccggggtgtgaattcttctttctctgggctttgtgccttttacgggtggggcttagatcaccagtgtggggtcggggctcccagggactttgaccttgagtcccagtgggaagcgggcctaggacttgtagtcctggtacattcttgctcatggagtctctgtgcccacgacgggggtgccttcactccaaatctctggttcgctatctttttgcccgatagggtgcgtccttgggtccacccggtcgggctatatgcccgcgggg

SEQ ID NO: 629819 - DNA, 132 bp, Homo sapiens
atagcggtccaactgcccaaatacgatcgatccgcgcaataaagtttgatcctctgttgtcctcaaccgctcccatttactcccggactcgatcacagtagaacatccaaactcgattttcgcggcgccacc

SEQ ID NO: 629820 - DNA, 672 bp, Homo sapiens
ctagaggatcccgacagaagatcacctcatcaaaagaaagctgtaaatatgaaagaacaaaggttatttcctggagaaaagacaatttattcaacatatagatgacagattaaagcactgttaatgaaaaattatgaaattgatgactacactatggttatataagaaaatattctttgacatacacactgaaatatcctgggggtaaagggctacaatgtatataatttatcctcacatgattaaaacaaaattttgtgtgtgtctgggtgtacacatgcaagtgtgtgtgtgtgtgtgtgtgtgtgtgacagagagagagtgagagagagagaaagactgagcatgcaaaagtataagaaagagtgagcatataagtgcatatgcaaatggagaaatggaataaaatgtgttaacaataggtgaatctgggtaaagagtgttgagatgttctttgtattatttatatgtgtgtaactttgtgtgtatttgaaattatttccaaaaaaagttaaaaaaacaaaaacaaacacaaaatctttgttctacgtaattgtggttctcccaagaaataagcactgttatttccacatttgcgtatatacatttctgtattctctgaaaagagaataatgagcacatattatttttaaatacagaaaacagagaaag

SEQ ID NO: 629821 - DNA, 210 bp, Homo sapiens
  misc_feature (35)..(35): n is a, c, g, or t
  misc_feature (56)..(57): n is a, c, g, or t
  misc_feature (91)..(91): n is a, c, g, or t
atctagaggatcgcctgggtgatgatgtgtgttgncgcatcatagaacattctatnnagagctaatcaagagggagaaaaatgttagtatntattcaggaaagaaaaattatatgtattagattattggttttcttctcatctttacatttttaactataaatacttttatgttttgctttaaaatgtgatgcttcaaattaacacatat

SEQ ID NO: 629822 - DNA, 259 bp, Homo sapiens
gaactagtctcggtttttagtttgttagctgcctgggagtgttattttaagaaagcaggagcaccatcatttgacacacttctttatagatacacacacactttaaccctggactttttttgtctctcacattttttcaaagagggggtgtaaggtcaagatgtaagggcccatttttctttttctcggggaggtgctcggcggggtttttatttaagggctctttcaaatgaaaaaccccccaaaggaggaaaagggg

SEQ ID NO: 629823 - DNA, 167 bp, Homo sapiens
cattatctaccaggacttcggaatcatctcccatatgtcacttactactccggacaaaaaagaaccatttggataccataggtatggtctgagcatatgatatcaattggcattcctacgggtttactcgtgtgagcacacccatatctttaccagtagatatcgca

SEQ ID NO: 629824 - DNA, 109 bp, Homo sapiens
ttcctgtaatcggagaagacctgaaacctcaccttgcacagtcacagggagcaagatgaagctactaaacttatacataaagagggccagaccaccaacagcacatgct

SEQ ID NO: 629825 - DNA, 146 bp, Homo sapiens
gtgttctcgcggctcttcgtgcgcaggctagagccgtctcggctagctttttgtccccaagctggtccccagggtcgcttccatggttgtcctccgcattccaggttcagccatgcaggcaggtcttgctgtgctcagtgcagtcc

SEQ ID NO: 629826 - DNA, 871 bp, Homo sapiens
tgcgcggtgccgcgcgggcgggaagcgaagaggctgggcgtgccagcgaggagcgctggagtaagaaaaggcgcgagcggtcaggagggctcaggccgagacaccttgcaatgccggcgtctgtcatcgaggcctgcgcgtgtgctcactgatcctgcctccaggccaccgccatgtcgagccgcggtgcgtgaagaagatagtccaccaagacgtccaggtctgccaaagcaggagtcatctttcccgtggggcggatgctgcggtacatcaagaaaggccaccccaagtacaggattggcagttgggggcacccgttgtacatggccgccgtcctggaatacctgacagcggagattctggagctggctggcaatgcagcgagagacaacagagaagggaccgggtcacaccccggacatcctgcttggcttgtggccaatgatgaagagctgaatcagctggctaaaaggagtcagcatagccagtgggggtgttgttacccaaaatacacccgagttgctagcgaagaagcggggatccaaggaaagttggaagccatcatcaaacgaccccagcaaaaaaggcagtctccatcccagaagaaagcctgtatctaaaaaaagcaggaggcaagaaagggggccggaaatccaaagaagcaggggtgaaggtcagtaagggcggcaagcgcgacaggaaacgagggcaaacttgcgagggttacagtccttttcacgaagagctttcttggcagaagttgacctaattcggggaaacaggaataagcggttgaggaggaggaaaataatctacatgtgatttgataagttaccagaaacgggaaaagggggagagtgggatgctgacg

SEQ ID NO: 629827 - DNA, 364 bp, Homo sapiens
tctataacagatgcagatgtagtacaggtagtacccccatcacctggcctaactaagagagaagggccagtagatgaggccacttggctggctgataacatagggcacaacatgacaaagctacaaaaagctaaccaaagtctaggtaagcttagcactcataaataagatcagtaaaacggtattctattcattatggaagtgatacagacaaacaacagaaaggtgcaatttgcaatagatggctacagtgtcagaatgaataacactctcaagaaaggatggcaagacagattgctgttccgcacatctctgctcctgataaacgtatatatcagtttacagcagcttctcccaaagatgc

SEQ ID NO: 629828 - DNA, 340 bp, Homo sapiens
  misc_feature (134)..(134): n is a, c, g, or t
  misc_feature (166)..(166): n is a, c, g, or t
  misc_feature (215)..(215): n is a, c, g, or t
  misc_feature (231)..(231): n is a, c, g, or t
  misc_feature (241)..(241): n is a, c, g, or t
  misc_feature (246)..(247): n is a, c, g, or t
  misc_feature (251)..(252): n is a, c, g, or t
  misc_feature (257)..(259): n is a, c, g, or t
  misc_feature (266)..(266): n is a, c, g, or t
  misc_feature (275)..(275): n is a, c, g, or t
  misc_feature (280)..(280): n is a, c, g, or t
  misc_feature (302)..(303): n is a, c, g, or t
  misc_feature (314)..(314): n is a, c, g, or t
  misc_feature (323)..(323): n is a, c, g, or t
aacaaccccggacaagacgctggaggaccgattctttgagcacgaggtaaagctgaacaagttggccttcctgaaccagttccactttggtgtcttctatgccttcgtgaagctcaaggagcaggagtgtcgcnacatcgtgtggatcgctgaatgtatcgcccancgccaccgcgccaaaatcgacaactacatccctatttctagcgtcctgncccaaggctctcaatngcactctttntgtgnngtgnntgtgnnngcgcgtntgtgtgcgngtgtntgatgtggtcttacaagcctgnngctcacctgcntgtccgggnttgttggaccaggctcg

SEQ ID NO: 629829 - DNA, 1122 bp, Homo sapiens
  misc_feature (161)..(161): n is a, c, g, or t
  misc_feature (580)..(580): n is a, c, g, or t
  misc_feature (602)..(602): n is a, c, g, or t
atggcggcttcgcgagagagcgggacttcaggctagcggaggcagcaccgaggaaacagtttatgaccttgcgtacagtgaggtgaagacaaatagagaagagagactcggttctaacttcgacaaaatcacgattgacagaggactgacctcgtcctggnatccgtcttacttcaatttgaacctcatttgaggttcgttgcaggataggatctctgaagttactaggagtgaaggaatatagataaaagatggtttcgtggaggtatatacagatctaggtgtcatgcatgatagaagaatacaaggatgatgcctgactaggagctacatacaatgagctgttgagaagcctgctggcacaaacgactctacagaggtctgcatacgtggagtcaggtagcacaaagaccgaggagccctggcattgtagatctcagggcacggtaaagatgcaatactctgtgacactactacgtgttgcacaggcagacgagaaaataagtaagttagacaggaaggcagaggcataatgcttaccaagtagtagcaggcatggcatgcatccgtggatcgtgtngcaaaaacaagcgtgtaatatngtaatagacaccatgaaaactcgtattgcaagcagttggtagcattataagagggaagagagaggagaaagtcgataagagaatgcattgagacagtgagaacggacgaagtggacagaaataagatccggaacgtcgtcgaagacaaacaggcaaagcgtgcaacagcaaaagtggggcaggacacaacttttggcgcgacaagacgcagactgggccgtgatgcgacccggcttgggcgacagccatcgcagagcgcaatgtaggaaaggcggaaccacaacagcagcagacacatcgggggacacctttcacggggacacaaccgggagaagggaaaacacctggtgggccaacagtggagatgtgacagcgccaacagtgtgtacagggcgcaccacgagcacattttcggcccgggaattaatgccgcacgccgacatgctagacggacgacacatctatatgctcccacgaaatcacgcccacgcagaagagaagcacagtatgagagatgcta

SEQ ID NO: 629830 - DNA, 176 bp, Homo sapiens
actcatagaggatccccatcaggcgaatacttcgcgtgtacgtggtccaggatatcagtgtgaagaatgagtaggaagggaagaggatacggagagtacggatgctgggatgagggaagcacttctggtaagactgaattcgggattttttataagagagggcatgagagtaatcg

SEQ ID NO: 629831 - DNA, 321 bp, Homo sapiens
  misc_feature (321)..(321): n is a, c, g, or t
gaggaaacagcctcctcactatctctacatggcaagggtagttatcgcttatcatattccaaatatgatacttaccaactattttcgtcatattcttcacagaaggaagatcgtgatgttgtgctcacaacaactcttgtggatgatatacaagctatgccaactacctatgatgagcgagaatattatgcctctctggcctatggaactcactacagtagctctgtgtctctaggaggactctatgaactaatatatgtatcggatacagctatcatgatgcggataggtgttgctactagacatacagagtgccttgcn

SEQ ID NO: 629832 - DNA, 1333 bp, Homo sapiens
  misc_feature (797)..(797): n is a, c, g, or t
atgtagcaacatttctttattccagtagctactgaagaacacattggttgctggtaagtgttggtgtattattctgttctcatgctgctaataaagacatacccaagactgggtaatttataaagggaaagaaaaaagagttttcttacacaattttaacattttaatattaaaatgaaataccattttttttttaatcccaactttagcagatcagtgaaggaacaaagaaacctactttgtttcctttccctcttatttcaatataatttatcaagaattgcctttcctaagaatacttaaaatttggactctttaagaggagaataggtaaactaaattagtgacagataatgtgtgttgacagagatcttttttaaactttgagtcatcctgtcatgaaacctaatccttttcagctatattttatttgcctactgactctatgtcaggaataactggagaacatgcatgcatgcaccacaagaatcttcagtatcgtcatagaaacactatccatcatgaaagccttagagaaaggtcttaatattgggcattctagtataactgttctgatcaacagcacatgtaaagcacaagtcatgtcgatcgcctcttacaatagatctacgccgcgagccctctccagcatgaatttctcggaagtccacaggaacaccgccaacctaggctttggacttcacctgtccctcctcaggtttccctactttacgacggttccccccgtcaaccttgctgacacccctgtcttcggtctctcctttcaatacgatctnactcgccatacacctctcgcgccgcttcccacacctatcgatgctctacagcctctcctgactactctcccatctcctcctcacctacttgcacccttgctttactccctctctcgtccctctatccccctctcttctacctctctccttctcttccacctctcgcccgcatcttgttccccgcttctttcactccgctctcttcgtactctctatcttcactccccttccttcttcttcatctgacctatatgcccacatgagccaccctctctctctagaccttcttctgtcgcctctcatactccatcctcttctgctcactatccctcttcaccctctccctctcttcgacactcatcaccccgtctgcctctgtacttcactccatgtccctcacgctcccactcttctcttctctgtttctctcttactctctcttctcgcatcgtctcctctcctacgcctctcctcatcttctcgactgctctacttcgttactcacgcctatctctctcaccctcttctcctccccc

SEQ ID NO: 629833 - DNA, 709 bp, Homo sapiens
  misc_feature (469)..(469): n is a, c, g, or t
cctcctgccagcctctctgttgttgttgtcctcttttgggtgcgtctccgctctcgtggttctctcctcctcgttcctctgcgtggccccctcccattgtgttgtctcccctcttgatgctgtgttttttctcagagggggccctccttctaacgggcgcccccctcttttgttctccacagtacatttccctcgtggaatccctgcagttatggagcccacgggtgggccttggccctctatggggtagccacacacgccctgggtccaatttttcacatgggacgcacagccccttgtttaagccacgctggcaaagtaatggataagaccacaacatggtgtgagtgaaatttttttatggggctcgaacaatcccctcgttaactcacagggccaatacacagaatggttcctaaccccagacttaggggtctaggcgagcgtagcgtacactactcttgtcccnagatgctgacccggtagccatccttcccaggatacatagcccctgggagattgtggccccacaccaccattttctgacattgctgtttgaaaaaacaacctggactagttaccagctgagtattttggcttttctcacagggccaagaataccaggccttctgctgaggtcactccccctttttacatgtctgcttaaggggaccacaaataaaggtattcgtatttttaaagattaata

SEQ ID NO: 629834 - DNA, 291 bp, Homo sapiens
taaaaaaaattaaaccccttttaaaaaaaaaaagaacacaggagattccagtctccttgagttagcataatacagaagtcccctctcctttaacttttccaaaaaaagtaccctgacctaatctgatgttaaccaaggtatttatttctggggttctgtttccttgttccaatttgacaaaaccccctgttcttgtattgtattgcccagggggagctatccctgtacttgtagaggggggctgctttaattcataaatcccaaataaaagccaattagctttattcctta

SEQ ID NO: 629835 - DNA, 103 bp, Homo sapiens
atgaggtctacacatgggctcttctctgtctacctcagcgccgataccagagtggcagcgtggtgatctttggtggcattgactcttcttactacactggaag

SEQ ID NO: 629836 - DNA, 245 bp, Homo sapiens
  misc_feature (93)..(93): n is a, c, g, or t
atctggggtgatacaggacagggagcatcattcctgcctgggaatctggaagacttcctgcaggagtcagcgttcaatcttcaccttgaagantggaaggatgttctttttacgtaccaattcttttgtctttcgatattaaagaagaagtacatgttcattgtagagaatttggaaactgtagaagagaatcaagaagaaaaataaaaatcagctgttgtaatcaccaccagaatcaccaccag

SEQ ID NO: 629837 - DNA, 196 bp, Homo sapiens
  misc_feature (70)..(70): n is a, c, g, or t
ctgcgctggtccttcccctttgtctgttttgtttatttttgtctttttttacgacgactgacggtcttgnctcggtaccgctggaccggactggactgactccacgttccctacccgtcctgacgctcccgaccgtacctgggacttcccctacgtgacgcccggggactcctctacgacgtcgaccctgcacggc

SEQ ID NO: 629838 - DNA, 300 bp, Homo sapiens
  misc_feature (3)..(5): n is a, c, g, or t
  misc_feature (27)..(27): n is a, c, g, or t
  misc_feature (49)..(49): n is a, c, g, or t
  misc_feature (52)..(52): n is a, c, g, or t
  misc_feature (62)..(62): n is a, c, g, or t
  misc_feature (70)..(70): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (96)..(96): n is a, c, g, or t
  misc_feature (152)..(152): n is a, c, g, or t
  misc_feature (176)..(176): n is a, c, g, or t
  misc_feature (182)..(182): n is a, c, g, or t
  misc_feature (186)..(186): n is a, c, g, or t
  misc_feature (225)..(227): n is a, c, g, or t
  misc_feature (230)..(230): n is a, c, g, or t
  misc_feature (233)..(233): n is a, c, g, or t
  misc_feature (259)..(259): n is a, c, g, or t
  misc_feature (286)..(286): n is a, c, g, or t
  misc_feature (290)..(290): n is a, c, g, or t
tcnnngggtgacacccatggcttctanaaccactgttgtgctgataacnccnaaaatccatntccacaanctgagtncncnttttgtggtgccagncctgtatattcaactgtctagtggacattccatcattgagaggcacatagcatatngaaaagtggttaacagtaaggatnctcatnaggnatggtgctcacgcctgtaatcccagcaccgtgggtggtnnntgnctnaggcaggcagatcactggagcccaantttgagaccagctgggcaacattgtcnagcnccgtctctac

SEQ ID NO: 629839 - DNA, 182 bp, Homo sapiens
gcggccgcctactactactactgctcgaattcaagcttctaacggtacggggacatgcttgtaatcccatctactcaggagaatctcttgaacccgggaggcagaggttgcagtgagccaagattgcgccattgcactccagtctgggtaacaagagcaaaactacatctcaaagaaaaaaa

SEQ ID NO: 629840 - DNA, 311 bp, Homo sapiens
cgacaccccaatatcttacatctcaatgtcccatcctagggaagcactcatactttatgcatccccgcagctacacacggacaacacacagcacacgcatgaacacagcacacacacgagcacagcacacacacgagcatacagcacacacacaaacgcacagcacacacagaacacagatgagcacacagcacacacacggggcgcacagcacacacacgcacacacatccacacacagcacacaaacgcacggaacacacaagcacacacatgcacacacagcacacacgcaaacgcacagcacacaca

SEQ ID NO: 629841 - DNA, 492 bp, Homo sapiens
gtggtgtggtgggcgcctgcaatcccagctacttgggaggccgaggcaggagaattgcttgaatctggaagacagaggttgcagtgaggtgagaccatgccattgcactccagcctgggcaacagaatgagatgctgtctcaaaaaaaaaaaaattgccattctacagtgtatatatagtgtacatatttcaaaacatcatgttgtataccgtaaatgtctacaattttttgtttttacttgtcactctaaggacagtggctgaggattaccctttcccacttattggacaatcactgactaaaattttaggtcctagtgcacctgtattaaactttagagctatgctgtccggtatagccactagccacatgtgactattgagattcagtttaaattaaatttgcttagttacactgccacatttcaagtgctcaatcgctaaatgtgactagcgactgccataccagacagtgacgtcctatgcaaggat

SEQ ID NO: 629842 - DNA, 808 bp, Homo sapiens
  misc_feature (142)..(142): n is a, c, g, or t
  misc_feature (350)..(350): n is a, c, g, or t
  misc_feature (563)..(563): n is a, c, g, or t
  misc_feature (581)..(581): n is a, c, g, or t
caccccactctcctttagtaaatgttgagaaaatgcctttgttgtcatgctccaaatcccacactataatggccctattcacttctaagggcccaatttttcctttctcagtggttattatgttaacatcagaaaaggatgnccgtgcttgaggaggaagaatgggttcaagatcatcatattcatcagaaggggacactaaatagaacccttaacctgttgacttgccaaaattgagaatcagagatgtgtaaaatgcagcaaattaattataatgtaagttaagatttgctttttgccaagttgcaaagttgtatccacatcaggtcactgtaaaaatgtattatctngtaaaacttatgtaaaaaaaaaaaaaaaaaaaagggcaaagatccttaaaaaattttaagtcttcccgacttttatttttctccttacaagtgtgttttagaaaatgtgcttctctgtgggaattggcataattatttattctgtggctccttgtgggaaaccggttattgtgaaaaacacgtggcttaggtggatatttaacagctttttangcaaaccttccctcacangcgcggattgagaggattaaaaataccaactaattttgggtacccctattaggtgcctagaagcagtcccaaggtgctaaataaattattttacctgatttaaaacccaaactatagctactcgggaggctggaggaggactcgtttgagcccaggattttggaggccattctgggcaatatagcaagaaccctgttgtccgaaaaaaaaaaacaaacaacaacagg

SEQ ID NO: 629843 - DNA, 244 bp, Homo sapiens
gcgtcccagcaaggaaggtaccggctctactgccacctcttccagctccaccgccggcggacaggggaaaggcaaaggcaaaggcggctcgggagattcagccgttaagcaagttcagatagatggccttttggtattaaagataatcaaacattatcaagaggagggacaaggaacttaggttgttcagggggtcttttggtctgtttagagatcgcttaattaccactcttcttcctcagca

SEQ ID NO: 629844 - DNA, 519 bp, Homo sapiens
tgattccagggtgaagcacttgagtatgatggataagcttttcaatgtgctgctggattcagtttgccagaattttattaaggagtttaccttgatgtcatcaggatatgaactgaagttttctttttttgttgagtctctgccaagtttcggtattaggatgatgctggccttacaaaatgagtaagggagacatcccttttcttcaattgtttggaatagtttcagaaggaatggtaccatctcctctttatacctctggtaaaattcagctgtagatctgtctggttctgggctttttttttttttttttcaatgggcgggctatttatcagggcctcaattccaaaactggtaatgggtctttccagcgattaagcttcttcggggttaagtctgggaagggtgtaggtgtccatgaatttactccattaatttttaatttcctagtacattggcatagaggtgtaatagtatcctcggatagtggtcggcatccggggcagggatatcccctta

SEQ ID NO: 629845 - DNA, 871 bp, Homo sapiens
agcgggtgtgcgtcgacgtcagcgtgctgacgtcacgggccggaggtccggggctgctgggtgcgggcggtgggctgcgcgtgtcgctggactgggtcccggtcacgccccgacaagccccgccctcagccgtgggcgcgaccgggatccacgcagttcccgggcagctgggcggcggcaggaaacacccgttaaggtgtattcgtctttacggatggtgaggttggaaagaaggcatcctgtatagccgtcctccaggatgaaggaaactgccagaagacatggagaacagctctcaccagggagccagagctcccatgcttctctgtgcgaatatccattccatcaatcccacagaactcatgggcaggattgagtcctatgaaggaagggacaaagaaaggcgtatctgatgtcaggaggacatttactgtggtgtgttgtcagctttgagcgtcttattcgtaagcattactgtggataatagagttaaatgtgaatggaggcacttgagaacacattagagaaggaggtgatgcagtatgactacatatacttcatatttgagtatatttcttctggcagggtttcgatttaaagtgttaatacttgcatatgcctgtgtgcagactgcgccattgggggggcaaatagcgttgacaccggcagtgaccagatgctttttactagcaaaagtgatcctttcgaagctttttctctcacaggggcattagggataatgtgctggcccatccatttcatttaattccttggcctggattgagaacgtggatccctggatttccaaagtggtacctccagaagcagaaaagaaaaagaaacctggaaggtcaggatgctttcgaaaggc

SEQ ID NO: 629846 - DNA, 428 bp, Homo sapiens
  misc_feature (74)..(74): n is a, c, g, or t
gagattttctgcagaaattgagttccagcctctctcgaacctgggaagacctggcaggaggggctgttttcggngcccaagctttcaccccccccgtaggatctgagcgccatccatcttgacacggcagtgctgttggtttcctgagtgtacgcaggtcctcccaggttcggtgtgctccgagcgcgcttggcctaatgccctggcctgtgaagtggggactcctgggccctgtgagcccctagaaggcaggcccaggaatgttcgggtaggacagggaactcctttgccccgggtctgagttttgcctaggtgaaaccccctaggacacagatgggtccctcctcctcaggagtgcatgccagtcccccgttgcaggacagggtgatcatgcccataaataacccttcccgtgtctaaaaaaaaaa

SEQ ID NO: 629847 - DNA, 736 bp, Homo sapiens
  misc_feature (14)..(14): n is a, c, g, or t
cctggtacggtcgnctaggcgtgttacgtggagggaacggattactcttactttgttctaagacgccataggaagagtcttccttgtccgtggctgtaactatataagaactattgtgtcacataaaccaacaagaatgaacctttgctgcttcagataagtttgattattccagacaaggaaattaataagtaactgattctatcaggcgatagaaacaactgagaagaacttaagtgcaactgtttcttcactagcaaaagccaatcccttcatttctgtttcattgctccaaaacccagtttttcaactaatggtttactcattaaactaacatgtctacgaaaagttgtatagagtaagactatatttctttatacatagtcctcctgataccagtataagactatttagtaacagtgcattatgtatggtactatctaaaagtaagttagataagatgtaagagaatcgggtagctgccggaacaaacattaggtattattcctaaattagggtaacaggggaaattgaccaccaacaatcatattaaagcaaatagcatgtactattaagccttattcagaggggtcacagggcgttaaaaggaaaactggatggcaatcctaagggacctagcttagaccccagggaaaaatgcgatatattaagcataccataatgtcccctaacaagttcacaaaaatatgtacaatggatacataaggaaccacag

SEQ ID NO: 629848 - DNA, 883 bp, Homo sapiens
gggtctctctcatagaggggagctgcagctgagaacgtggcgagggcccttcctccaaggtccctagactggctccccgggtgaacctgaggtggcatggttcaggttatcaagatggtgaggtctcgcatgtctgctggacagtgacattaggctctcagaactcatgggtgtggagctgggcctgtccctgggccagttgagccctgctgtgtggccgtgagattaggcggtgctgtgaggcctggttatgcactggcaggatgtgaccttgatttggatccagactcatgtaatccatataaccactgtgaggtctggagagatggagaaagagactagggagggggacccgaacatccattcaagcaccgacgatactgccaccgtaagcttgatcgccattataacccattgaatggacctgtggccagacatgaacttcggccactgaacatgaaggacatcccacttagcaagggacaacgacaccttggaggatagctgaagcttctggagcccgatcgtcattcatatttcacccattcttgcgattgggcgaaacaggctgtggcgcattttatccacatcagaagcaacccattggcttccacaccacgggacccacgaagaagggaacatccccgaaactgatatgaatggaagggccatcaacgaatatcggacacccaaagaccggattgtgtcccctttgggggcgaaaacccggcaaaaacggcaaagcgccatggcaataaagaccatcgtgtgaattgcctagtcacaaggggcacaagatgaacgcagcaccaagagagccaaaaaacagaaaacgtcgcacacacgcaggaaaacaaggagcacaaacggaagaaagcagaaa

SEQ ID NO: 629849 - DNA, 344 bp, Homo sapiens
cgagtaatgcgaatgtgtttagaagtggaacttatagggtattaaccggggtaatgcctgttggggccatgtgccctcataattggggggtagggtctagcctgaagtggtaaaaggctcagaaaaatcttgcgtgaacagttggtgtgtggtgcccttggtatgtgctttctcgtgttacatggcgccatcattggtatatggttagtgtgttggttagtaggcatagtatgagagagcgttatgaagtgaaagtgatatcacatggatagcccggaggtcattaggaggtctgagagggcccctgttaggggtcatggtctgggtttcactatatgatagcc

SEQ ID NO: 629850 - DNA, 208 bp, Homo sapiens
ctagaggatcctgatatgtgttcactggcatttttttgaatggattggtgacattttttacatggatatgttaaattttatatatgggttaaagtatattaaagttaattttacctggttcttttactttttcttttttttcaaaaaaagtaagggcaggtggagcagctcagtcctgtagtcccagcactctgcggggccaagggga

SEQ ID NO: 629851 - DNA, 216 bp, Homo sapiens
gaccgcagtctgtgacaatgcctgccactgagaccaaaaaggtcagccatgtggctgatacaagaggtcaatacgaagaggctcgaggagactgagggctgcaccctcgtcaggccccagacagatgaaccgtgagccgtgcgagtgcagcgtgcccagatctcagagagaatcacggatactccggcccaagtgtcaaacgccaacgaacagccc

SEQ ID NO: 629852 - DNA, 206 bp, Homo sapiens
gctcgacattttcttttattctcttgtagttcctaatcctttaaaatgagtagtgaatttaggtaaaccttcatagttaaattagaaataattgtatgtacatgattaccctgaaaacatttgggagtaaaataaaatgtattagagaagcactaaaagattacggaagaccttttcttttttcttttgttcctcccccgtcgacg

SEQ ID NO: 629853 - DNA, 302 bp, Homo sapiens
  misc_feature (184)..(184): n is a, c, g, or t
atccccgctgcgtacgcgacggcgccaggggatggcagacagtgccatgcacggagtttaggcacacgatgtggccattctgcagctccagcatacagttgctacgaaagccttgagtggtccacgaactggacccaggggtgttgattgtcgttgggacttgagagagggcatcatcatcacntgtccattaacgctcttcccatgtgaccactggtgcgccttgttcacctacggatggtgtatgtcaccctaccttctcccgggacggcctctgggcgctctggtacacctccttcccg

SEQ ID NO: 629854 - DNA, 705 bp, Homo sapiens
catgagtgcctgcgcaatgtcggtgcgctgtaggaggataccagggcgtcttcccgcggattgtgcagcggttccttggtgaccgcgtgctgtccactgctaggtcgcatccccagtacttgactcgtcatcatatctcagctgcgacacgatctatcccaagacctattatgactcactcacaactcgtagaccaaggctggattgactgttgcaatcgcttgaacgaactcttgagacacccatttcataacagaaacagaatcgtacaatacatttactacaggggttgacaatatgtgagtctctcaccttctgctgaaactgcattctctcgaacatcagagaaacagctagactatacgtacctaacattttttcggcacgcaacaaaaacagcattgtaagactcgttatcatttcgtaaccgtagccctttgacgtatgtaccctaatgtacaactgtataagtggcaactacaccgctttaagggtaacgttgcttggctccatgaagccccgagttggccacacagctttattcctgttcaggcaccagcattgaaccgtactatggttggccaggtctttgattaagggaatcttgattgaaatcttttcaccccccaaactaccctacaaatccttactgcatcatctaatagcatgtggtgaattgtcttgtacagcctaaccgggaccaaa

SEQ ID NO: 629855 - DNA, 813 bp, Homo sapiens
tccccggaattctgccattatagcccggggtagcccatatttttccacgaagtaggggcgggccgatatcatccccatcacacatactagatctgtacactatctgacataaatctatccaccctaaaaaccttactaaactcctcctacatctaaaagctcagcctattataatgacagtcccaggaatctaggtacttaccaatcgccctcttacgtattaactggagggggcgataagaaactacgatggtccgacatcactcgagagctattatgcatggtatcattctgtcaaacttaccctaaattactttactacaagtatgactcaccctcaatatagtctaccgtcatgatcgcatactgggatctattagttctctttgcctaatgaatcttctaccacgtcctttcatgtgaagaatatcaatagctaccctttaccaactgtaaacttatataagaaatatttaaaaatttacatacccaaccaagtcccagattagaaaagataaataatacgcaaaatacaattacaatactttaagctattgataacctaatatgtcctaatactatattctctaaattttttgttttactcagtactacaagttatactgtaatcttctatatagcacaatagcgttgatctctacttctcagtatggttctacttagtaatataataaatcacaccttcaagaaagatgaactattagatattaagatacagagatatattgattatgattctccagccaacaatactgcactacttatctttttgcctcgccatcatccttcaag

SEQ ID NO: 629856 - DNA, 716 bp, Homo sapiens
tatcatgcagctgcatgtcagaagagccagaaaggcggggtcctcagaaaatggagcttctttaaacaactcttttaactcctgatcagacatgactgcgagggcgagtaagaagcaaggacacaaaacgaagaaagaaagccagggtacacgaaacagatcagacacacgaggaaagacgacacacagcagacaaagaaacaaaaaaaaaaaaaaacacaaacaacagcaaacagcgaaaaagaacgagacacaaaaaagaaaaaacaaaaaccaaaagaaaaaaacacaaaagaaagaagaaaagacaaaacagaaaaaaaaagcaaaaacaaaaaaaaagaggaaaaagaccacagcaagaaagagcaagagacgaaagaaaagaggaaaacaaactaagaaagaaaaagaacacaaaagagagggacacaacagaataacaagacaacacaacaaagaacacaagaagaacagaagacaaagaaaacaagaacaacacaaaaagaacaagagacaaccacaagaacagaaagaaaaaacaagaaaagcacgaacacaacacacaaagaaaaaagacacgcagaagagaagacgaacgaacaaaaacaataaacacgaacacgacaagcagacagaaatagacacacaacacacgacagagagacacaaaaagagaacagaacgcaacaagcacgaacaacaaagaaagagat

SEQ ID NO: 629857 - DNA, 360 bp, Homo sapiens
tgagatggagtttcactcttgttgcccaggttggagtgcagtggcacgatctcggctcacccaccgcaacctccacctcccaggttcaagtgattctcctgcctcagcctcccaagtgactgggattgcaggcatgcaccaccacgcccggctaatgttatatttttagtagagacagggtttcaccctgttggccaggctggtctcaaagtcctgacctcaagtgatccacctgcttcggcctctcaaagtgctggaattacaggcatgagtcacagtgcccagccgcaaagtatatttttgtaaaatttcatcaagataaatctggctaaaccaataaactaataataacaaaacttg

SEQ ID NO: 629858 - DNA, 196 bp, Homo sapiens
gttgacgtccactggggctctcaaatttagtcttcaaaacaaaaatattgcatttttcccccagttcattcttcattttagtaagaacaaccttactctcctgtcaattgatcatgtcgaaatgtctttcctttttttcagtcacctgattaagtcctgcggtcaacttgtcgatatacgcccgagatccgtcgcg

SEQ ID NO: 629859 - DNA, 249 bp, Homo sapiens
  misc_feature (136)..(136): n is a, c, g, or t
  misc_feature (146)..(146): n is a, c, g, or t
  misc_feature (165)..(165): n is a, c, g, or t
  misc_feature (215)..(215): n is a, c, g, or t
ggcacgagaatttattctaggttgcccagttttgtggcatatggttgctcacattagtctcttgtaatctttttcatttctgtggcatctgttgtactgtcacctatttaatttatgattttagtatttgagattnctcttttttncttaatatagctgtgagtnttaaaatttttattgatctttaaaaaaaacaaactcattgtttttttccnttttttttctgggtcttattctgcttatctctgc

SEQ ID NO: 629860 - DNA, 315 bp, Homo sapiens
agaatatgcctgcgccatctcagtacccaacttcaggtatatagaactcctacgtgaaggacaaaacatacaaactgcttagtggctaggacatagatggctacacacctataaatactcttaagtactgaccacctctccccatactactcacctaaacgactccaaaacattacagacctggtctgactgaatcactgggacggagaccagatgacactagtagtagcagtacactgagagctggtagtaaactactcaggaatcaggccggacgcgggctattataaactactggtggcttgcagtcagccc

SEQ ID NO: 629861 - DNA, 342 bp, Homo sapiens
ggttcgacccgacataaacataaaaatgtaacaccagccaagccttcactacgccccattgttttcttttcatcagaagcgcgtgggtttccacacaccctatcccagcggcccttttatgctttatcatataaagcacagaaacgaagttatatatcaaggccccaacaaatgttattccactcaaatttctatacagtgtcacattgaaagggccggtgataacgggagcgattttcacacccacactatcaagaccgctcatcacaggacctataaaaaaatccaacaccttagtcagggacggaaaatagaccccacaaaccgcataaaaagtcgacg

SEQ ID NO: 629862 - DNA, 1108 bp, Homo sapiens
  misc_feature (405)..(405): n is a, c, g, or t
gctaagacccgtgtgcagacagcggcggcggcggtagatggcggtggcggtcggcggcagtcgggctcaggagtgcagactggttgggctcgacgagcgcagcggaccgggcgtcgacgttcacgtgctgttcgacgcgagttgggaatcggaacgctcgtcttaagagatggcagtatcgacttgggactgtcgtagcacgaggaggatgcgagggagccttcagcgcagcgcttgcccgagatgctagtagctccagtcgattcactgtacaggagatgcgctttcgtggctgcgtgcaacagtgcgcggccagtgtgagagagtcgctccgagactgatcataccattcgcaacagactggtcaaaagctgcggtctcatcgactcatagggttgccagtcnttggattcgcgttacttagagccatcttgtactgtggacatgaacactactgcaagggatactcgtgtcgcgcggtacaatcctcaattaactatggggcattggtcctcctagattgataccatacatatgtggaatcggaccttaaccataggctgattaggccatccagagggatgcgcgtacgcatatttcacctgcgtctcagtgcactacgccgtggtgcagcgttaccgtaggagcgaccattgtgatctccctctgaagaggcagtacgctgtgtgcgaaaggtagacttggacgccacgacacgtgaccggactcgtgcgcacgacacgacgaattccttgaatcaaacgggtggctaggtctagcccaattgaccagcgacggcaggccacgcatggtatggcaaatacaaagtggccaatgtgacaaaaacttaaactgggacttccgccatgagatctgggcagcggtaggtatgggcgagcaagttgaatctcgtctagaaagccctgacaggaaaggacacacgcattctcccggaaggccatggggccctgggactactggagcccgtggtcccgtaaaggcatgggaacttccgtaccttaccaacaaattttaatgtctggacggcttttcactttttgggattatacacccaagacacacctcacatactgttcgggggagccac

SEQ ID NO: 629863 - DNA, 557 bp, Homo sapiens
gcaggcggcaagatggcagtgcaagattatccaagaagaggaagtatgtcagcgtagagtggcatctttcaatagactgagactgaatgagattctcatttagctctgctgatgctggctgaagatgagcttatgtcgtggaagatggaggtgtggaggttaacacacaaggcaggagacatgaaagtcaattatcattagctcgacgcagaaggacagaagtgtacttgagtgatgatagggcctgggggtgattgtcggggaatgtggatgatgatagttcataaagaggtattggcttgcctagagggaaatgtccgtagcatgactctataattgcgttccatagcaacgtggtgccaagtaggacgagtccttgtcgatgcctcatgtggcccacaaaggctatgaagtcctctagacagtcttagcgaataacttctctaatgggtagcgggtcttatggcctcgtccgtcgggggccgaggggccttaggcaataaaagggctcggtgactggacggagatcgctagtcctagtggccgagaaaggattg

SEQ ID NO: 629864 - DNA, 359 bp, Homo sapiens
gcacgaggagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatagacttt

SEQ ID NO: 629865 - DNA, 483 bp, Homo sapiens
  misc_feature (215)..(215): n is a, c, g, or t
agcacctttgggaggctgagttgggaagaaattaattagcttgaggccagggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagcccntggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgc

SEQ ID NO: 629866 - DNA, 233 bp, Homo sapiens
gtcctacagacatcgtgttactcgcatccggagtatcactcaccttacgctcaccatagtctaatagaaaacaacgcgaaagcagatatattcacgcactggttattacaattttactgggtctctattttaccctcctacaagcctcagagtacttcgagtctcccttcaccattaccgacggcttctacaggtttcgtcggtcagggtaccgacggctctgaattcgtaat

SEQ ID NO: 629867 - DNA, 420 bp, Homo sapiens
  misc_feature (130)..(130): n is a, c, g, or t
  misc_feature (160)..(160): n is a, c, g, or t
  misc_feature (186)..(186): n is a, c, g, or t
  misc_feature (196)..(196): n is a, c, g, or t
  misc_feature (213)..(213): n is a, c, g, or t
  misc_feature (230)..(230): n is a, c, g, or t
  misc_feature (237)..(237): n is a, c, g, or t
  misc_feature (309)..(309): n is a, c, g, or t
  misc_feature (320)..(320): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (382)..(382): n is a, c, g, or t
  misc_feature (407)..(407): n is a, c, g, or t
aaccgaagatcagccctcggggacctcgccggggacaactcccttggccttgggccatttcgaacttcggggatctcaccttttcctcaggttggggggctccctccgggaaccggggaaatcaaccttnccgtaacaaaagaatggttttttttttccngttttggcctcctcagtgccctcccnctttggtacntgatcttcggggccccngctagcttgaattctantggggtngaatggttttgaagaagaaaaaacctgctttttgactgattttcccttgaaggaaaaaagaacctttttttntgcatcatttnccaatctttccccccaagcatttttttttngnacnttttattttttcataaaattgctaatnccaaagcttttttttaaaagaaatnattttttaattta

SEQ ID NO: 629868 - DNA, 640 bp, Homo sapiens
gattcggagctgcaggatccgtccgagatggcagaggtggaggaaacactcaagaggcttcagagccagaaaggagtgcagggcatcatcgtggtgaacacagaaggcattcccatcaagagcacaatggacaatcccaccactacacagtatgccaacctcatgcacaacttcatcttgaaggcgcggagcactgtgcgtgagattgacccccaaaacgacctaaccttccttcgaattcgctccaagaaaaatgaaattatggtggcaccagataaagactatttcctgattgtgatccagaatccaactgaataagccactgtctgggcttcctgtgtcattccttaatttaatgtcccccaagaataatagtgctaatcatgtcagtgggcacgtggtggccacctgagcctgtgtagaccatgccattgatcaagggtcgctctgcccaccccacaaggagtgcctctgatccagtcagcccctggggaatcagttcgcccttgcaggctttggaatgagagcttatgataagcccacacccagctcttcaaactttcagttcaccttgtccacccctttggaaaaagcctgttttatgtttttttaaaggttaaaaaaattactttcaaccccc

SEQ ID NO: 629869 - DNA, 277 bp, Homo sapiens
ttttgggccccccccccccccccccaaaaaaaaaatttaaatccccctgggccggtttttatttttggcaaacccgggcccaaagggctggggggggctttttttccccctctccccaaaaacccccctttttttgggaaatttttggggggggaaggaatagggccttttttttctccccaaaagtttatttttaccccccaaatttttgtaccaaaaaacccttgattttttttttttttttttggggaaaaaaacccctttgggggggttccca

SEQ ID NO: 629870 - DNA, 146 bp, Homo sapiens
  misc_feature (23)..(23): n is a, c, g, or t
ggacctggcccacgccaattggnatcctgcctatccagccccctccgccgccagcaacaatagcaacagcctgaatgtcaataacggggttccggcgggcggccgcgcactcctcagccaccgtcgcagctgcctccgccaccacc

SEQ ID NO: 629871 - DNA, 766 bp, Homo sapiens
tggtcgcgctttgcctccgtccttccccctactcccgtcttacctgacttcctttacggaggaagatccttgaagcagccggacgttgggacaaaggatttggataaacccagggctaaagtcgacgtgtatcctacctttaagacttagcctacaatcatgttcactcgcatggtcagttcccgatacccgccctaaccacactatttatagtcaatcaacctcaattgagaagatcaatgaagggatgagtctagacaaaatgtccctgtactgccatcttctcccaggtattggcgcaagatcctggatatcctggtatcactggagcctgaagattatgggccattgtctttgtcatcttcaaggaggtctagcagcgccacgcaatgactcctgtcgctaccattgcagggttctcccgtttctatgacacaatcctatgcgtaatccagtatgccatgatacgacctcacgatatcattgccaatgatgtagaggcaccttcgtgtgagcgggaccggcatgcgggagaagagtgaagcccaacgaagccatggagatccccggtgcactcaaaggaactgcttgtgcacagggcgtgcgggaatgtcacccccccgtggttgggggcatcgtccagggtgcctgttcacggggtcattgccgcctgatgtcctcagtgcgcccgtctattatgtcccgacatggccgggacatgtcgccgcttaatttccttgcctgcttttctacgccgaccatgctt

SEQ ID NO: 629872 - DNA, 80 bp, Homo sapiens
gccgtgtattactgtgcgaagtatcggactgcccgcagctcgtcctactactttgactactggggccaaggaaccctggt

SEQ ID NO: 629873 - DNA, 674 bp, Homo sapiens
accagcggtggtggctaagcagagactgtatgtagcggcgacagcgactgatggcagcgatggctggggcggggccagcccctgggactcccgggtgcaggaggacccgtggtcccagtggtcctggctgctggcatcccgtggcaaagagcagtgctgatggagacgcttgagagggaaagtgtgaggcgtgagattgtgcccctgttttgagtcacgagaatgttctggtgtggctccagtacctgggaatcccaagctgcatgtgcgcttgcggttgcccacatgtcccacactggtcccgcacatgtagatagcgatgacagggtcccagtcggctcctgtgatcctgcccgatcttatcgcgaccagacagcgataccagcaggtccagtcggactctggaggcccgagcgatgctgctgcagcgcacagtagttcctcccattggtgtggtggccctccttttgtaggccctgttggctttgggcctggtgatctggagtcacctggaacaggccagaggctcgagaagcatgttcctgcggcgggcagctgtggccccccagagggcccctatctgcgtcagccttcgtcccccacgtgctacagagagcagattccgctctctcctctgcagccgccgggcctcgccggatgctcttcggacccaa

SEQ ID NO: 629874 - DNA, 348 bp, Homo sapiens
agctgtgctatccgaggaaatcattggtcactaatgtggtgtttatggcgtggagtgacatgccaccgggaaatggctcatgttcatctgaggatgctgtcctctgatttagctgctgcctccagccgtctggcttgagaacttagcgtaaaggcagcttcgttcctgttaaaccccgtgtacactctccataaatttggtgattctctgctaggcctaagattttgagttaacttctcttgaagccaaactccaccttctgtgctttttgcttgggataatggagtttttctttagaaacagcgccaagaatgacaagaaattaaaaaaaaaagaaagaaaacaaaa

SEQ ID NO: 629875 - DNA, 129 bp, Homo sapiens
gatgattcagaaaaaaatgtagtgtgttccatttataattaaggcatatggcatcatcataacgataggaagccacaatgttcttggcccatcatgcacatttgtctatgcattaactgtgagctattg

SEQ ID NO: 629876 - DNA, 728 bp, Homo sapiens
agcggagtaaaaataggttctgaaacatgttgctatgccagagtgcaagaatgcttaaaagtgatgaagtggccgggcctgtaatcccagcactttgggaggccgaggcaggcggatcacgagatcaggagttcaagaccagcctggccaacatggtgaaaccctgtctgtactaaaaatacaaaaattagctgagtgtggtggtgtgcgcctgtaatcccagctactggggaggctgaggcaggagaatggcttgaacctaggaggcagaggttgcagtgacccgagatcatgccactgcactccagcctgggtgacaagcaagactccgtctcaaaaaaaaaaaaaaaaagtgatgaggttatgttaaaagggatacagtaggcaacttgaaagggactcccacgggctaaatcagagaaaacgtgtcaaaaaaaaaccagtattagtaacgggataggggtccattgaatagggaatttacgagttcatactggatataattttaaaaagcaaaagatgccgggtgcggtggctcatgcctgtaatcccagcacttggggaggccaaggccggtggatcacctaaggtggggagtttggaggccagtttgaccaacatggagaaaccccatctctactaaaaatccaaaattagccaggcgtgggtggcacatgcctgtaatcccagctactcagggaggctgaagcaggagaatcacttgaaca

SEQ ID NO: 629877 - DNA, 1670 bp, Homo sapiens
  misc_feature (443)..(443): n is a, c, g, or t
ggtgccctgagccctgtgctgggccctttaagtgtgcctgtgggtgctggtgtagctgtgtgccctgccccctccccgcggctgccctgcatgtcctgttaatgtgctgatgcccctggctgcatgtggtgcctgtgatcttggcctgtgtggtgcctgtgctgtgctgtgtgtgtggatgctggctgctgtcagtgtacaccagtcaccaatggtgtgcccaggcaatgcattggtctgctgcaggccgcccgtgcactatgtgtccacactgcagagcatgcaggtgttgtgatgtgtgcctgtgcgtctgggcggatgctccttgacaattgcctgtgcatgccacgctgcctgacctgaacctctgcaagtccaccactgctgtgagcgcaagccctttttgctgcatgccctgcctgtgtgagctccattgtggcccnccttggtctgatggtccatgggggccaatgtgcctttggttgttacagacttctgttgttgagatttgtgcctgggctgtgggcccgccacttcacagctgatcacacacaagtaccgtttctggaggtgtggaccccaggtgaggaaacccttagcgagcatggttgtggccccaactggatgtgcatggacatttgttcacagccatatttgtttggtcgctgagaggccacttggtgaccatcgccaaagtggttgccaaacaaggcaaatggccttgggaatagtggtttggtgcccccgagggccatggtggttggattgtgggcgtgggtgccccaaattgtgtccctttgattgcacaggtagcctggtctgtgtcatgcatgtggaacagcctcccaaagatcccccctggaggcttttgacagcgaaaaccattttcttgtttggccccccagtttatggagcccttaagagactggaaagtcggcgttgggggctgccagcgcaagggtttccacttgtgggcctgcacgaaattccaaccaagggcgttgggttatccgctatagtttgggggctttgactttggtgacagagggggtgacaggccataggcttaaccaatcggtggatcacggacaccgttggttccgccctaagtggcacgcaactgaacaatggcagtttgtgggactggctcgctttggcaccgaagtcccacacgttgtccggccttttggttttggggagttggccccgaggccagacacccttagagaagtttggccagggcagcatttttggtgacctttcttggcgaccacgttgttatcttttcccctttttggaccactgggattagtccccaaaaccactgcggtttggcccgatttgggcccaaatggttgccctgacgccccgtgtgctttaaagcataaaagggacgattggctcacctttgtggcgccatgtggagaccaaggagccacatgaccccctttgtgggtatgggatgagagaggacgagccaacggggtacgcacgcagtgcggaggactgcgtctcactcatggagatgcgaaagcacggaagcactgacacacgcaagcgagcgctaccctatgtcatacgctgcggtctaagcgtaacgtctggctagttcgactacgtctgacgcgaaggaagtgacatgcagcgcatgccatgtcggcatgcacgcg

SEQ ID NO: 629878 - DNA, 260 bp, Homo sapiens
cttaggtacaagagaagtacaaaaggccagaaactcaaagctgagggttagcgtaacaaacctacagactgaacagtacgaccctctctcaggtacctttacgtaccccacggcccagtgtgcacatacccccaggcaggagacgggagggcacttctctggtgaagcagtgcagccccatgtgcaggcaagggacggcgtgtcactttcattcagcatcggggtgtcacctagcaaaatagccaggacctcaccaaatc

SEQ ID NO: 629879 - DNA, 147 bp, Homo sapiens
  misc_feature (6)..(6): n is a, c, g, or t
gtgcantggcttctaagtgttcaaggggaatggaagaatcatatgtctctactgaaatcaaaagctagaaatgattaagcttagtgaggaaggcatgtcaaaagtcaagacaagctgaaagctaggcctcgtaagccaaatagccaa

SEQ ID NO: 629880 - DNA, 307 bp, Homo sapiens
tggatattaggcattgagagttttataatttatatttcttttaatattgttgggctttgttttaggacacagtgaagttacttggaatcagtttgtttcttttgaagctaatttttaagcttttatagggcatgttcagaacctttctactaaggcaatgtccttctagattctacttgattcctcttacatgtggagatctttctactctgactgattgaaatgtagaatcttcccaatcctattttcaattccaaggattgttgtacttattccttttctttcttgtagttctttcctcagcttc

SEQ ID NO: 629881 - DNA, 138 bp, Homo sapiens
ctggggcggtctagaggatcccaacaagtcagttcttctacgctaggatcggaagtcatccggggtggccgccagatggaattccttggatatcatggcgtggaggtcgccggcatgcctgaagaactgactgggtgg

SEQ ID NO: 629882 - DNA, 300 bp, Homo sapiens
tgttgaaactacgagttttcgcgtgtccgaaaaatcccggattcggcattacgcccgggagacgttttgccaaagtctcgggtttcctggtaaacagggcttggacggaacccggggttcgttccccaccccggccggccgcccatagccagccctccgtcacgtcttcacccgcacccctcgggactgcccccaagggcccccgcccgccgctcaaagcgccgcgcagccaccgccgccgcccgccgcctctcttaagtcgccgccatgacgaccgcgtccacctcgcaggtgcgccag

SEQ ID NO: 629883 - DNA, 1009 bp, Homo sapiens
ttggggtagcgcgtgttgagacttgggtctgacaagggatgcggggtgcgcggtctggagagtttctccggggtgttgtgttgtccacgcacgcgggtcggtggacggggtcggtgttgttgtccccttgtattattggggtctgtgtctccctcctcgttgggtggttgcgcgcccgttgagtgtcgtcgtgttggttctgatgtggttgttgttaggtcccgtgttgtggcgttgtttgttggtagatccgttgccgccgccacgtctggtgtgtattgttgttcgagctgggtttttcctggccggtccgggtggagttttgaggcgcgccctcgtgtgggttagtgtctgttggctcgccgcgatccgtcgttgttgtgtgttttgtgttgggcgcctttggcgcttactgctcttgctcctttttgttttattatagccgcaggcggggggtgttatcggtgtgctccttccctcgctctaccgttccctatgacttgtggggccgccgccaccggggttgtgtatgctccttccgggttgataggccgcctctttggtgggcggcggcgagctttttttttcaatgcttctcaacatgtttgttttgcccccgttctttttgtttgttgatgccgagcggcggctcgctctgcgcatccttttgtgtgtggcgactcgcgggggtggtgtcttcgtgcgcttgagcgccccccctgctgttgttgtatgttgctctcccctcggcgtcttgtcgttgtcgtactgtggggggtccccccccattggtgttgttaacgcagatggctgtttctcccgggtggtgtgtacaccgaccagcgtttcctgcggacaccgcccccggggggtggtataccggtcgctcgccgctttttagtattttggggggcccccccccttttttccccttttttgttttcccccaaatttttttataagggcccttttttccttttccccccccttttccccttttgggccccca

SEQ ID NO: 629884 - DNA, 156 bp, Homo sapiens
atgacagtagaacatacaaaacccacccgattcctccccacactcatcgcccttaccaggctactcctagcctactccccatatctaacaacgtaaaaataaaatgacagtgtgaagcatacaaaaaccaccccattcctccccacaatcatcgcc

SEQ ID NO: 629885 - DNA, 301 bp, Homo sapiens
acacaacataccaaaccctatggatacaacaaaagcagcactaagaggaaaatttacagcaataagcacctacatcaaaaaagtagaaaaacttcaaataatctaatgatgcatcttaaaaaactagaaaagcaaaagcaaaacccaaaatcagtagaagacataaagatcagagcagaagtaaataaaattgacattaaaaaatacagatcaatgaaacaaaaatttgtcttcctgaaagacaaacaatgttgataaatttaggccaacttaggaaaaaaagagaggagacactaataaa

SEQ ID NO: 629886 - DNA, 400 bp, Homo sapiens
tacttgtatctccacttagaggtatttgtaatctccccaaccttaagaaggttctttgtaattctccccacgcttgagaatgtacttatgtgagatccacccctgccgtgcaaaacatggctcttcacgcctcctatcccaaacctgtgtgaactagtgatcctccaccagcctttgctgactctcttttcggactcagcccgcctgcacccaggtgaaataaagagccatgttgctcacaacaaaggccctgtttggtggtctcttcacacgggaacgcgcattaaacaacacgattgcactttcaagggcttggggggaaagagctagaattcccatctcaaaaaaatataaaatacccaggagtcaccctcccccgagagggcctctgaaccaaccc

SEQ ID NO: 629887 - DNA, 479 bp, Homo sapiens
ttcctttgtcttactgtgactacaggaacctcatgtttgaccctactaattctccaacctcctcttcttgtattgccccctttttgttcactctgctctaaaaacactggtctgttttctcttctgcaaacttatcaagttcattcacacctgagaacatttgtactgcttttttctctgcctggaatgctctctgcttagcctctttgcatggctgtccccttttcatcattcaggtttaaagtcctcagaaaggcctactctcactactccaattctgcgttcctcttctccaaggcatacttgaaatactctgttttattttaagcctaatacttatcattctctgaaattttcttatgtgtataaacaggtttgtagtctgtcttcccctccaatatgttcatagctatatacccagcaactggaatagtgcctggcacataggaaagccaccatagatgagacaaagggaaaca

SEQ ID NO: 629888 - DNA, 163 bp, Homo sapiens
ctgattttaaacaatcagattcaagttgggtaattttaattatgtaacaacctgacatgatggaggaaaacaacctttaaagggaatggggtctatggtttgaattcacttaggaattttaatttcctataacctaagtgccattaaatggggtttttcatgt

SEQ ID NO: 629889 - DNA, 550 bp, Homo sapiens
gggaaaagcatttcatttttccctgaggatgataagccattattaagaagcgttgctaatgttatacagcaggctgggtgtcctgtcccagaatacataaaaggttttcagaaacttctaagcaaccaaaagaaaaagatgtttaagaaccccttggaaagggagggccttagtccacctccaaaatgttttttagaaaaagctaaggataaacaaaaaaaggtccctggtcagaccagcaaaaaaaaagtagcttttgaagccaaaagttaaaaacagcctttaaaaaacctgtcccagaaaggtgattttatgttccccgcaggaatgttattttcatggaaaacttgaagttttccagtcccctgtcccaaacatttgaaatcaactccaagtacatggggctggtgataaatgatcctaaactatcaagccagtttcaatttgtaggggccttttttttttcctgtggaaatgagggtcttcccatgttgtccaggctggttttgaactcctgccctcccccgatcctcctgccttagcctcccca

SEQ ID NO: 629890 - DNA, 370 bp, Homo sapiens
tgagatggagtctcgctttgccacccaggctggagtgtagtggcgccatcccagctcactggaagctccgcctcccgggttcatgccattctcctgcctcagcctcccgagtagctgggactacaggtgcccgccaccacacccgggtaattttttggatttttagtaaaaaccgggtttcactgtgccagccaagatgggctcgatctcctgaccttgggatccacccgtctgggcctcccaaagtcctgggattacaggcgtgggccaccgtgcccgggctaactggtctgatatttttaaaaaaggggacttggattaaagtatgcaaactcaaggagtagtactagcccacttgagtgaagttagc

SEQ ID NO: 629891 - DNA, 669 bp, Homo sapiens
agagatcataaatgacgtggagctacacgctgtaaagttatatatcttatgctagcagaggtatgaaataatatcgcatatggtgacgtactactccgctacatgataagaatatatccgtttggcatacgtgatgtatggtgcgtgaggcgtgatgcatatggcgatttgagtgtctcggtaatgatgaaattgtgtgagctatacggatgattatggaaagacagaaaaagatagtgtgaaaagttagaaaagatatattgccttatgtttattgataaaattatgggattaatcctagaggagatcgaagctattccaggtggaaatactgaaaacaatatcatggaaagcagataatgaaaaatgatctgcatgcagagcatctgaggccctaggaattcatcgtttctttttcaccgtatggtggcctgactggcatggtattagcaaactcatcactagaacatcgtactacacgagaccgtacaaacgatatgtacgcgtcacttccaacaatgttcgtaatccaaataggagctgtattgcgccacttcataggaggctgcattcactgatttcccctatgctcaggcgtaacaacctaaaagcaaaacatacagccaaaatccaatgcactatcattatacatcggcgtcaaatctaaga

SEQ ID NO: 629892 - DNA, 711 bp, Homo sapiens
agcgggtagtctggagctatggtggtggtggacagcgcgccgtagacccggacgacgggcaccccgtaaacgttctgcttctgtcggggcatgcccagtgcatccgcccggcggaggccccggccggcacaggccctggcacgctcatggtgactcatgcactcacgatggaggggaccagcccggaggcatgcgatgcggggggtcttgacccaggcgcggcaagcgagagtgcctcagggcacctgagccccgaggagaaggcgctgaggagtgaaactgaataagacagagtagtcagctcagactgccggagatcgaagagaaggctcgaattgagtgagctggagcagcaagtggtaggatttagaagacgaggaactcaaaaatgtattgctagactaatacagacttttatgagagaaaactcatgggcttgtaattgagaatcaggagttgagacagacagcttgtgggatggatggcgctggtggctgaagaggaggcggaagaccagggtgcactgatgtgagggcacgttggacgggggttctgatgagttccagccagcagttcaggatcgactgtggcgcgctctggcaggcagtgttccaggtcgcagtgagtcaaacacctgccagaagatctataccatggattcgggcggtatttgagctcttcatgattacagagtctggatatcctggtggg

SEQ ID NO: 629893 - DNA, 257 bp, Homo sapiens
gggggagagggtgaccgaaatcagaataggtgttggtatagaatggggtctcctctatcttaggggccatcaatttcatcacaacgaattgatcaatataaaaccaccctgacataagcccaataccaaagcgccacctaatacgactgatacacgaaacgtaactcacacgacagaccatagaaacaacatatatcgtcaccagatacataaacgacagaaagtcaagagaaaaaacaacagaacgaaaccaaaaa

SEQ ID NO: 629894 - DNA, 464 bp, Homo sapiens
  misc_feature (353)..(353): n is a, c, g, or t
  misc_feature (398)..(398): n is a, c, g, or t
  misc_feature (406)..(406): n is a, c, g, or t
  misc_feature (451)..(451): n is a, c, g, or t
aatttttagtagagatggggtttcaccatgttgatcaggctggtctcgaactcctgacctcaaatgatccacccacctcagcctcccaaagtgctgagattacaggcatgagcaccatgcctggccatcagtttcttaaaaagtaaacacatatctgccctatgagttagcaattccactacaaggtatttaatttacccaaaagaaatgaaaactttcataacaactgtattaagagccaaagtaggctgggtgcagtggctcaggcctctaatcccacgttttcaggggctgaggttggaggatccacttgagggccaggagtttgagaccagcctgggacaacacagcangaccccatttctggcaaaaataaaataaattaaaaatttagccanttacagtnggcacaggctgttagttcctactagaggggctaagttgggaaggntcttgagtccggg

SEQ ID NO: 629895 - DNA, 326 bp, Homo sapiens
  misc_feature (144)..(144): n is a, c, g, or t
tcgaccgctttgatgtatcgccacacagaagtattgtgtctcagcgtgtctagtctctttgcagatctctctccacacgctgaagaagtggcttacaggactctggggtaggatggaatagatgtcttccatctcacccttggnggggctgaaaacctggggtggaatccttctttttgcccttaggtgctggtgactcaggcagctctcttggcctctctgagcattcatttcctcatctctaaatgaggatgatagtatctgcttccaagattgtgtgaagattattttcttcttcttttcttttcttttcttttttttttttt

SEQ ID NO: 629896 - DNA, 192 bp, Homo sapiens
aactgtccctctacagtatatcatcttcacaattctaattctactgacttatcctagaaatcgcatgtctgccttaatccaatgcctactgtttgcacactctcaggtagagctgacttcctacactattaaagtgtaccacaaccaccagcccatcatactctttcacccacagcacctaatcctacctgg

SEQ ID NO: 629897 - DNA, 197 bp, Homo sapiens
tggagacagaatctggctctggtcacccaggctgggctgtgcagtggcgcgcgatctgggctcgctggaagcctctgcctcccggggtctcaagcgattctcgtgcctcagcctcccgggtagctggggataataggcgtgcgccattggcttctgggctaattttcgggattctcagtggggagacggggtttcac

SEQ ID NO: 629898 - DNA, 878 bp, Homo sapiens
  misc_feature (254)..(254): n is a, c, g, or t
ggccccgtctctaggtccaccaggtggtataaagggagatggcgaggtcctagaggcaatctggtaaccaaagaacgacgacagagcagatcaacaagcaagccaccatcatagccaccatcaccctccgtaacctctacttctacctacgcctaatctactccaccctcaagtcacacgtacgtcccccatcatcttacaaacgctagaacaataacatgcacagttctgaactatacaaaacccacaccacnattcctccccgacaacttcatcgcccttaccaccgcgtactccatacctatcgtcccctttttatacttattaatcttactagtaccatagatcataacctactattagaaccggcagaatagaataatagagcttggaaggaaccctttgccaggagtagcggggcctacaagcgcgaatcttcaattgaggacgacgggggacaccaattgccttggagacacaccttggactcgaaagctttgtccttgagatccaaaccggagggctgagcactgcacagtccgtggtgcgccttccactgtgaaattagttcaagagcgacacgatctctaagtaacttgtggaaatttgaaccctcgggcggaaggaagccgccggccttgtataatgcgaaatgtggcacggttgagatggcattttacccaatttttgggaccacacacacaccgttgcttgcacaagcttccaaggatccaaacgttaccttggggaataccgtggtcagcacagcaccttggggcccaaccttggaaccaagaacaaattggaacccccccccaattcttggtggtggaacttatccctttggaagggaccccgcattcaacccttgaaactgg

SEQ ID NO: 629899 - DNA, 170 bp, Homo sapiens
ttggtagaataggtacagaggctacagatggagttgcgttgttatgaaagtatggcggtgggttttctttcattgtaatagcctcatatgtagaagcatgggtccactgttaaaaccacatgtgtatgtgcagctttacattttatttaacgtgaagcatgtgctcgtgg

SEQ ID NO: 629900 - DNA, 174 bp, Homo sapiens
tccgcgtctccatccaacattccttctgggggtcacgtcgcatgccgttggccagcaggtctgcggtgatccgctgtttgccgtggaccctctcctccaggtgagtgtgtccgccttggggctgccggggacgatgttgcccaccttgctcaggcgtttcataaactcgatgtc

SEQ ID NO: 629901 - DNA, 346 bp, Homo sapiens
gaacactaaaagcattctgaaaggtaaaataaggctggaaaatgtatcactctcctccattacttggttaaataaataggtgtactaggcctgatagttagcggtagtacataccctttcactaagtgtatagagtaggcacaagcgcacataataccatagagcaaagaagagattgatatcataaaaaatgaatataggctagaatggcttatataattggaggtaacgggatttcaacatactctgtatcgtcactagtaccactagacacagaacaaatacaccctagaataggttattacaataccaatatttctaacaagtaccataagctaggtaccaa

SEQ ID NO: 629902 - DNA, 628 bp, Homo sapiens
gagctggtgagcggagatgcgtgaccccagagagccctgagcagccccacctgccgcctgcctgtgcctagattaccatcacacccctgtggagtgagcctgcatgctgccgcaagcctgtgccccaagtcaccatcacctgcaaccatgagcatgcgatggcctgagacccaagcatgcctgaccagacagaaacacacacaacgaacagcacacacctgaaacacctcgacgactgcgcagtaccagacaaaccaaacgtcgcccgagacaacctacaggacccatacggaggcagccaaagagggcacagccgaggctgagacacactgtataccggagaccatacaaacaaatcaggccaagaagaaccaagaaaaaggacagagagatagaaccacgacgaacgacgggggacaccacaagagcccagaaagcaccaccggcctacccagcgcgaacaccaacccaaacccaccatcggcccacccccacgccggctacagaggcagccacaggcgcactaactcgggcagaaccacaaccaaccacagcacgcccgaacaacagagaaccaagcacaaagagcagagcaaaccaacccacccacaatcaccaccgtcaaaca

SEQ ID NO: 629903 - DNA, 455 bp, Homo sapiens
  misc_feature (185)..(185): n is a, c, g, or t
ttcaggaccatggtgaacgtcctgggtgatgcgtttgggacgggcatcgtagagaagctctcgaagaaggagctggagcagatggatgtttcgtctgaagtcaacatcgtgaacccctttgccttggaacccacaaccctcgataacgaagactcagataccaagaagtcttatgtcaatggggnttcgcggtagacaaatctgacaccatctcgttcactcagacctcacagttctagatgcctgacctcagattgaggcctgggattgtgaagggcgtctccacaggagccatctcctagcaaactccgacattaaggaacgagaaggacactaagagtcaactgtacatttagtttgataaacagacctccagattattttctatatttgactttatagccttggttctctgggtttagggatttggggtgagatgaactgaaaggaaatta

SEQ ID NO: 629904 - DNA, 463 bp, Homo sapiens
  misc_feature (292)..(292): n is a, c, g, or t
agagagacaatctaaacattctcttaggctgcagataagagaagtaggctccattccaaagtgggaaagaaattctgctaagcattgtttaaatcaggcaaaatttgttcctgaaagttgctttttaccccagcagacataaactgcgatagcttcagcttgcactgtggattttctgtatagaatatataaaacataacttcaagcttatgtcttctttttaaaacatctgaagtatgggacgccctggccgttccatccagtactaaatgcttaccgtgtgacccttggntttcagcgtgcactcagttccgtaggattccaaagcagacccctagctggtctttgaatctgcatgtacttcacgttttctatatttgtaactttgcatgtattttgttttgtcatataaaaagtttataaatgtttgctatcagactgacattaaatagaagctatgatg

SEQ ID NO: 629905 - DNA, 144 bp, Homo sapiens
gcttcagtgtgagcttagacgtctaccctaaaatagttaaccgtaatgctaattgtaactcattattatcgctttaaggcgtattagggggaatgtagtgggctataagtacgtcattcttagtcaagtctgacacgcggggtc

SEQ ID NO: 629906 - DNA, 243 bp, Homo sapiens
ggggggtttttgggggccttttttggggggggggggtggccccaagtttggggggccttttttcttgtggccccctgcctggggcaagggggttggttttttgggggggcttttgggggttggggttttttcctttttggggtttggggctggccccaatttcgggggtttttggcccggccccccccccctttgggggctttttgtggttttgggggtttattttaataaggttttccccca

SEQ ID NO: 629907 - DNA, 700 bp, Homo sapiens
cccacgcgtcgacaaaaaacaaaacaacaaaaaaaaaaaaaaaaaaaaaaaaaaaaaaaaaaaaaaaaaaaaaaaaaaaaaacagaggggggggtgtatattttattttttttatttattcatctttattatgttcgcctaatttatagtgagtgagatagagcgagcgtcagacctcctgttttcgagatctttattttctttcctaccacaccgctgcgcccaactatcactaaccaagcagttctctcggcgcgacgaaaatcgtccttcaattgtgtgtgatgtcgtatgctgctggacagccgacgcgcgcgcgcttccgcctggtaggagcggaagcgcaagccgcatggtctaaacctcattcttatattttccatatcctcctcctgattacggcctctcacttcacaaaaaattatacaaagacgatgaacaatcgaagccctcccccaacacctcccacccccctccctctctctcccctaacaattctcaccctcctcctctcctcttccccacccccactccgactcacactcaatatctctctccttctctatcatctaactctatatatttcaacaccacgcacaaactcccttccccacctatcataaactaatacacctcttccttccttctttcccctcctcccctctctcctctccccccctcccccccacccccccccccc

SEQ ID NO: 629908 - DNA, 241 bp, Homo sapiens
tgcagcggtgtcacggaacatacgattattcttggtcagtccgctgctttttctggtcctgctgcacaattggggattcaattacacgctggtgcgaaggtctattttgattacattaacttaacaggcggagtatttggccggaagattgagttactccgacgggatgacaaatacgaagcggaaattgccgccgttaataccaaggcttttatcgagaatgatgacgtttttgccttgt

SEQ ID NO: 629909 - DNA, 400 bp, Homo sapiens
gcttttgctgttgtgtcaggtgggcagaagtcacttgatccaactacagagatattgtatttatgacggtagacaaactggatgtacttatgctctgccagcccaccaggtactctgttgagcttgtcgttgtccaaatgaagctccctcacatgaggcgtgttggccagagagccattgtcaacagcatagatgctgttgaaactcaatcccaacttagccaaattatgcagtcctttcaggctagctgcatcaacactgctgattttgtaggccatcaagatgtaattccgtaatggaaggaggaagaccttgaggaatgctggtgatattggtatcaccaatgcgcatgtatcagagcttcttcattccctggaaagccccattttcaatacctgag

SEQ ID NO: 629910 - DNA, 175 bp, Homo sapiens
ccctgtgccggcattcagccctttttatttgaagtgtcatctctacgggataaccacagcttactttatatggttggtcatagtttacacaagcatgtgaacaatcttatgcttttcaaaaaagtgtctgtggggtagggtgtatggtgtgggttctcttggggggactcctcta

SEQ ID NO: 629911 - DNA, 1358 bp, Homo sapiens
  misc_feature (73)..(73): n is a, c, g, or t
  misc_feature (509)..(509): n is a, c, g, or t
gccgggcgtggtggcacattcctgtggtcccaactactcgcgtgcagtgctgacggcaggagattcgcgctgnatacctggtgaggcagagtgttgcacgtgaggcctgatgagttgtgccacattgcactccagccttgggcgacagacgtgaagactcctagtctcaatagagttggatatatataaatagaaacttgtctttggaacttgggcgataataggtggattgcgaaggcatattcaatatcagcattgcgtaagagaatcagtacgtttggagcaaaacagaactagtggcgaattcgtcattgcatgtgtccggcaatccacgatggggtcgggggggaacagttggcccgatgtacgggtgagatcagcacagaagggcgacacttctattgatggcttttataatggacctgtcaaattacttgttagagagacgtgatcttccctctaattttcaataaaggtgtgcttgaatgagtatgtctaagagcgcgcantaccatggatcctacccaggagaggtttcctaatgggtcttttataccattgtgttttctaaatagagtttacctcttttatatttttaaccgtgggtgaccgttaagagttgggtggacacagagggtagtttaaacggcagattccccagtatttcaattgttttccgtactcgcgctaccttaacaataccttatttttaagctatctgtgtggggtccatattaataccggcataagactaagtgggtcgaccgagtagttgaagccttcctttaacccacgaaattaacttccatgggtgtacccccttttgtgcgttttcctaaatttacttagggggctcccagtgtggcttaaaataattacttgttggttgcaacatctaacaaggttactaaagctatgaaggcatcgaattggttagaaaattccctggggatggggtgcccctggaaattccaactggacgtatactttactttcggtgcacacgacatggctgcgaacaacacggtggggagacccattaagggtgtcgtaaaagaggcttgaaccacacattttggggagtgggcgactctagagggttattacaccgacaatcgtggggcgttcacaccacacgacaatttttggccgggttcacagagttgccccctatatcgtgcattctttctaacagagaagacgacgagtcttccccactcctcgttgcacccccggggtctgggaggcgcactaccagaggggaggagatattacgggctctgatctgagcagcccgcacaaccatctgtgccccctctggtcggtaacgctgcggcacgacagacatcctccgtgac

SEQ ID NO: 629912 - DNA, 820 bp, Homo sapiens
gaggctgaagcagaagaactgcttgaacctgggaggtgaggttgctgtgagccatgatcgcaccattgcactccatcctgtgtgacaaaaatgaaacaccgtctcaaaaaaataaatatacgattaagtaaaaaaacagtacattcaaataagcataacatgttttcgggcgggacgcacggtcctcgagagaaaagtattttcatgacccatgcgttttgggcgcgccggcgtcccacggttctaaagcatcgatgggcgttatgggagtgcccttacgacactggggtcacaaaatgtgtgcggggatgaaccactccgaagagaaaagagacgcccgggaggcccagccgattagtttccaataagaaagcccaatgcgttacaggacccattgaggggctcttaaacagggggaagcgcaaaaagggagcccacaaggtttgctagttgacaccccgcgcgtgggaaggcagaacccttttaaacaaggagtataaccgaaggtgatttaaaagacccttgaaaattcatgacgcagggaggaaatggggggttattataaaagccaaagttaacggctttactaaagagcagacgaaaattggaacgattattggggagtgctaggatgaaccattgtgagaagattgacgtttgaggtggaaacttgcaagacaggaagtcgagaaggggagacaagaattaagagattggaattaggagatacaacattcttttgagaagacaaagtaaatctacctgaaagttgagcgaaaaaaggaacgctggacacaaagctggaatgtcaaaaaaaata

SEQ ID NO: 629913 - DNA, 1015 bp, Homo sapiens
  misc_feature (38)..(38): n is a, c, g, or t
  misc_feature (66)..(66): n is a, c, g, or t
gccgggagggcacgaggctctagaaatgcccttcactntctcctggtgtttttctctctggacccntctgaagcagattttggacaagacctgcagcggaagggactctgggctgtgcctgaggctggctgggggcaggacaacacagctgcttccccaggctgcccactctggggacccgctgggggctggcagagggcatcggtcagcggggcagcggggctggccatgagggtccaccttcagccctttggcttcaaggatggagatggttttgccctccctctctgccctcgggtggggctggtgggtctgcagctggtgtgggaacttccccacggatggcggtggagggggttcgcaccgtgctgggctccccctgactgtagcacggagtgttggggctgggggccagctccaggagggcttgagagctcagcctgcctgggagagcccttgtggcgaggcattaaaacttgggcaccagcttctttctcggtggcagaaattttgaagtcagagagaaacggtcctttgttggcttctttgctttctcgtgggtcctttggcaggcctccctttggggagagggaggggagagaccacagccgggtgtgtgtctgcagcaccgtgggccctcaagctttcctgctgtcttctccctcctcctcctttcccctttctctttcctcatttcctagacgtacgtcaactgtatgtacataccggggctcctctcctaacatatatgtatatacacatccatatacatatattgtgtggtttcccctttctttcctttttttaagcaacaaaactatggaaataataccccaacagatgagcgaaaatgtattattgtaaagtttattttttttaatactgttgtctataatggggaaaaaggacattggccccgcagtgccctgccccagtcagcctggctgggctctggtgggggctcctgatccgcatccaagcttaaccaaggctccaataaacgtgctaggaagca

SEQ ID NO: 629914 - DNA, 143 bp, Homo sapiens
atttatccctgatcctaatgctgaaaaacctgatgacttgaatcatcaagccagccagcaggtttaacaacacgtgaacctgcccaaatagaagattcaagtgttgttaaacctgctggctggcttgatgatgaaccaaaatt

SEQ ID NO: 629915 - DNA, 1136 bp, Homo sapiens
cacacttgtcagagtgtgtcaatgcccccagcaccggtagttttaagcgctatggctgcgtttttcaggggacaaaccagcagatcaaggcccacgaggccagctccgccgctgcacgcagcgtcacaccctgcttgcacaggcatgtgcgacgccacacatccgtcctctgacacacacgcaacgcgtgttcccgttgctatgccacgcaactgcaacacggtgtacgacaacacacaacacagagtcatacacaagctcttgccacaagtcacgactactgctacgcctctcgcaacattggaagactctgacgcacgcacacaaacggacaacctgcctctcgcaacactacatgaagtcccacaaactccgttcacttctacacgcgagtgactagacagccaagcagagaaactgaaggagcttgacaaggagatccggcccttccggcagcaactgggcaggaacgcagacagccatgacagagcagccgtggcagtccctccagaaccgcgtgaccgagctggagagcgtggacaagagtgcggggcaacgtggctcggaacacaggcctgctggagtcccagctgagccggcatgaccagatgccgcagtgtgcacgacatccgcctagccgacatggcacctgcgcttccaggtcctgcagaccgccagctacaacggagtgctcatctggcaacgatcgcgacctacaagcggcggaacgcagcgaggcccgccacgccggaacaccctgacccttaacagcccagcctttctacactggctacttggcctataccatgcgtgcccacgctcaccctgacccgagacggctcggcgcacagcgacccacagcaccactgaacacacgcccacacgtcctcgccaccaatgccgcccggcaccccaacaccgcgtaacgccaacacgaccacgacgcccgcagccctccggcccccaccacccactgagccatcgctccaccccccccagcaggcacacgcaccccccccaacacaatacctacgaacaccaccacaccgatctacacggcacttctaaccacacaccacaacacaagcagcacaccccagccgcaccccccaccacccaatcactcaccacccacg

SEQ ID NO: 629916 - DNA, 411 bp, Homo sapiens
tgtgcttgtccaggtctttaaaattggttacgttacagttacatcacatttcagttgagactagccacatttcaggtgttcatagccacatgtgagaagagggtatagtattggacaatccaaaaagtcttttcaagtgactttttcattaatattattattagaaccaaagtgatacacaggtttacaaatatttgttaaaagtaacaagtcaacatttacaatttttacaatatttacaaaatttacaatttttttcttaataatttttcttttaaagctaattctttttttaaaaaactgatacaggcatgagcccccacgcctggcccagattattatttatctttgtgtctgcagcaaatagcactggcctagtccataacaagtccttaataaaccagaatctga

SEQ ID NO: 629917 - DNA, 462 bp, Homo sapiens
cgagtcgaggacagaggcgggagaactaggctcggggctgcctgccagggcgttagggataggatagggcccagcttcaggtagggggcaccttccaggcgggcggtgaacccctaacgggcaacgagcgggggtactgatgtcccttagccccagggacccagaagcaggttcaatctgtgcctcacagcaccaccgtgtggcttccccggggcatgcagccgcctacctgggtgtggccctgcagtgtggagctggctactacaagtccttaggaatctgtcgcatctacactcagtgcaaaaggcccagaacctcagtttagagcagcagtttattcgaagccacacatagtagcaggcccaggctctcacctaggcaagccacaacttcccaaagcaatggcaagtccagcccttccgtgtctcgcaatatgtcaggcatcaccgtcagggcagcagg

SEQ ID NO: 629918 - DNA, 180 bp, Homo sapiens
aaaaagcagctgctgagttagcattaccacagacatcaatatagtccatctgcaatcacaacgcacatagccaggatacccaccaactcccctgagatctgcagcccacacgtgggagctctggctgtcaccttcacaagccacagaaacggccacaacatattcggttgagcggagaga

SEQ ID NO: 629919 - DNA, 134 bp, Homo sapiens
tgttcccggtgtggtttgctgtagaacgctgccctttccatataccttgaatactatgcacccagcatggggtctcgggaacagcttggaatatgcggagtttgcaagatcactatcttgtaatccccaagtaa

SEQ ID NO: 629920 - DNA, 264 bp, Homo sapiens
  misc_feature (138)..(138): n is a, c, g, or t
tgactgtacttggtcgaatggtgacccctaaaagtcatgtccactgggaagctcagagtgtgaccttatctgtaaaccatcttggcagttatgatcatgttaagatgcactcacgctgggttagggtggaccctagtncaacaaccatgttcttttaagagacagaagaggagaagacagagagaaggccccatggaaaccgaggcacagactggagggaggcgaccacaagccaagaacgctcagagccgctgggagctggaa

SEQ ID NO: 629921 - DNA, 120 bp, Homo sapiens
aaaaattttgggggggttaaaaaagtggttattcggaaaaaacaattttaggtccctttgggacttaaggaaaaaacattttttccatgttacagtcttaaacagaattttatggctgca

SEQ ID NO: 629922 - DNA, 420 bp, Homo sapiens
  misc_feature (282)..(282): n is a, c, g, or t
acagtggcgcgatctcggctcactgcaagctctgcctcccgggttcatgccattctcctgcctcagcctcctgagtagctgggactataggcgtccagcaccacacccggctaatttttttttttttggtattttaataaaagagggggtttcaccgtgttagccaatatggtctccatctcctgcccttgtgatcctcctgcctcggcctcccaaagttcggggataacaggcatgagccaccgtgcccggcgggtaatgtcgggggggggagggggtatntctgggatagaggagtcctgtccggtgagccccttactttgtcacaccctaaaattatctcctaatatatcccccacctgcttagattataataattacagtaaggccttctagacaaggatcatgttaaatattgta

SEQ ID NO: 629923 - DNA, 162 bp, Homo sapiens
  misc_feature (5)..(7): n is a, c, g, or t
  misc_feature (55)..(56): n is a, c, g, or t
ttttnnnttttaagcactagtgctgtgctttgcgaacagaatcaagacattaacnnagatcagcttctctgaatgaaaagctttctatagaacaaagactgctactgtttcgctgccattactcgctccaaagctggaaaagaaaatatttcaaaatcaagg

SEQ ID NO: 629924 - DNA, 829 bp, Homo sapiens
  misc_feature (36)..(36): n is a, c, g, or t
acagaatccgactggtaccgaatcaagcagagcatngactccaagtgccgcacggcgtggcggcgcaagcagcggggccagagcctggcggtcaagagcttctcgcggagaacgcccaactcgtcctcctactgcccttcagagccagtgatgagcaccccacctcctgccagcgagctcccgcagcacagccgcacgcaggccctgaactacgcgctggccaacgcacagcaggtgcagatccaccagatcgggagaaagacggacagtgtgcaagtaatcccacagggacaccttccacatcgcccaggtgccgcaagggggagcaaggtcctagtatcacgcacggacagcgagggcaacctccagatccatcaacgtgggggccaaggcacggtcacggtgctgcaggggtgcacaagctgatcgcgggtggcctccttcggacccccggccggcagggcgggccgtgcgattgggttcggccaacttccatggtgacagcggactattcccagggtccaaggtctacggtgcaggcttggccgccatgttgaagtgaccacacggccgggggcacaagaccgggcgaaggccctgaagcccaggctaacaggccggagattgcagctcgagccacggtgggccattccagattccagggaagcgggtgccccatggcaaccagggagcccctcgcgggtctccgacttacgggccgggcccccaaagcgcccgggatctacaggggctcggccacaggcagcgggctgcacgtgttctgctagaagtggtttgaagggcgtgcctccggggaacaacctctatg

SEQ ID NO: 629925 - DNA, 372 bp, Homo sapiens
aaaaatacagggcacacatttgagataaagtttctaaacagtctttgatgggcactggaaacacttgcatatattcattccttacaccccgagtatgccacttggggttcaatccagtagttgcgttaagtttaaaactgcactggtctatattttctaggttttaggctattcccacttccgagcttgtttttctattaatgcaaaatatttcttttagaacccagatatcgaaaaaatccacgcgttaaaaatagcagatatatataaaacacagtattcaagagcgcacccacagcgagaacccccttttagtatagtcacatccccatagagcccgctttacacagtatttttctcacacaaaaacct

SEQ ID NO: 629926 - DNA, 178 bp, Homo sapiens
tcactagagatccccatactcatcaagtggcatcttttttttttgctttttttcttatggagacagaagtattgtctgtcgcccaggctgagtgcggtggttgtagatctcggtcactggaacctccggctcccaagtttgagtgattctcctggctaagcctcccgagtagctggga

SEQ ID NO: 629927 - DNA, 808 bp, Homo sapiens
  misc_feature (460)..(460): n is a, c, g, or t
  misc_feature (474)..(474): n is a, c, g, or t
  misc_feature (598)..(598): n is a, c, g, or t
taagctgcttgcaacacttcgttggccacaggctgtttcgccacaatcgcgggccttgcaccagaacaacaactgcgcacccttggcctgcaaagcttcgcgcgttgcggtaaaggcggcgctggagctgtgttcggcgggcaattcataggtgattgcagtggctgggccgcgtgcgatggcctggccttcataacgcaactggccgtcgatctagcggatcgcgcccatggggtaaatgcgttccttgtcttcagcggggcggtaatcgacgatttgcgcatcaacctgacgggctaccgccggtagatcctggctgccgggcagatcggcggcaaataccatggggctgaaacaacaaaggcccagggcacggatacatcctttacccaggctcatcggatcagtgagccctggccaatgttggtcacagcgatatcgagtgtgttcatggttgacnccctttcaatccgnccagcctcggcagttgaccccgccaagtcaaggcgtggagaagaaccgattgaaacagtctgcaacaagagccgcaccgggctcgtcattcaggtgtaaatgatggccgcctggcagcgtggtnaccgtgaagggtagctgagaaagcaattcggaatgtttcgccagcatgccgttagccgcgaccaccaactgggtagggcaccctacccttcgcacgaaagccatggcttgctcgtcggtcaggcgcaccggcgacgccagggtcaggcggctatcgctgcgccagggtgtaaccgcctggtacgcgtccgtacgcacgggatcctctaga

SEQ ID NO: 629928 - DNA, 413 bp, Homo sapiens
  misc_feature (18)..(18): n is a, c, g, or t
  misc_feature (23)..(23): n is a, c, g, or t
  misc_feature (48)..(48): n is a, c, g, or t
accacttaccaattattnaaacnagaagaaagtttcacattcattccncggtctcgtgaagagcttccagacaactttccaaaggaaattcctgggatctgctatttcctggaggtaaggactggtccaaagccaccaaagccttctctttcttcgtcgagaataaaaaaggtttcctacaacatcggcaccatgttcctccgggagacaagcctctgagacctgctacagatcaaagactcctccaaaaagcacaagcccagaacatgggtcaccaatggggggtggaaagagattgtgtctctttcattgctttgttgggaacaagcagcaaaatttctgtattatgtcaggcaataatcctactaaaaggtggaggtgaccgctgtcaataaaaagccggaggatgaggg

SEQ ID NO: 629929 - DNA, 769 bp, Homo sapiens
gccaagtctgttggaggggcccaaatttgtgtgccgatcattggaagtccccgtgagccaccaagctaattggatcgtgttcagcggtagagttccccggttggcccgctacactctctctctgcggtccggaccggcagtatgtgtgctctgaagcaagtgacgaagtagacgcccacggctgctgcccaggcgtcatcgtctcctatcacaaactaagtgagggtgctcaacgcaaacttcggaataggggttgctgtagggataacccatctctcgccccgctcgcacacgctcggtgcataccatggataagccccgcgctctctaccaattctttgcaatcggtaggagatacatgtgcgtgtgcaatggtgaaaaatccttcatatgccgtccactcgctactttcgcatcgtatgaaggagtcatggaaatgaccacgctcctgggccatttatggtagagttgtcccattccgtaagaagggattatgtgatgcagaaagctgtccttcgacttatgatgtgcctcgcgcctctggcacgcgcccctgcatgagatgtagatgcacgctcggtgatgccctggatagtttactttgtggttctaccctatgcgagaggtgctttctgatgtatgacttggataagaagaagacagagagagaagcaaggaactctccttcttatttgcctgctacgggtaccagcatcacccacaacacaaacataccgaatcaaataaaacaacacgacatagacgcaga

SEQ ID NO: 629930 - DNA, 738 bp, Homo sapiens
ggcaaacccggcgagcagggcagctcgcgtgaccctggctcctctgcctgccccctcaggcccccgcctccttcaggatgaggctggacgtggggccggaggatgagctgtccgactgggccgactgcaaaagagttttaccagaagtacgaccctaaggacgtcatcggcagaggagtgagctctgtggtccgccgtctgtgttcatcgagctactggccacgagtttgcggtgaagcattatggaagtgacagctgagcgtgctgatgtcctgagcggctggaggaggtgcggggaagccgacatcggcgagagacagcaactagtgcgttcgcctagggtcgctcggcctaggccccacatcatcaaccctgcatcgagttcctatcgagctcttctagcgttcatgttcctggtgtgttgacctgatgcggatagggagagctgtttgacttatcttcatgaggagacaggtggccctcgtctggaagacatggaaaccaggtccatcatgcggtctctgctggagatgccagtgagctttcatccatgccaactagacagttgtgcatcgagatctgaagcccgtagaatattctcctagatgacgaatatgcgaggatccgactttcagcatttcgggttctcctgtccacttgggaacctggcggagaagcttcgagagtgtgtgggaccccaagggtatctagtcgccagagatccttaaatgctccatg

SEQ ID NO: 629931 - DNA, 248 bp, Homo sapiens
cgttgcgcgagatcagctacctgacgagagactgcatatgcggtgtggagtgtctagaatcgttggaaggcgtgtatcttaagctccaagttcacaaggtgtactagtacgtgcagacctgaaccaggcagtaccagtactctaggttctctgccctagtcatatgaagatcctggctcgaggattgtaaaccgtaaagttttgaaagcttaaagtttctggacagtctttaaactactctgtatggg

SEQ ID NO: 629932 - DNA, 724 bp, Homo sapiens
gtagcccccacaatcctagggctacccgccgtctagaactgatcattcatatgtccccctctattgatgccgctacctccaaatatctcatcgatagaacacgactaggtcaccacccaacagagtgacgtaatctagagcgtaacctcggaatacgaaactgataaccatacacaacactatgaggacgaacctgatctcttatactaatattcgtaatcatttctattgacacaactatcctcctcggactcctgtcctcactcattatacaaccaaacgctacgccaatctatgctagttagaacgctagtcgcacggccatccccttatgagcgggcgcagtgatttataggctttcgctctaacgtataaggtaatgccctagcccatcttcttattgacaaggcacacctagaccccttatccccaatactagttatcatcgaaaccatctggtctactcattcaactcaatagccctggccggactgcctaaccgctaacattactgcgggccacctactcatgcacctaattggaagcgcaccctagcaatatcaaccattaaccgttccctctagacttatcatcttcacaattctaattctactgactatcctagaaatcgctgtcgcctttaatccaagcctacgtttgtcacactttctagtaagccctctacctgcacgacgaagcacagtaaacaaactcggacacaacg

SEQ ID NO: 629933 - DNA, 151 bp, Homo sapiens
ctacaaatgatgtgatgaaaatgacatagttgcatggcacatggcagaaatgaatacgatgcacacacactcgccatcgcatacgatttgtgacggcataccagatgtgcgttatgaccaacggcacattgcatagcgaagttaatagata

SEQ ID NO: 629934 - DNA, 432 bp, Homo sapiens
  misc_feature (432)..(432): n is a, c, g, or t
atataagtacatattttaatacataatatatatatatccccctttcaccatacataatattttttacacgggaaccttatttgtggcttatgcttaagttctttttttttcttttgagacgaatttttgctcttgttgcccaggctggagtacaatggtgtgatctcggttcaccgaaacctttgcctcccgggttcaagtgattctcctgcctaagcctcacgagtacctggggttacaggcatatggcaccatgcccagctaattttgtatttttagtggagacggggtttctccatgttggtcaggctggtcttgaactcccgacctcaggtgatccgcccacctcggcctcccaaattgctgggattacaggcgtgagccactgcgcccagctgtgtttgagttctgtagtctgtccggtggtttttn

SEQ ID NO: 629935 - DNA, 134 bp, Homo sapiens
gggctaatgaaagtttttagcatgataggtttcttaatctattatgaatgggaggtattcatcccattctagttttaaatgaaaacccaaatttaatgcattttgccttgttggtttcaaccatcacaccaaat

SEQ ID NO: 629936 - DNA, 1124 bp, Homo sapiens
gacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacgaggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaattttcaagttttcttgtagagacagggtctcactatgtagtctaggctggtcttgaactcttggcctcaagtaatcctcctgcctcagactcccaaagtgtagggattgcagatatgagccactggcctggccttcagacagttctactgtgaagtaaaattgtatgtggaaagagtagatttcatggtctaccatttatctcaattgtaactgcgggcagccatgttgccatatacggacgtcaaggaggacagcatacggcaccgggacacccagcctggccgccctggctcctacctctatacagactcctcactcgcatcgaaaccgtgacgaacacaagaacgcaacattaaccacagtctcaccagcacaaccccacacgccacaggccagcccacaagagcagggggcaacatcgacgacacaacgcaactacgaagaattaaagacccgggcacccaccgaccagcaacaaaagacacccaacaccagacagacagcaaacgacggaccgccaccgagctcccgacacctcggccccagatccacacgcagaaccacgcaaagcaacaccacccaaggagagcggccaccaaccaagccagccaacagcgcgaccaaacaaccagcaacacctccagaacagacaatgaaagagaaactcatgacatgcgcg

SEQ ID NO: 629937 - DNA, 305 bp, Homo sapiens
  misc_feature (64)..(64): n is a, c, g, or t
  misc_feature (110)..(110): n is a, c, g, or t
  misc_feature (177)..(177): n is a, c, g, or t
  misc_feature (186)..(186): n is a, c, g, or t
  misc_feature (190)..(191): n is a, c, g, or t
  misc_feature (196)..(196): n is a, c, g, or t
ccgccgttgcccctctgaaaagcccatgctccccaccatgtataggcctttctgccgtgtcccnccacctgccctcctgccgtgtccctccacctgccctcctgccgtgnccctccacctgccctcctgccctcctgccatgtccctccacctgccctcctgccatcatgccatgtncctccactngccnncctgnctagtcaattccattccagcgtagactagtagcactagtccacggttggctgagaatgagtgtgaggcgtattataccatagccaaccgtggatatcgccaaccagtgg

SEQ ID NO: 629938 - DNA, 86 bp, Homo sapiens
cctttttttttttgcacagtaatcaaaattacaattctaaaatttacatgaaactaaaataaatccttggactagccaaagcaatc

SEQ ID NO: 629939 - DNA, 95 bp, Homo sapiens
tcgatacgactttttttttcccatctttcaggtgtatttactgggtatgttttcaaagcttgttccaaaagcttctgtccttctgtcgtcttctc

SEQ ID NO: 629940 - DNA, 283 bp, Homo sapiens
  misc_feature (67)..(67): n is a, c, g, or t
  misc_feature (263)..(263): n is a, c, g, or t
ggcacgagcttccctttgtatgggagctgttttcatgctatttcactctattaaatcttgcaactgnactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattggggctaaaggcttgcattgttcctgcaanggtaaagtgctgggggtttg

SEQ ID NO: 629941 - DNA, 189 bp, Homo sapiens
ctttccacgcgaaaaccacacgccgcgagtcgagaggtcctgatggacgaagttgttgcatatccgggtgaggtcatggtggacgaagttgttgcgcaacaacttgtccacaatgatttgcaacaacttcgtccatagtgacttgtgggagcgggggggcgtgtgcagtttggttgttcggcgtgtgca

SEQ ID NO: 629942 - DNA, 1128 bp, Homo sapiens
tgaatcctgtacggttctgtagtaaacctcagttctttgtctccttcagaagaagagaatgaccaaggggcttaaggtatacggagagactgaggcaatgtcataagtagcaggagtggaccctccatttgtaaatagctttagcgtgacagcgaactgaacatggaacggtaatagcacaagttactgcttgcaggagggccgagtgggcagctcgacaggagcacgtgcctggtctagctggattcttttttggaccttcgtattctagtaactgattgttgttatttagacttcattgtatgttctttgctctttcaagtcaacgtatctttaacgctggaccatcttttcctacgacacgagaacataagcacaccaataatgtcatcaattgtctggtgagcctccaatgtgaacgcatcctaaggagacagtgggcacttgtcatggagttccgcaaacaaacgtactcatatctattaacttggcgcactgtttaaaacaactgtcttctcaggcgtaagctgctcaatcctagtggcagcgtacctatactgctgagataaaaccccatttgaagaaaatcattgtacagaagtggaaaagtaattggtgtggaaactctgaaggagcaacatcggtcgcgtgtaagcagctctatcttgtgatcccctagctaccgttaccagatgggggtcagaaagaagtgggccaggtggatcacgaagttatttgcattcgtcagccaaccccatcaaggaccccaatgatgtcgaatttcctggcggatccttattccaaaagaatccaagtcacatctgaaagacgagaatattgacggtctggcaatgatcttccttggggcgcgacaggtatgcggcccgagcggaggctcatggctgctgcgtcgaccacctggtgtgtaccacgcgcctgaagaaacacgcgcgccttgtgcctgggtgcctggtcgacactgtttctcaggtcctctgttctccactggcgggcaaccaatttttgtcaggtgactcattgacggcgtcgccaccggccacgctcgtcgcccacggtcagcttctgttatgttgcttgtattctgcttctgtgctgtcggatagcgcg

SEQ ID NO: 629943 - DNA, 466 bp, Homo sapiens
ctttggcttcaaaaacatgtatgccaaggtctctgggtccattaatatggacagccccccccagggcctcttccgtgggctctccagacaggcatcccatcaacatatgggttataaaaagggcccccatgttgtggaaaaccgggaggaatgtggccctctgcccattgtggttgcgtccccccgggggccctttaggaaggatccaaagccaaaaaattaggttccatacgtcaaactgggctgggaaaatgttaaaactgcccagggaattaagcgccctgtgtggtctaattttaaaaaaacccccccgtaacctctctggccttgtgcaaccagttcctgttctgccctgcccctaggaaagactcagccccccccagcctgggatgttcccctgccttttgtttgtttttagggaagtttaatctttaaaccctttggaaataaataattatagccttcc

SEQ ID NO: 629944 - DNA, 644 bp, Homo sapiens
gggcaggtggctgaggcccctgggctggtgtggacgtacctggtgggcaccctgatcctcaggctcctgtgtccctggatggctagtccccagcaccaggacctcgctgggcagcggttggtggtaccatgaactcttttcccagtgtccttcagggagatctgtgatgaggtgatagcctgccgctgactctaccctgcagccagccctctgcctgtatggtgcatcgtccgaaatgagaccagtgctgggcgagccattgccgagttctatgtcagtgcaggctgacttctgatcaggtgaggaatcactagctgagtgggggacccgagggccacgagctctatcaggaatcattcttttgtcgcgacgacaacagaacgtgtcgtgatgattgcccgagacggatgatgtgggcgtgaactctgcaccactcggccatagaggcgcctattcgatccgtcttacaaccggggttcatgggagatgtcccagttggagtggcccctagaggtccccaggcccgtactcctcgccggcgtctgaacaataagtaaagcggacgtttagttccttggatcaagcagagtctatagaaaatgaaaagaccaactttcaaagttgcaagatgtaggggacattac

SEQ ID NO: 629945 - DNA, 88 bp, Homo sapiens
tttaaaaaaaaacccgtttaaccctttttaattgaaaaatgtttcaggcaaacattgggggggacaaaaacgtttgtggaaaacttta

SEQ ID NO: 629946 - DNA, 166 bp, Homo sapiens
cgaacacatagaagtacgtatatcatatggcacattatgacttgtaacatctgtacttcataatacaggtataggtgtgtggtatggaagctaggaaaaccaacagtagtaggctattatagcaaaagatctgatgttaagatataaagatcatatagcctgattt

SEQ ID NO: 629947 - DNA, 447 bp, Homo sapiens
  misc_feature (74)..(74): n is a, c, g, or t
  misc_feature (125)..(125): n is a, c, g, or t
caggaccctgaagatcctaactggacacatccctaatcagtccggtgacctcatttccaagatcagaataggcnccagcctggccaaaagggcgaaaccttgtctctattcaaaatacaaaaatnagctggatgtggtggtgcacagctgtaatcccagctactcggggggctgaggcacaagaatcacttgaacctgggaggcagaggttgcagtgaatggagactgtgccactgcactccagcctgggcgacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtaga

SEQ ID NO: 629948 - DNA, 604 bp, Homo sapiens
agcggatgctgtatggcagaccatgctgatgtgcgtgatgagcggcagtcaggtgacaagtatcttgggaaacgcagttcaagctctatcacgaattagtgacgagttctggctagacccatctaaaaaaggtcttgctctaagatgtgtgaattcttctcggtcagcatatggatgtgtcctgtcctctcctgtgtttgatcagcatcatcaatggtcagctttagtgcaaaatgagtgaaaatgaacttgagacaacactgcatttaggaatgcaaatctgggaatttgaagtcaagttttgccccatcttgtagatgtctgaattacccttgaatagaagatatagagaagtgcctgaatattcagccagatctgataacactgcacaagtagcttaccttcaactttcttctaacatgacactggtattaagataggaactcataagtatatgtcttctcaggaaacgtcaggcctttgcaagcttagtttgtgtggacaagaatggtttggtactaagtacggctaaattgatttcaacccaacggattgctctgcctgaatgtccatatgcttcctttcatgaaccactcaaggtcaa

SEQ ID NO: 629949 - DNA, 521 bp, Homo sapiens
acgacggcagtgcaagctgtcatccttgctaggtgatcccatagaggatccccagaggttcaggctttcgcttcgaagctcctgaaccttatgatcccgccacagcctcccaagagtgttgggattacaggtcatgagcctctgcactcggtctgtgagttacttatttgtctcgtgtattatctgtctcatccccactataaagtcagctccatgtaaggcaggtgaattgtatgtctacttcgttccctgttgtctccaaagtgtctataacagagcttagggcctgtgtggtcctcatctatcagtaacagaatgaatgaacatcagacaaggagagagggctctgaaacacaaactcacagtcagcacactctggttcagaactgttcaatggacttccaatcgcacttgaagtacaggatgagatctcttactgaggcctatgtcaggccttgcctgatctggcccctgcgcacctctctggcttccccttgaaccaggctcactctctgagcagc

SEQ ID NO: 629950 - DNA, 103 bp, Homo sapiens
aagtaaggtagggatatgtactcgcctgatagcggacgcctgatgctttgagctcggcactaatcacggccacatgagggaagtgctgtgtcacaatggctca

SEQ ID NO: 629951 - DNA, 130 bp, Homo sapiens
ggtttttcggaggatctctctccgcgccgatcctatgttctagtccacacagttctgagctacaggcacggcgcggatgggagtccctggacgggtttaaaagagtacttttgtagcatgttagacgtca

SEQ ID NO: 629952 - DNA, 1058 bp, Homo sapiens
  misc_feature (401)..(401): n is a, c, g, or t
  misc_feature (544)..(544): n is a, c, g, or t
  misc_feature (557)..(557): n is a, c, g, or t
  misc_feature (631)..(631): n is a, c, g, or t
  misc_feature (633)..(633): n is a, c, g, or t
gctaaaaccaagtctcccaactcctaaccatgggatggatgggagaggcaccccgagtctgatgtttctgctggggtgatcctccaccccactgatttagaggctgtgggagggtctggggcagggtgctgggaagcctgccaggctcagcttgcagccctccagccagagctcttcctgtggccccactcacagaagggcattacctgctagttagcatagcctcccaccttctggggttgttatggaaaccaaacctggaggggaagggaggaagggcagagaggagggtggcaattcctgcagtcactaacggcgtgggcttcaccatctcaagataagggaggggcaggaagaaggcttccctgcagtggggctggtgatgggataggattctcaancaccaccctttgctctttctgcccctgtctgctgtccagctgtctgcctctggccagcagcttagccatcactgaaggagcagactggcttggaggagggtttgccagcctgagaggggcaaagctctgacccctcacgtgancccaacttgccanctctgcaactggccctgtgtcataccaagcattcctccagccctgcacactcagaggaccaaaagaggctcagngnggatctgggtagaataaaagaggcagtagcacaccaagtcagcaaatggtcccagacattccacagccttaccctgtaagtcctctttttaagacttcctctaactcatgattgtctcccaaggaagaacaacggccaccagtggaatcctataccagccatcaggtggttggaagcatggccggagaccagagtatggccacctaatacggaatagagggccaggacctggaaaccatgcatagaggacgaaagaatgaggcacaactgtcagacacggagcccgcaggagaagtacccgtgacgggacagggagacacaccacaaagggcagtccggggcacaggaacagctatagcacagcacgagcgacaacaagcgaacgacagaaccagcaaggaaacacataggggccacgacaagca

SEQ ID NO: 629953 - DNA, 498 bp, Homo sapiens
caactgcaacactgtcctgtctggagaaggcaagtaggttgtatggcagacgttcattttaagaacaacctgactggccaggtgcagtggcgcagtgcctgtaatcccagcactttgggaggctgtggcgggcaagtcacctgaggtcaggagttcaagaccagtctggccaacatggtgaaaccccgtctctactaaaaatacaaaaactagccaggcgtggtggcgggtacctgtaatctcagctactcaggaggctgagtcagggaattccttgaacccaggaggcagaggttgcagtgagccgagatcgcgccactgtactccagcctgggcgactgagcaacacttgtctcaaaaaaaaaaaaaaaaaaaaaacaaacttcaattttgcccaatcccccttgtattggggaccctaaattaggggtttaatttcggggggtttatttccctcttctgattctggtgaaccaaaagcggttttgggaactttct

SEQ ID NO: 629954 - DNA, 400 bp, Homo sapiens
ggtgtctatagagattatcatctgctgagggtaggcagagggagtagagcagacactcaggaggtgatatgagattatcatccgctgagggtaggaaggggagtagagcacacactcgagaggtgtcttgagattatcatccgctgagggtggaaggggagtgcgcacacactacgggaaggtgtcttgagattcatcataccgctgagggtaggaaagggagtgagcagacactacggagaggtgtcttgagactacagggagtaatacagaaatagaatgttgttaagtaaggaggaggtggctggtggcccatcctagtattaatcaagtaacagctgtgaggtaacgggccagtaggagcaaacctgaagaatgacgatactccgctaccgacatt

SEQ ID NO: 629955 - DNA, 142 bp, Homo sapiens
tgggagctggctgtgcactggcagtcctgcgtgtccagatagctgaatcatgcccggagtggaagctgaagcctgcacagtgtccaccgtgttccactcccatctttcttccgggacaatgaaataaagagttacctccagc

SEQ ID NO: 629956 - DNA, 698 bp, Homo sapiens
  misc_feature (44)..(44): n is a, c, g, or t
  misc_feature (62)..(64): n is a, c, g, or t
  misc_feature (123)..(123): n is a, c, g, or t
  misc_feature (127)..(127): n is a, c, g, or t
  misc_feature (194)..(194): n is a, c, g, or t
  misc_feature (255)..(255): n is a, c, g, or t
  misc_feature (268)..(268): n is a, c, g, or t
  misc_feature (288)..(289): n is a, c, g, or t
  misc_feature (292)..(292): n is a, c, g, or t
  misc_feature (303)..(303): n is a, c, g, or t
  misc_feature (305)..(305): n is a, c, g, or t
  misc_feature (317)..(317): n is a, c, g, or t
  misc_feature (332)..(333): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (354)..(354): n is a, c, g, or t
  misc_feature (362)..(362): n is a, c, g, or t
  misc_feature (365)..(365): n is a, c, g, or t
  misc_feature (371)..(372): n is a, c, g, or t
  misc_feature (390)..(390): n is a, c, g, or t
  misc_feature (396)..(396): n is a, c, g, or t
  misc_feature (398)..(399): n is a, c, g, or t
  misc_feature (417)..(417): n is a, c, g, or t
  misc_feature (447)..(447): n is a, c, g, or t
  misc_feature (466)..(466): n is a, c, g, or t
  misc_feature (469)..(469): n is a, c, g, or t
  misc_feature (488)..(489): n is a, c, g, or t
  misc_feature (491)..(491): n is a, c, g, or t
  misc_feature (503)..(503): n is a, c, g, or t
  misc_feature (514)..(514): n is a, c, g, or t
  misc_feature (526)..(526): n is a, c, g, or t
  misc_feature (534)..(535): n is a, c, g, or t
  misc_feature (538)..(542): n is a, c, g, or t
  misc_feature (546)..(547): n is a, c, g, or t
  misc_feature (550)..(550): n is a, c, g, or t
  misc_feature (552)..(552): n is a, c, g, or t
  misc_feature (554)..(555): n is a, c, g, or t
  misc_feature (557)..(557): n is a, c, g, or t
  misc_feature (560)..(560): n is a, c, g, or t
  misc_feature (611)..(611): n is a, c, g, or t
  misc_feature (619)..(619): n is a, c, g, or t
  misc_feature (626)..(627): n is a, c, g, or t
  misc_feature (629)..(629): n is a, c, g, or t
  misc_feature (691)..(691): n is a, c, g, or t
tttcagataaaaataaaatgacaagagcacatacgaatattggnattattcattgagctatnnncggcgttagaaggggggggggcttttggtgtatttgggtccgacctccttctgtatgcngggntcacttctggatgtctctcgtttctttcttcggggggtggttttccagggggttcccggcctcctcngatctttcccaagtttgttgcacttcacctcttagaaataatgtatatatatttatttttnttttttttttttngggggggggtcttgctctgnngtncgtggttgggngnggcggcgtggtnggggcgcgcggcggnngcgncncgnccgggcgcgggngttcctcncgnctcggnntcccgggtggctggggtngcgggngnncgtctcccctctcgggtnttttttttttctctctgttgtgatgctgtnttgcggtgcggtgcatgcnggnctcagacttgtaggctcanntnatcctcctgccncggcctcccantttgctaaaaanaaaagaannaannnnngtgnnttngngnngnctntttttaatcattaaaaaaaaaaaaaaaaaataaggcaggccggcttctctntttttttnttttttnngnaaggtctcatccttgaagcagctttgttatatgcagagcacagtactggcttcaaaaaatanataaagg

SEQ ID NO: 629957 - DNA, 1174 bp, Homo sapiens
ggagagaactagtctcacggttttttgttttttgttgttgttgtagatcacagttttttattcttaaggtcccaagcgggagaaaaatctcacattcatactaaaaatttccaacataaactcaacgggaatgtgaagctctcatatttgggtaagtggaaagctcccagccctccgcgggggcgcggtccaggtggtggtgtacgggtacacattccacacctcactcttcactcgagggttccccggaaccgggcgtggtccgtgccgtggggaacacgtggaggataaacaagccctcgagggtcacggaccacatagggaggggtcatacacttatacaatagagggtccgaggataaaagcctggagtggcataggcgccgagggccgcaacccgagaacccctctccatatcggataaccgagggatattaagaggcctggagagggttcaaccttccctctcgcgctcaggcggtgccaccacgccgagacccgagggatattacacccacctcggcgcgcctcgagggtccacaagaggcggggggcgacgggggggccacgccggggtaaaaccagttctataacgagtcccacaatatattttgaaaataacaaaaatagaaagaaattaacagcagtatagccccaaatttacaccgaggtgggccaagcaaagaggaggcactcaaaggatcccccccagggggaaaaaggcgtggcacggagggggaaccgggcatctttgggagggccccctctttttctgtgggggcgcccaaagggcgatataaaccatattaaacgataaataccgagcgcataaaaatctcccatagggtttaaaatacggcccattataaataccggtggtaaaccgcacccttcatattggaaaccccaaaggcttggacacggggaacttttctaaaaagggggcgcacttttaagcgctataaaattcacgacaaaacataacaacgtccttgggtgttaaacaacaaagcggttttaaacaaatcgtgttcaacactctgtcatcaatgtgaaacaacacacaggggaattttcaataggtattcttcccccaacaagagagggtggtgggcggggttgaacaaccgacaaagggaggctagtggggccccggggggctaacaagtgggga

SEQ ID NO: 629958 - DNA, 256 bp, Homo sapiens
ctggcccagagtcccacctgggggatctctccacccttctcagagttctagtttcaagcagagtaccaaccaatgggctccatcctctggattctggtcaatggaaatatctccctggcagggtcctcttctttgcccagagatccaccccaaccaggggcttttagttaatgggggagttccaggaaaatcgggggttggggtttggcttcaaggaaaggggataattaaaggattggggggccttaccatccca

SEQ ID NO: 629959 - DNA, 614 bp, Homo sapiens
ccctagacccaccagatacgcgtgtgcataggctatacctggagccaacctggttggcagcacccccacgcctggcaaggccaccccgcttctatgaggcgggtgaggagctaactggacccggggccgtggccgctgcccgcctctacggtctggaacctagctcacccacttgactctacaggcgcttggctcctcacaccaccacctgctgcggccccgggaacccctcaccttctcagcaagaccccaccgggagccctataaggagggcaccagctccgcttgtgcccgccccccggcccagttccccaccataggggaccctggcccagcatcgggcatgacaggtgaggggaacggggaggggagtcggggcacagctccatctaccccttccttaacccaggtccaagggctgaggttttccgccagggcctgccagggccaaggtcatacacctcaccagccacctctgcaggtcatggcaacctgggcaaccagcacgcctcaaagaccacacagcaccaggccatcacatggcgtgaaagggtcactagggagagccaaggtcaacagcctctagaggaagggagcaggggcgtgtgcatagg

SEQ ID NO: 629960 - DNA, 424 bp, Homo sapiens
  misc_feature (9)..(9): n is a, c, g, or t
  misc_feature (38)..(38): n is a, c, g, or t
  misc_feature (110)..(110): n is a, c, g, or t
  misc_feature (135)..(135): n is a, c, g, or t
  misc_feature (137)..(137): n is a, c, g, or t
  misc_feature (146)..(146): n is a, c, g, or t
cctggcccntatggcgtggaggctaatacgcaaaaccncgatccaggtggcggcggttccagcagcagcatagctatggcagtggcagaagaaattaggaaacaagcttngcaggagaggagagccgagaagtgncngggaagctncaggttacaacagatttgtgaactcagccaagcacagtggtggcgggcctagctgctacaagagacatgttttagacaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctttttttcc

SEQ ID NO: 629961 - DNA, 120 bp, Homo sapiens
ctctgaggatccccgtcccaacgatgcggaagtgatctccaggcgactttgaacccattatttggcagtgtccatattattaaactagtcaaaaatgctaaaataatttgggagcaattt

SEQ ID NO: 629962 - DNA, 221 bp, Homo sapiens
ctctagctcggtaccccatccagcttctgatcctccaccaaaatctgccgcagttgcttgtgggccttggaggagccaaacaacaccccatccggcacaatcaccgctgcccgacctcctggtttgagtaatcggagaaacaacgccagaaacagcagctccgtctttttagttttgacgatttgcagcaaatccttggctgtgttctcatagtccagtga

SEQ ID NO: 629963 - DNA, 339 bp, Homo sapiens
aaacccccaactttttttccccctttgttgaaagaaggggcggggggaagttcaaatttgggggttaccctgggcctcccattagggtttgaagagggccccttgttgggatttccccccggcccccttttaaaaaacccccgcctttttgtttgggggaaaaaaagggccgtggaatttaccccccttggcccccccccccccgggggtttttacaaaaatttttacccggtttaaagggggggttttataacaaaattgcggccttccccccgaggccttttcccccctagggttttccccatttagaagggatgaaaaaagtttttaaaactttta

SEQ ID NO: 629964 - DNA, 117 bp, Homo sapiens
cgcagtattactctccattttacgaggaggaaaagcaagcaatgtacccaagtcccacagttcccatgtgtcctaggtggaggtgctggtgggggagtcctctccattcttcagcag

SEQ ID NO: 629965 - DNA, 283 bp, Homo sapiens
gctcatgcctgtatagactttggggagcgccagaggcgcagaactgagcttgggagttccgagaccagcctgaccaacatgcagaaaccccgtttctactaaaaatacaaaaaattagctgggtgtggtggcgcatgcctgtaatcccagctacttgggaggctgaggcaggagaattgcttgaacctgggaggtggaggttgtggtgagctgagatcatgccattgcactccagcctgggcacaagagccaaattccatctcaaaaacaaacaaacaaacaa

SEQ ID NO: 629966 - DNA, 540 bp, Homo sapiens
atgtagagtctggacttctaaacatcatggactttgttccgaaaaagttctatgtgctgtgtggggtaggactcaccgagattggagcaagactcagtaccacgactgcagtgcccctgacccctggcctgtggggtgccctacacctgctgcatcaggaacacgacagaagttgtcaacaccatgtttggctacacaactatcgacaaggagcgtttcagtgtgcaggaatgtcatctacgtacggaggctgcaccaacgccgtgatcatctggttcatggacaactacaccatcatggcgggcatcctcctaggcatcctgcttccccagttccttgagggtgctagcttgaccgctgctgtaccattagaccgggtagagaacatcatcatggagcactctgtcactgatgggtcctggggcccggtgccaagcccagcgtgaagaccgcaggcacgggatgctgcttagtgctaacccaattagggcccagactgccatggaagctccaacaaagaccgtctgggatagcaactct

SEQ ID NO: 629967 - DNA, 894 bp, Homo sapiens
tattgtactgcttctgtggctcttcacagacctcacggagtgtgaccggagatgagtggcgatgaccactgtttttaaaggagaacgagagctcctggtggggccctcggggatggtctcagtgtcccatttgcagtctgtcaacagtgacagcgcagccctggtccgagatgcgtggtgagctttgtattgccttctgggtcagctttcgctgtgtctcctgtgtgtgttagaatccagagcccataggaagtgcaatgcgggatcctccgacaacgggtggagcagcctcttcgcggtcgctgcttggacgacagcagtcgctgtgattcgctgtagcaggggagttgttctgaacacaacttcctgagatagtccggcgcttgtcaagtgaggtgcttgattttccctttaagacacgtctgacagtatttacctcgtcactttccagaaccagaagcagtgacgaggaaggagatattgtggggtccgtttaacatcgatagaaacgcgcagggtggatgggccccggcgcggggttcttgacccagctcagctgctgagccacaaacgccctgggcgatgcacttggctttgcttgatctggacttcgctccgtccgttcctccttcatgacccggcgggtgaactaggaaaccgttggtgataaaagagcatccccacttaccgcaattcgtgtagacaccatttgttaatgtgggagccgactgtgacagtcctgccagggctcaacgtgtcatttcacagcttggcgtacctagtcgactctagacaggatggtacttcgagagcttagggatcggcttgttgaatttacctttcagtgggcatcctaccgctgtgcatcgcatggcggaaacggcaggcatgccc

SEQ ID NO: 629968 - DNA, 161 bp, Homo sapiens
agtgatactgctggaaaaacaaaacgtttatgtatcacaatacttttaaaagtatctagccaagatttctgtaactagattatgtgtaaacttttctaaatcttgtaggagtgtcggtggtaaagaactagagcttattcctataccaaatctaccgtgcg

SEQ ID NO: 629969 - DNA, 509 bp, Homo sapiens
ctccgccttgagccccctcgctgtccgacgttccgttccccctgcccgccttctcccgccaccgcccgccgccttccgcaggccgtttccaccgaggaaaaggacatcgcatcgtatgtccgctatccagaacctccactctttcgacccactttgctgactgcaagctaacgggctgactgaaccgtggcttcctgctggcacctgacggagcttactactcacactactaacgaacttcaaacatgacgcacaaacccggcccagcggaaagcaccccttacctactgatccaagggcactcgctgactgactctaccgataacaacagaaacctagctgaagggcgctaccaacccacacaaaagcttcgacctgcaacacgacgctaaccgtggcctccaaccccacaccgaacgcaccaaacattcaccggacgccacacataagcttggggcaacccatagcgctacaactcttcaaagccactacccagtggggcccactac

SEQ ID NO: 629970 - DNA, 247 bp, Homo sapiens
agtatctcactgtgtagccaggctggtctcacactcctgggctcaagtagtcctcttctcttggcctcccaaagtgctggaatataggcgtgagccacactgtacctggcctaagtactttttttggctgggggggacggagtttcgctcttgttgcccaggttgcagtgcaatggcgtgatctcggctcaccgcaacctccacctccggggtacaagcgattctcttgcctcagcctcctgagtag

SEQ ID NO: 629971 - DNA, 233 bp, Homo sapiens
cgactctgaggatccccgtccttcatcatacctaccttgaactctgttatgtgaactgcgctggtcttacactatattcctggaataaacctttcaaatgccttctgctattatcccaagtgtctttatcattactgtatgtgccagaataatggtaatccacagttttgagtgtttaccctgtgccatgcaccattgccaagtgcattgtgtggtaagtatgatgaaggacg

SEQ ID NO: 629972 - DNA, 254 bp, Homo sapiens
  misc_feature (30)..(30): n is a, c, g, or t
  misc_feature (48)..(48): n is a, c, g, or t
tagtgaagcgcacacctaggagcaggggtngggaagtgagacggctgntcaacagcatcgtcctcattcacacagcccgatcctacaagcagctcagccggatatgccaggccctgaagctcagcagcatagggtgtaagatttcaacaaacgggttcatttctaaggatccactcatagtgggtatgattatctcatgttcaaagaaggaattaaataagctacccgtgcccatttaaacctgattcaggcag

SEQ ID NO: 629973 - DNA, 450 bp, Homo sapiens
aaggacctaggtgcggtgactcacacctgtaatcctagcactctgggaggcctaggtaggtggattacctgaggtcaggagtacaaggccaacctggccaacatggcgaaaccccatctctactaaaaatacaaaacaactggccaggctttgtgaactgtgcctgtaatcccagatacttgggaggctgaggcaggagaattgcttgaacccaggaggtggaggttgcagtgggccgagatcgcgccactgcactccagcctgggcaacagagcaagactctgtctcaaaaaaaaaaaaaaaaggaaaagaaagcccaatttagcccagtgttctcccaaagttgggccatgtgattgggcccaaagctgatatcctcaagggccgggggaacagtgagttagattagtggccaaggtgctattcctacagagggcagagcttatcctt

SEQ ID NO: 629974 - DNA, 326 bp, Homo sapiens
ttttaacaataactgtttgtaacattatgtttgtgtcaacttagagtgtcacttgtctgtatacaggtaaacactgggaccagttccggggttaatgaattaatttttgttttgtaatatttcacagtgaaaagaatcaaagtaattgtaatggctagaagagacctgccagaagattaaaaaaaaagaatgagagaaaagcccagttagtggtgtgcggacttacttcctttaaatgtcccatggatgtaggacagtgccatgtttcaagatgcctgtgagctaggtcttcaagatttatagaatgttacttatgataccgcgaa

SEQ ID NO: 629975 - DNA, 182 bp, Homo sapiens
agaggagttcaaaagtgcctcttctatatctacctgttaaaaacctctaaccctcatggtagctgcatccgtgaaaccctgtaggagtgactcgaagaagacgaaaaagaaaaagaagaagcatcgaaagagcagttcagctcgtgatgatgaagaaaagaagcatgaaaaattgaacgcgg

SEQ ID NO: 629976 - DNA, 180 bp, Homo sapiens
aggtactctataatatgtttcttcaagtactacattatttcctcttggggaaattgatgggagatgattatattcttgcagtttttttttttccctctcaccatggtttctaggatgggtgatagtcccctgttcaaaatctttaatgcactcagtaatttttgggaaggctttccagac

SEQ ID NO: 629977 - DNA, 141 bp, Homo sapiens
taggagcgttcccctggatccaattagggatgaatttattggaaactgggcttgggtcattgtggagctggtttatttttggctcaaacttacgcccctgcaatccagcctgggcgacaaagcgagattccatttcgaaga

SEQ ID NO: 629978 - DNA, 276 bp, Homo sapiens
actgctctatttgttccttctccatgtatcccttccttaggcattctacctgaaaaggacagccctcccttccttcttcatcccattggcaattcagcaaaccttaaccttctcttgcttataccacgaggttacttactactcgaacagcttgtcttcagacattaacacgctgtgtcctctgtcacgtgtacagccaggtctcaacagagcctgagacaaatggtcaactggagggcagacttgagatgtacgactctaactgactgttttact

SEQ ID NO: 629979 - DNA, 252 bp, Homo sapiens
aagcgcaggaccaagtgcagagtggactctcctggatgatgtagtcagacagagtgagtccattctttgcagtctggtcctgcgcttgagggggggtgtctaagtttccccttttaaggttcgaacaaatttcattggcacttgcctttcaataaagtcgtgggcatccccgaaaaaagagtatgccataagaaagaaaaggaaacactgttgcgcgcggctggagcggcctagaaaggagttggaaaggac

SEQ ID NO: 629980 - DNA, 1775 bp, Homo sapiens
  misc_feature (419)..(419): n is a, c, g, or t
  misc_feature (1046)..(1046): n is a, c, g, or t
gtaagatcgaggtcttgctgagagatgcgcgccaccagtgtgagtacatagtgtagggattcgttgtggcatcggccatcatgctcatggcctacgtgctgcgtctgatttatctcttagatcagtcataatgctctgaaacacgcttgacaactactatctggcagaaactatactcgcctgtaacgatgaagcactagcaggctggatgtagcagggaaaatcttccgttgtggcactgtgatgtacatcaatagtgcatcgcatgcacggcatcatatacgttacagtcgagttcgcagcgatacataaattcttggataatccggcaaatcacctacgtggaggtcctatcagttatctcctaaaagacctagtcctcctggcaacgttaacattgtgaatgtggtggtatcggngtaatgcatgttgccattgttgcgtggttagtaatcaacagtatgtaacctaagcgcatgtttaatggagttgattgatgtgggaggcaaaagaggaatccgtaaatagagatattttcctgatgcaattagtgtgctagatgtggagggagcatgtcgttataacacgtgagtggggttagttcacgcttgtggattctaccagtcattagtctttacagcatgtttccaaatttaatgtataatcaaaaaaggtctcatcaaggagtgaaagcagggccacttggagctggcagaaggagaagaggggccctggtacccgttagcgtaagggaactgggcaaggcgagagtccaagtctgtcacatttcttggtgccattggccgccgctgacatcaagggcgcgcacccccaggcgccgacagccgcgggggaagaaggcgagaacggcgcgcaaagccatggagagtcacatagaattggcaccgcccgcggtcatctaggacacaacccggcggaggacaagcggcgcgccccctctccagcagcagacacgcgccgcaccatcaccatcacattagcttcttctgctctctttgcttgccgcatgcaagctgaacaaccanccgcaccagacgaccagacatacgagacgacaaaccaatcacacacacagaacactacacatcacacacatgcgaaagcaacagacaccactggcacctcgacaacacaacagaccacacaaacgaacagacgaccacaacacacaacaacagccagacacaaacgcaggaggagagggagaggggaggagacgaagggaggagagagtgaaggaagaagtgcggacggagaagacaacgcggccacacagaagagaggagaggagtcaagcacggagggcagacagaaggagaagatagccaagacaggggagaagagagcgccagacagccaagacagccaggagaggcgaagaagacagcgccaggcacaagcagagagagcacacagcacgcgcaagcaacgaagaacgaggaggagcaacgcagaagcagagaacagacgaggacagagaaacgagcacaaggggagaagagacagagaagagacggagagaccggaggaaagacacacgagaggcggagcacgacacaagacagaccacaggagcaaaaagagacaaagaacagccaaggcacagcaaagcgcagggcgagagcgagcagagaggagaaagaagagacagagaacagcagagcacagcggagcagacacgagagaggaagaacaaagcaggcgacacaacaggcgcaagacaccagaacagaccgagtacagaagagcgcgcg

SEQ ID NO: 629981 - DNA, 1120 bp, Homo sapiens
  misc_feature (535)..(535): n is a, c, g, or t
ccacgcgtcgctcagtttttaacacattgttgaagaaaaggtaccagctttggaacgagatgctatactaataagcaagtgtaaaaaaaagaaaaaaaagaggaagaaaatcttaagtgattggatgctgttgttcttttaaaaaaaaaaaataagaattacattttcttggggttagagctagagagaatggccccaagcttctatggtttcttctaaattcttaattggcgttaaagtatagagtatgtgtcacttaacccggtggcttctggtgtaactggtggtaaattaaaaatggggtaagtaactggtgtaacctaaatctaacctccatgggatgtgttgtaaaagcgccatcatgggggaggtctcaaaatctctcaatcatcacagtggttcctctcaaactctctgtgttttaaaaaaagctctcaaaaaatttgtgggcccatactatggctaaaagtgccccagtgtggtgacacacacctaaaagacaattatatgggtcacacaacaccaaaagcgactnttgtgcgacataaactttacagagtgtgggcaaaagcacaaacacggggtgtttacaggcatacccactcgtggtctccgtgggaactctgcgggggccaagtttacagagcaccctcacttgttaaagaaactctttgagggagcgtgtaggacctcccaattaatgatttttaagaactgacaacacacagcgatgggagaagcggagcatgtgcgcccccataagtgtcatcaccaccacgaggggtccccccagaacaaacatgagggggatcaccaacacggcaaaataacattggagggacagcgaccaccggtctggacatgctggtgggcaaacacctaccgtgcagcccacgggggcaaaattagcgggaccccgataagataagaataactagggggaaaaagctccgtgtggaaaggagaactcttgtaagacagggtgtcggggcaaaacattaagagacaaaagctaatagtaagggggcggcaacgcaaacacacgaagaaagtgcgccccaacatcaacaaaaatttggacgcgagccaaacgccgtggtggaggaacacgcccccgcac

SEQ ID NO: 629982 - DNA, 349 bp, Homo sapiens
cacggtaatttgcccaggtgataaaatatgtatgtacaacaaacccccgtgaaaacgtttacctatgtaacaaaccttcacatgtaccaccaaacctaaaataaaagtttaaaaaagaaataggctgggcaccgtggctcacacctgtaatcccagcactttgggaggccgaggcgggcagatcacttgaggccaggagttcgaggctgcagtgagctatgattgcaccactggactccagcctgggcgacagccacaccctgtcttcaaaagaaaaaaatctatttgtatatatattcttcttattttaaaagaagttttaaaaatacgtatatctttatactttata

SEQ ID NO: 629983 - DNA, 195 bp, Homo sapiens
agcgtgaaactccatcctcccccctgaaaaaaataaaaacataaagggacaagctgggcacattagtgctcacctgcagtcccagctacttgggaggctgaggtgggaggattgtctgaggtcattagttcaaagctgaagtgtactatgatctcacctgtgaacagccattgcactccggccagccattgcact

SEQ ID NO: 629984 - DNA, 259 bp, Homo sapiens
ctctcctcctactttgtgtacctgctgataaggacgcggtgaacgagtcacgccgcgttgatgttcggccgctacgccgattcgctgtgtttcggggttgtcacagtcacctatccatctggctatagaggacgaggttgcccccaggacagttgctcgggtatagaccattctcctcctgtcttctctagtctttgccatctgccttctttagcgctcccagacggggcacttcttgtgctcccgggtttagccctag

SEQ ID NO: 629985 - DNA, 269 bp, Homo sapiens
  misc_feature (189)..(189): n is a, c, g, or t
atatgtttggtgaggcacagtggcttatgccagtaattccattattttgggaagctgaagtgagagaattacatcagccccgggagtttgagaccagcctgcaataatatggggagatccccttctgtaaaaaactaaaaatgtggcccgggcatggtggcacgtgctggtggtcccagctgctccggnagatggaggcaggaggatcgcttgagcccagaagttcttgaggctatggtgagcctgggcgagagtgagaccctgtctca

SEQ ID NO: 629986 - DNA, 390 bp, Homo sapiens
tttgatacgcggctctagagaggaaagtagctgggtacagactttgtttactcacccagtgaccaaatcctggccgtctgtttaggtcgttggtgtgtttgcaccagacacaatcgcagcctctgtgtgacctcagctcagcacacgacagccacagacgtgttacacatatgtgatgggaagggaggtgctgctgagatgttgtgtgtttgcaccagacacaatcgcagcttctgcgtgacctcagctcagcacacgacagccacagacgtgttacacatatgtgatgggaagggaggtgctgctgagatgctgttgtgtgtttgcaccagacacaatcgcagcttctgcgtgacctcagctcagcacacgacagccgcgtagtcagat

SEQ ID NO: 629987 - DNA, 146 bp, Homo sapiens
ttcattagcacacttgctgcctggggagtacactaccctacccttactaagtctattcaggaataactagagaattatgtgatgagatgtaggcaaaaatcgtaatatcataaagaggactcatactgctattgaaacttctaaaa

SEQ ID NO: 629988 - DNA, 113 bp, Homo sapiens
tggtagttgcgcaccttgtaatcagctactcgggaggctgaggcagacaatggcttgaacccgagagagggagggattacagggtggcatcgataaacaccgggtaccgagct

SEQ ID NO: 629989 - DNA, 510 bp, Homo sapiens
ccaggcggccgtcgcttcccagcagcggagcagcgcagcgtcggacatgttgtgaggcggcggcgcgggtgtctgaaggatggtttggccgaggcgcggcacacggctgctggcggcggcggcaggcagcgcgtgcctcgggctctatagagcggacccgcgtggttacccgccggttaccgcggggagccagttgcccctggatccttggtctgctccgacgccgtttgtgaccagtttaggcgacacgcccgcccctctgaggagacacgaaggtggttcctcagccgctcaaatttccggaccaccgcgctttcccctcctcagcctgggctgtgctctctctagaatcctcgggcccccactttcttcccaaactcatcctagatctctcacacacgcgagtttcccagccctcaagccagctgctcctccgttcattttctgcacctcttcgcaagcaccccacggatcactctccgagggcgactttttgagaaatctcggtgg

SEQ ID NO: 629990 - DNA, 396 bp, Homo sapiens
actgcagcctcaatcttccaggctcaagaaatctccccacctcagcttccagagtagctgggactacaggtgcatgccacacccagataatttttttttccccaatataaacgaggtcttgctatgtcctccagtctggtcttgaactcaaggtgggaggatcacctgaggtcaagagttcaagaccagcctgaccaacatggagaaaccccatctctacttaaaaaaaaaaaaatacaaaattagccaggcatggtggtgggcacctgtaatcccagctactcgggagactgaggcaggagattctcttgaacctgggaggcagaggttgcggtgagccgagatcgtgccattgcactccagcctgggcaacaagagcaaaactccatctcaaaa

SEQ ID NO: 629991 - DNA, 349 bp, Homo sapiens
agttcatgtcctttgtagggacatggatgaaattggaaatcatcattctcagtaaactatcgcaagaacaaaaagccaaacaccgcatattctcactcctaggtgggaattgaacaatgagatcacatggacacagggaggggaatatcacactctggggactgttgtggggtgggtctatggaatgttctaactccttttttgtgattttgacaatgttcacatcatgtttaccccaagtatattacatattatgcattcactaactcttaagactcttgatatataacacctgggttagattacatagatttataatactgcaagaaattgagccaccactttgtaa

SEQ ID NO: 629992 - DNA, 567 bp, Homo sapiens
gaaaaaaggagagaatgctacttaacaggttcagcgatagcctaatagtagaattaggtacttaatctgggttctcaaggatgaatccgtatttgaccagaaggaaagtgaaagtaaagggtagtataagcgaaagaaacagcaaatgaaaaacaaacttgagttgggatgtagcctatgaaggatggaggataggaggtgagtctagcactagacaaggagcagttcattatagccttgtgtgccttgcaaaggatcttggaacttattctgtagtcagtgagtcaggagggaagggtcatagaaagaaccagtcagaatgctatttgataaaatataagtaggagttcaagaccagactgggcaacacagtgaagccccatctctacaaaaaaatttaaaaattagcaaggtgtagtggcatgtacctggttgtagtaatcccagctacccaggctgatgcaggaggattgcttgagcccaggaatttgaggaatttgatacagtgagctatgatcgtatctacactccagcctgggtgacagaatgagacactgtatctattta

SEQ ID NO: 629993 - DNA, 177 bp, Homo sapiens
gttcctctcgggctcttaggcgctgctctaagcagcttcaccctttacaccagaaagctggcgggcactatggggaaaaacaaaacaggagaaagtggaggaggtctagagaggaggaagaggatatgtggtggaaaagttctcgaccgtcgagtggtaaagggcaaagtggagtac

SEQ ID NO: 629994 - DNA, 195 bp, Homo sapiens
tatagtacgcatgtcacattcttttggcgttatattatcatgctccaccatgagtaactagatatagttcccagtgctatacagcaggatctcattgcttatgcattctaaaggcaatagtttacatctgttaaccccaaattcccaatccatcccactccctcctcctcccccttggcaaccataagtctgttc

SEQ ID NO: 629995 - DNA, 603 bp, Homo sapiens
  misc_feature (109)..(109): n is a, c, g, or t
  misc_feature (280)..(280): n is a, c, g, or t
  misc_feature (416)..(416): n is a, c, g, or t
  misc_feature (577)..(577): n is a, c, g, or t
taacttttatagccaacaataagtgccaacattactacttgagacataacagtactgagatatattccccaagttttatggaaattgaaatcaattttttaaaactaancatatctaaatgattttagggttaaagaacttgaaataaggacatgatcaattaaaaccaaaataatgataaccactactatttattgaaaacttgtaatgcattgagaactgtacctaagattttatattaattctttcatttaatcctcccaccaatctcaagcaatangaactattcttgttattttcttgaggatgaaacacatgagatctagagaggtaggtaatgtgccaaggtgtgacacacacaaagtggatggtgtaactataattcaagcccgagaacctacctccaaaacccacangtagtaccttcctgacacctgctgctgtagtttcaaatcatactgaaaagaatgtatttggtattataacccattgaacaaacttaactgtttttaattcccaactctaaatgtaccccatctatatttttgagggggcaaccaatttcaatccaaataangcctcttccaatagtcaccggactat

SEQ ID NO: 629996 - DNA, 911 bp, Homo sapiens
tgatgtgtaccggttaatgaccgagtgcatagcaagcctgcatagatgaaactcgcaagtgtcacagctattctggagagttaataagctgtggacatttttctggcgagataataatgggaagctagaatagcatttgcgcaatcatcataacatgctctgttcaacctgtttcataattagtggatcatagtccagagtgaaggattcatgacttgctgactcccgtcaaaggctcagatgctggcagtctgtgctcccagggacacttgagtgtccgtccattggccatcggccctgagactgtgatgtgcttcggtattccttcacctaggttataaaggcagagactgactttcataactgagtccatagggagtcgttcttcaaataggtgcacggaattggcatgcgcgttaaagataggatgaccagaatgcaatggttaataacacatgagtgtggggaatgtctatcccacgcgaggaaacgttattggtaacacaaatggaacgtatagcattagttgaagggtagtacccaaggtttgaaaagaagtgttgtaagtgttttgtggcaattggaaaaattaggccagttagaaaagcgcaaagggtgtttgggatgaaccagattgttgggggggatacacaattctcggttaaagtacatgcgaaaaagtggggaattggggtactgttctgacaaacttggtttttgtgctggacaaaaatgggaataaccacgtcaggggacttggagcatcgtgcaggcggcccaagatggaggggtatctatttctggaaaagttgggtgtgaactgtaacagtgacagttttaaaagtggtgcgaaccaaatgacggaaattcgggcgttataagaatagggaaactatggagagaaaaattag

SEQ ID NO: 629997 - DNA, 477 bp, Homo sapiens
ctcttctgctttgacaaggaaaatgacattggggaggggaggtcgccgcctcccagcttttctcaaattgttcctatagatactggtattctggaaatgaagaagtaattctgtctctgcacctactcttgcggaatgttcaaggaagtattctgtgttagtatttatgccaaaaagttgtttttaaaggttttgtactcagcacatcatacaaaccacctttcttctgtcacttcagggcctcggggaacttggcgccccttttttttgctttttttatccgggttaccattggccaggtggttccccttgtttgctgtgtttaccatgtgtataccgtccggaggtatttaggcctttagtagttccacctgcggacctttgaggggggatgctgatgtctttgcccaaccccacggcctgtctcttctcttgtttagttatttccggcaataaatcatctatgagttagtgcaa

SEQ ID NO: 629998 - DNA, 128 bp, Homo sapiens
ggtctgtcatgatgacagccaaagactttctctcaaccgcactgccttcttacacacgcgccccagaacggtgcccagcgttggcctgcgtttgagcgcttctctttctgtctccatgcccctcccag

SEQ ID NO: 629999 - DNA, 107 bp, Homo sapiens
  misc_feature (107)..(107): n is a, c, g, or t
gccaggattcccgatccagagacaatcggccccgatgggcatggagcccgaaggcagtcaatcgcagaagtaacctcggcaatatccgatatgtttgacagactttn

SEQ ID NO: 630000 - DNA, 145 bp, Homo sapiens
ttcctgcattctgccccaacgcactgaacacagtccggctcttctaaacactgagcacggacctcccccatacgccacccccacatgggttctcttgtttcccaagttcctgacttgatacaacgcctgacgttcacacattcac

SEQ ID NO: 630001 - DNA, 914 bp, Homo sapiens
gcaccggagaatttgggattctcagggatgggttcgattctcatagtcctagccaaaaaaaaaaaaaaaaaaaacaaaaaaaaaactttggggaggacagaggccaccccggacaacactaaataagaaacaccctcgcgtaggcacagccgggaccccccaacggcggacagggcgcacaagtgggccaacagcgggtgtaccccacgagcaaaccacacgggaaaacagcaaccagagcgcaaggaaaaactacgcaccaaacaaagaaacaaacaaccgcacgcgcgggaaaaacaccgcgatcggtagcgccacaccacaactagcaaaaagaccaccagtgcgccgagaagaccaccaaccgaggggagacttaaaccaacaggatgagagtgaaacagaacgaaagccgacaaaaggatagagcaaaaaagaacccagcgagttgggtgggggggaaaaaaagcacgacacaacagagaaaaccacaaaaaagcacacaacaaaagaagaaacaacagagaaacaccaacacaagcaaacgcaggaacaacaagacgacggaggaggagaggaagcagcgggcgaccggagcagacgaggaaaggggaggcgggacagggcgaaggaagggacagaggcacgagaagaggcggagagcgagcgccggaaagcgcgagaggagcgcgaacgaggagagcacagagagggtcaagaggggcgacaaacgcaccgagcggaaccagtactagggcaaaggaagcggaaaaggagcaaaagagaacagcaagcaagccccagccggagggacgaacggccggagcgccagggagagccaacaggacaggacgggcagaaggagacgaagaccgagagagaggcgacaagacaagaggaaagccggagcgccg

SEQ ID NO: 630002 - DNA, 1476 bp, Homo sapiens
  misc_feature (601)..(601): n is a, c, g, or t
  misc_feature (1115)..(1115): n is a, c, g, or t
cccctttaatggggtattcacaaagcgaacacacgatgcggagttttttaggggtgaacccaccctattgtaggaaacccttccggtaaaggggatcccctcaccaacaagtgtgtgtggaacacgcaacaaaaaatatcgccacagggtcgtgtggtgttgaaataaacttggccgcctggcccccccacgtggtatacctcttatatttgacacccggggtttcctctataaagggggtataaatcccgggaaggcccccccttggggggttgggcgggagagttttcctggggccacctccgcgagggcgcatcttagtgctgtctctctcttcctgtcggtggcccaccgggcctgattggttgttctccccctcggggtgcttgtaaagtgagcccccccccccacggggtgttcccgcgctcgccccctattgggtgtgtggttatatatttggagcacttggagtctctgggcgtttccaccggaaaagatctctcttatgggcccgcccttagggccgctgcgcacaccgtggtcttctacacaagaggtggggcgccaccactcttgtgggggcttcacacaagcgtgtgtnttttgggggttcaactctagcggcacacgagagggccccccaccccccctctggagtgtttgggcgcacttttggggcgcgccctcagagcgcgctccctgctctctgttctgtagagccccgtcgagagagctctcggagacacactctgtcgtctctccccagcggcttctctctttgctctcgccctattaactctctttggggtgtttctggcgcgctttttctgtcgcggcgccccaccgcccgtcgagattctcggagaatgttgtcacgcaccgtcggcgcacccacagagagagagagctctctccccaccgcgtgggttcttctctagggggctctcacatgtgatatacacacgcacatcttttcgtggaggccccctgcgcgggagaagcagaaaacacacgctgggagagatctcaccacgcgcgctagagagccgctctatacactcttccacgcgctttggagatgagatctcgggagagcgctctggagagatgtgccnctctataggggagagatttctctctataaggtggccacactcccacgccacattatagatatattcccacatgagaaaaaatgggtccctcgcgctccacgcgcgctcgtttgatagaataaccactttctttctttaaggttataaaggggctcccacgctttggaggattctcgggctcacttctaccacggctgctaccactttctgtttgggagtataaacacacaacccacattggtggtctaatttcctcttggaattgggaggaattagaagacttctccgttggatgacagcgatgactggcttggttatggctgatccctgattggatgaaagaataaatctttggatggtt

SEQ ID NO: 630003 - DNA, 374 bp, Homo sapiens
  misc_feature (374)..(374): n is a, c, g, or t
atgagactgctaaaaaaggcgggaggtttttgtaaatgagactctgttaagaggatcgaagcaatcataagagacacacttttcccttctattaataaaaaattatacattgtgatcatataaatgccagcaattcatagagaagaacggtaaaactctccatgacctcacgaccaagagataggctagggatactatcttgatatctgcgagaggcatttaaccttttgagagtcacagatatctgtgcgaatctaatgaaagttatagggctccctgagcccataacatgaccacaattttattttttgagatggagtctcgctctgttgcccaggctggagtgcaatggctcaatcttggctcactgcaan

SEQ ID NO: 630004 - DNA, 273 bp, Homo sapiens
  misc_feature (224)..(224): n is a, c, g, or t
  misc_feature (273)..(273): n is a, c, g, or t
attttaattcaactttaattggactatagaaagattttataagcatacagtgattcacattcaaatgacctttttatttacattctccacaaaactgtttattttaaagttttaactcattaaaaatctatacatatatatgatgtatggatagggtctgggtttccccacaccatggattcatatatatatatatatatgcagattccagagaacaacctcanacgttctagccatcggtcagcatcaacctctacacaagtaagtcttcan

SEQ ID NO: 630005 - DNA, 234 bp, Homo sapiens
  misc_feature (85)..(85): n is a, c, g, or t
  misc_feature (143)..(143): n is a, c, g, or t
  misc_feature (145)..(145): n is a, c, g, or t
accccatataggggatccctgattctccagcatggtgtgtctgaggctccctggaggctccgcatggcagtttcctggaacaggntgtacactgatggtgctgagctcccactggctttggctggggacaccagaccacgttntntcgtttggggacgtactctacgtctgagtgtcatttcttcaatggcgacggattctttcttttcttttctttttttcctcccttttttc

SEQ ID NO: 630006 - DNA, 336 bp, Homo sapiens
  misc_feature (200)..(200): n is a, c, g, or t
  misc_feature (279)..(279): n is a, c, g, or t
  misc_feature (326)..(326): n is a, c, g, or t
tctagaatgtttagatcctatcttttaccacaactataaccacagcccaggtctctcaaactttagatcagggatgtccaatcttttagcttccctagtccacactggaaggaaaaaggaattgtcttggggccacatattaaaatacattaacaataggctggatgaggcattttaaaaaaaaaaatcacaaggaaaantcttcacaatgtttttaggggagttttaaaatttgtgctgggggccacattcaaggccgtccgggggggctggcatgcngggccacggggcttgcagggttagggacagctttgttggacagtttnattttccctt

SEQ ID NO: 630007 - DNA, 603 bp, Homo sapiens
tccatgtggccactttgtgccccgccggggatataatgcttgcctgggggggtgttttgggagcgcagcttaaggggcggtgacatgcgtgtgcccagctgggggtactcgacgcggttgtgtcgggggctcctcgcacagcggggtgctccccgagtcacagtggttctctgcgaggggtctcctcgtttcacgcctgtgtgttacaagccgcgcgtgtagccccccccgcccgttgtacctgtcggtggggaaaacgtgcatgtcgtagtctcggcccgccgtttttgcccgctaggtgcatatccgcgctcgctttccctggctcgccggttcttcattggctttggtggcgccgccgcgctctttgttggtcgtctcttgtacttttctgggtggcgccccccccccctcggtggtgctcacgctcgcctcccccccctcctcactttctcacccaaggtcacccctctttttcacactacgccaacccccctctaggttaaacccacgatatcccccattgtctccactctttttctcctctcttctccccggcaacacttatatacccgggttttctcctcccaacattaccaaaaa

SEQ ID NO: 630008 - DNA, 227 bp, Homo sapiens
  misc_feature (21)..(21): n is a, c, g, or t
  misc_feature (90)..(90): n is a, c, g, or t
  misc_feature (117)..(117): n is a, c, g, or t
  misc_feature (121)..(121): n is a, c, g, or t
tttaaatgataatcttattantgaagcatcagttagaataggtatactgttgtaggtacttatatgcacatgattaagtccactaatcgnttctgattatcttctgataatccgganattntctcatcacagggaggagtctgatgttttttaaaaatgtccatcttggccaggcgcagtgtcacgcctgtaattccagcactttggaggccgtaggtcggcggatc

SEQ ID NO: 630009 - DNA, 271 bp, Homo sapiens
gtgatggtggttgtaatgatggtggtgatgatggtggtgatggtgatgatgatggaggtggtggtgatggtgatgatggtggtgttataggtaggactagtgttgataatacaattattgtgggaagtaattttatttgttttgtgtgttcgaattgtcatttcatttctatgtcgtcggcgcatgggaacatagtcagtgaggaggagtcggctagtcgtatgtagaaatagaggcttagcagtgctgtcatcgctatgacgtgtcggca

SEQ ID NO: 630010 - DNA, 445 bp, Homo sapiens
  misc_feature (3)..(3): n is a, c, g, or t
  misc_feature (27)..(27): n is a, c, g, or t
aanaaccctgttgccctcccaaaattncccacttggaaatataattttcctttaaaatcgttaagaatcagtttatacactagagaaattgcctaaactcctaagactgccctgaaaattgacctttacagtgcccaagttaaagtttaccttattctcggccgggtgcagtggctcatgcctgtaatcccaggactttgggaggccaatgcgggcggatcacgaggtcagatcaagaccatcctgccaacatggtgaaaccctgtctctactaaaaaaaatagaaaaattagctgggtgtgcggtgcacgcctgtagtcccagctacttgggaggctgaggcaggagaattgcttgagcccgggaggcggaggctgcagtgagccaagatcacgccactgcactccagcctgggtgacagagcgagactctgtttcaaaaaaaa

SEQ ID NO: 630011 - DNA, 139 bp, Homo sapiens
ctttactgcagagaatgctggctattacaagatgcaagctattttgaactggcgaggagatacgaagagaacagggccaacgtcatccacgttctaagtttcatcttttattatgaagacaatcaagaaggaaaataag

SEQ ID NO: 630012 - DNA, 484 bp, Homo sapiens
agtgcagacgtctggtgatgtatttattatacgaatgggggctcaactcgggagtactactcgattgtcaacgccaaggtagtcgcaggtcgcctggttctaggaataatgggggaagtatgtaggagcttgaagattagtccgccgatagtccgtgtactcgttaggttcagttaccacttgtgtggccaatttgactttgtatggcccagcagagccgtgaattctgaattcctggctctctggtgtgagttatggctggtggcgcgtacaccatgtcaatacggtcaacgcacggtgtctctaagcgcgagctcacgggaggacagtaaacctccctgtggagcagaagggcaaaagctcgcttgatcttgattttcagtacgaatacagaccgtgaaggcggggcctcacgatccttctgaccttttgggttttaagcaggaggtgtcagaacagttaccacagggattactggcttgtg

SEQ ID NO: 630013 - DNA, 344 bp, Homo sapiens
tccataatgtgtgccaaatattatggatgatgttatggttaggctttgtgtccccactcaaatctcatcttgaattataatcccgataatcctcatgtgtcaaggcagagaccaggtggaggtaatggaatcatgggggtggtttctccgtgctgttctcatgatggtgagtaagttctcataagatctactggttttataagaggctctccccactttgcacagcacttctccttcctgccaccttgtgaagaaggtgccttgcttcccctttgctttccaccatgattgtaaatttcctgaggcctccccagccatgatgaactgtgagtcaattcagcctc

SEQ ID NO: 630014 - DNA, 131 bp, Homo sapiens
cccagaggactcccaaccctggcgcggggccaagaaacagccagcaagagagaggggccagagggcactgggcaggacggccaacgaagccgacacgggccccggcccgaacttgcagcactagctcacta

SEQ ID NO: 630015 - DNA, 720 bp, Homo sapiens
tatctactaaatggtcagctgtcactacattgatactttcgtatgccacaaaccctttcattcctccctgggaatcagggtaagatcaggagtgaactggggcgtggactataagaccacgctcagtatatccagtctaagctgcgaggtacgggtattcctgttcttctttgggacctcagagatgtagagcatttgtagcagctcacgcaaaatctctggctatgaaagggacttcatgaccatccagtccaatataacacttgcagacagagaaactgaggtcttccatgacttgccatagtcgtccactagctagtttagatggcaaaactggattcccgactcgtggtagttgctgttgcgtatccctttgacatcatttggcccgttccgtttataatgtccgtgagagaccagagactcagcaccagaatcgattattcctcaggtgaacgcattagacgtcgttcatggataagacagatttcacgacatcagagatagagatctcttgctatcaatcaggtcacggggcagctccatgtggagtcctgcccaaattaatgtcggttccataaagatggcaaacaagtccaggctccttgcgcgtaatctcagacgcattagactccctaattgccagtgaagcaaggaggtggatctcatggaaagctacactgttatgaagcgtcaatcgactggagtactaatactcaa

SEQ ID NO: 630016 - DNA, 425 bp, Homo sapiens
aaaaaacccttcccttttttattaatgggacccccaaaaaaaggggccaaatgtttaaaaaaattttttttttttaaaccggggggtggttttcccccccccaaaaaaaaaaaccggggaaaaacccttgggccctcattttctttttctaaaccccaggggggggggaaaaacaaaggggccaaaataagttttttttggaaaagggcctgggtttttcaaaccttttaaaaaaaaggcccaattacttaaaacatttttttgggatttccccccgggaaaacaatttaagcctggcctaaaattacggggggggaaattttttgtggggctagggagggggaccccccaataaatggtgctataaaaagaaaagtccttttaaagctcaacctggtgcccaaatggctcccaggggaaggggg

SEQ ID NO: 630017 - DNA, 304 bp, Homo sapiens
catgtcatcatagctgaaataacttaatgtcactacaagatgcctgtaatccttatctgattagcaaagcacgcagctctatctacgacaacaatgtcccctctttaagagtaagcaggaatagcactggctattgtggcaaatccatataagtatatcatggcttcttctgtcttcataaattttgccaggcggtcttccaaatccaaatgaacatcatctgtgccatacaatcctctgggtccacaagtcccctcgccatacttcttcagagatgctcatgctgctgcctttacccgagcgc

SEQ ID NO: 630018 - DNA, 357 bp, Homo sapiens
ccaaccctaagtgccaaatgttaatgaagtgacttatggaacaaacttaaacaaagtatggcatacctatacaatttaaacaaaatgtgttatgtccatacaatagagtagtatttagtcataaaaaaagaaggaagtgctgatacatgctacaatatggatataccctgaaaacattataagtgaaagaagctaaacataaaaggccacatattatatgattccatttatagtaagtgtccagagtatgcaaatctatagagacagaaagtagattagtggttgctaggagctgggggaaggagagatggggagtgactactaacaggtttgagttttcttttggcatgattaaat

SEQ ID NO: 630019 - DNA, 936 bp, Homo sapiens
  misc_feature (137)..(137): n is a, c, g, or t
  misc_feature (148)..(148): n is a, c, g, or t
  misc_feature (339)..(339): n is a, c, g, or t
  misc_feature (519)..(519): n is a, c, g, or t
  misc_feature (527)..(528): n is a, c, g, or t
cttgagagtcaccctccagtgaaaagaactctttattgaggccctgctgtgtaccccatgctgttctaggagctggggatctagcagtgagttagacacacagggtcccagtgctcacagagggcatatcctcatgnagagagacagncagcagacaaggtcgcaaatatcagagaatagacaggcataagggccatgtgctggagtgaccagctggtgtgcgggaaaggcctttccacaaaggtgacatctccgttgattcttgaatgttcagagggtgctgctgtctgatgcttggaaggagggaacagtcagtgccaggaccccaaggggagaacntgttgatgggatgggattcatttatgctcgggagaaagagacttggtttattggacgcctgggttgattttcttctcttctgcatcctctgcactgacatttgcagctctgccttctccccgtcccgtctctgggtgaagaacacctgtccgatgctcgctggcctgcagctgctgcagngtttcagnnaacagggctagcaaaaaacaaagcaaaagcccaacatcctccagctggcccccaaggtgctgggcttacagtgttgtgcgccaccgcgcctggcccagtgtgtcatatatttaagcaaaggttattattgcctgctgtttgggcctgcctgttgctgttcggcccttcctgctcccatggctcacgaagttgagctttcatttcacatgggcccgaagttgctttctctaggatcagccacccagacttgactccttccatccccttgtctcctttccccaaaggaccctatatggagagaagcggggccactttgactaccagtccctcttgatgcgccctgtgcacggctccgtcagccagtgctgcagaggtccatcatgagcatgagcaatggactctgatagc

SEQ ID NO: 630020 - DNA, 545 bp, Homo sapiens
gagcaagagaaggcagaggctaagacccatcccgtatctgctctcctgaaataattctggagtcatgcctgaaatgccagaggacatggagcaggaggaagttaacatccctaaataggagggttctggttactggtgccacgtgggcttcttggcagagctgtacacaaagaatttcagcagaaataattggcattgccagttgggctgtggtttcagaacagagcaaggaccaaaatttgaaccaggttcaatctgttgggattctaattgccaggttcatcaaccatccattccatgaattttttcaaggcccccatgttaatagtaccatttgtgcaagcagaagagaaagacccagatgttcgtcagaaaaatcacgccagtatgctggccttcttcaaacttacactgtggcattgcttactggggcacatttacgccaaaagggaaagccacgccctgcttgcttcggcaacgcattctcttccatcgttacactttaggcttccagcatttcactgtacttctcgactggacacaaa

SEQ ID NO: 630021 - DNA, 2937 bp, Homo sapiens
  misc_feature (51)..(51): n is a, c, g, or t
  misc_feature (67)..(67): n is a, c, g, or t
  misc_feature (94)..(94): n is a, c, g, or t
  misc_feature (116)..(116): n is a, c, g, or t
  misc_feature (168)..(168): n is a, c, g, or t
  misc_feature (264)..(264): n is a, c, g, or t
  misc_feature (359)..(359): n is a, c, g, or t
  misc_feature (400)..(400): n is a, c, g, or t
  misc_feature (442)..(442): n is a, c, g, or t
  misc_feature (532)..(532): n is a, c, g, or t
  misc_feature (626)..(626): n is a, c, g, or t
  misc_feature (755)..(755): n is a, c, g, or t
  misc_feature (873)..(873): n is a, c, g, or t
  misc_feature (993)..(993): n is a, c, g, or t
  misc_feature (1286)..(1286): n is a, c, g, or t
  misc_feature (1557)..(1557): n is a, c, g, or t
  misc_feature (1672)..(1672): n is a, c, g, or t
  misc_feature (1766)..(1766): n is a, c, g, or t
  misc_feature (1786)..(1786): n is a, c, g, or t
  misc_feature (1991)..(1991): n is a, c, g, or t
cacgctagcctgagctgtttcgtgctgtgcagctgagagtagcacacacgnctgtgttcgatagctncgagagagaagagctacgttgtatgtntgttacgacgacgacgcgaagnactatagcacgtagtctctagtcacgttatgcttatcaggggtgagtagagncttgctatcgcgttgctagtacttaagctactatggcatactaacttctagcatatagagttgtaagcttaaactgtgagaatttaagctcatctnacatgaaagacgtcgacatgcctagtcgtgtgacagtctcgatctaaacgtctgacgagcacgtcatcgtgagtctcgtgtgtgggtgtgagtgnggtcggagcggagagcaagtacgctagcagactaggtgatngctatgttagaacatcatactatgcgactaacagcaaggagngtccgggtgctgtacgcacactgctcgctcatgaacgtgtgttcgtacgctacactctagctctagtgttgtgtctgtgattgggggcgngatcgtcatcatgtgctacagatctagtagccatcgtagcgcgtggagcgtgagaggtaagatagacgagacgacgcgtagttgcgtgtacgcngagtcgcgtgggagttgtagagacatcacagatgcaactcagagcatgatggtgtagtgtgtgatgtgacagagcacgagcggcgctagagagggatgtgtggtgcgtatggtgtacgcgactgaggancataggcagcagaggagcggtggcagaagaagacaatagcacacgatacgagcgcactgtgttgtatggatgtagcggtgtagcatgaggcgttgctcgtttttgtgtgcatgcgtgnccacggagtagtgtagtctagcacagtcaccgcaatcaactacgcaagcgggcatagtgagggtagagatgacgagagtgcatcgatgcttgtcgtctattgtctggctcttctatgagngcatggtgtgcccgtactaacactacaacactgatgagcgattggttcgtagtgttgcagtgcaggatagagcgtcgcgtagctgacctgtctgcgtgtcggtcacggctatgacaatagacgagggtactagtaaggactgtgcgatgctagtgtttgatgtagagtcaggcagctgactccagacgtgtcacgactggcgcgatgcaccagctatagctgaagctgtggttgcgttaggttggtggttgggtggttcagacgtcagctaaacagtcaagaggtcgagtagngggagcgtagagtgtggtgacgcgcgaagcgaacgaagagtaggcgtgtgtggtgtggtaggccgcacgacagacagcagaagaggttagtagggtgttgggctagtgctggagctatagagtagagagctaagagcctcttgcttactttccttgcaagattgaggtatgagtagcgagcaacgagcgcacgtcatgcgttctgacatgagtaggtcgacgggtcctgctgtggagagcaggagtagagacgttgtgtactgtacgacgntggagagggtaggcgagcacacgggtagccagcaggagtcggtgttgtcgggccgagagtgaccggctagagagggacagtagtgaggagtgagcagcactaacagccgtacgtnttgtgcgtgacgtcgcctaccgttagctcgtgtcgtctcttcctgccatcacatcagacctagtgtagttggtcgttagctctacagtctggtnttgcgtcgtacggtgtagtntcatgcagtcaagcacaccagtagctaggtgtctcggcagtgcatacactgtcaaacacgctatactggtgtgctcgtttagttggacggcggcacctcccgacagctgaccatcgctacagtcatcctgaaatgatagtgttgctttgcgtcattcactcacatcgcatgtttgcgtttcggagattcaggacgctcgcagctncctacaatcctacgtctgtctatcaatcgtctactacggccatctactacacaacaagacgacgcgtctgttgtggcgcagacgtgtggtgggctgttcatgcattcagcaagcatacgactacgtacttgctacgacaacgacggtagtgagcgagctactgctctactgtcgctgcagcggcagcatatgcatcatcgctgctgctgcgcgtctcgtctcagtccacacagcgcgcctactgtagatgcagcagctacgcatctcttctgcgtagcagctcaaccacaacaacgacactactactatgtcgctgagcgacttgtcatgctgctgctgcggtgctgctgctgctggtgctgtgggcagcactcgcggcgctgctgtggtggtagtgttgcgctgctgctccagcacgcggcggtgctgcagggccccacaacgcagcgctggctgctgctggtgagacaacacacacccacacagcaagcagcagagaagagagagagatagtgtgctgctgctctctcgacacacacacgcagagagaggtgtgtgtgtggtgtgtgtggtgagcaccacctctctctgttcaatgaccctactcacatacagagaaatgtgtttttgtcgtgtgcgctcacacacatagaagaccgcaaccattagctcccacaccatcacacacccgcctgatggtatatatacacacacacagatgaagatcacacaggggcgacatacgactgccactcgttgcgacacacaaatcattctcggtgggcgagggacgaaagagagtgcgcccaccttcgaccactcttctcaccctcttctttgttacccaccacctcccctcttataaaatcttcttgcttctcttctctctcaaaaaataatattaatataaaacaaaaaaaaaattaaacaaaaattaataaataaa

SEQ ID NO: 630022 - DNA, 585 bp, Homo sapiens
cagagtttaaggggccttccagcgtgtgtcccccaaagggtaggcaaaatctggtcaaccagttgggggattttattagggcccggggcaaaacccccccacccccaggtgggtcaaggttctgggggacccccaaaagtattaaaataaagtgaagggggtgggcttttagccctttttgccccctttgcaaacagtggcccaaaacaagggcccggggcccctttaggatttttttcaagggctttgggggttttccaaaaaaaaaaaaggccccctcctggggggttaaaaccggccggtttttttccccccggggggaaaaaatacaaaggaaaaaataaaaattttgggggccggggcttagggcacccaagggtggttccactataaaaagcttgtccccctggggtttaaagggttggggcctttcccgtttcccccaaggccgggcccttccccggggggattttggttttaacccaaaggttccccagggttttttgtttcacccactttccccttttgttttttttgggggaggttttccggccgccttcccccaaaaaactttctttttgggga

SEQ ID NO: 630023 - DNA, 739 bp, Homo sapiens
gcccggtgtactctgttcaacatggccatgctatccaccatggtggtgcatatcctgggggtgcgcccccacacccaaaagtggtcacatgtgctgacactgctgggccatctagtcctgtgtcctttgcgccctgtcactgtggtcacttgagtgcttcgttactcgctttgcgttgcgtggctagcttgccaagcttgtcgtccgtcgtactcttttgcagcatcatcacgcgtccgttccataggtcttcctcatcttcactctgtgtactggtccatgcggggtgcagtgcccgggtgtgtgcccatccccttctgaagagctattcagacagcggcaggctccccatcagttcgggcagcacctcgttcagccgcatctagggctctcagtcgcacactgcccatgtgatgagagcagatgattcggcctcgtcagtcactatctgcactgtggctcggctcgaacgtcccgttggccagtcccaggccattcagccgcatattttggaaagcccagtgaccatggtagagatgggccgtctgccttggtgtggacgggtctcccgggttggcgtttgtgagattgggcttggggacgtactcggctctcactcatgctcccacgggactcagaagtgcgccgcatgctgcctagggtacttgtccccacagtctgtcccaaccagctggaggcctggtctctcttacaaccctgggccagcctcattgctgtg

SEQ ID NO: 630024 - DNA, 448 bp, Homo sapiens
aaataatgaaaaaaaaatgtgggatttattttagcccctctgagtgggctgtacttttctcaacggaaaaaaaaaatgcccttggtccttgagacaaaagatttaatatacaaccatgtggcctcaggctgaccagatcaaagtggtttttaatccattttacatgtcaagtttaaatgaaccagactgcctgtgactttataatttaaaaggtaatacctgttggtgcttttttaacccccatgagtaggtaaagcaaataataactcccaaagtgtggatttttgaaaatttgaatgttttttcattcccaaaagtatcccttctacccctatttggggcagggctgaaaagtcatcattaaaggttctgttttttggggcttacaagttctatgttttttaaaattcgctgattaaaaattttaaaaaaatagggtcccccctga

SEQ ID NO: 630025 - DNA, 390 bp, Homo sapiens
tgtctgtttaaatagtacgcacctttcaaggcccagttaaatgtccattgccagcacttatgtttacctaatgagtccagtcagatttgctcttctccagaatctcactcacttgcactaacccatatgctcatcttgcgattatcatgtagcaagtgtctccaattcaggtctacatgttccagctagcagccagcagcatgcacctcttcacactggtttcatctggcctaacaaaccagacttcatttttcccaacatgccaaagctgagtcattccagccagtccacttgaggcactttacaaatcattcgccagccccaacccacgcggcagtgtcccgaccttctatcatcttactcagctgcaagtccatctagtccttttac

SEQ ID NO: 630026 - DNA, 244 bp, Homo sapiens
gttaaaaaaaccaaaacaatgttttgataattcaaaccatttagttttgctggatgttttttcccatctctactaaaaatacaaaaattagccaggtgtggtggcgggcactggtagtcctagctgcttgggaggctgagacaggagaatcacttgaacctgaaagtggaggttgcagtaagccgagatcacaccactgcactccagcctggtcgacagagcgagactctgtttcaaaaaaaaa

SEQ ID NO: 630027 - DNA, 581 bp, Homo sapiens
atatcacctaagcataatatcaccatgggactatcccctataccttctgcatatgaattacctagaaatactttgtcaaggagagccgcagcatagactcccgataccagacgagctacttatgaacagctataatagcacacccgttctatgtcgcatacatattgcgaagatctataggtggaggcgacaaacctaccgagcctggttattcctagctgctgactatgtaatcttagttcaactttaaatttgcccacagaaccctctaaatccccttgtaaatttaactgttagtccaaagaggaacagctctttggacactaggaaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtagcatgaaaacattctcctccgcataagcctgcgtcagattaaaacactgaactgacaattaacagccca

SEQ ID NO: 630028 - DNA, 124 bp, Homo sapiens
agttaacttttattaaaacatatatgagtgtggaaagcacatatattaagtgcagatcagtccctctttcagtgtgggaagagagcaaaccatgttgattttcttaaattcactccttaagaac

SEQ ID NO: 630029 - DNA, 347 bp, Homo sapiens
  misc_feature (58)..(58): n is a, c, g, or t
  misc_feature (74)..(74): n is a, c, g, or t
  misc_feature (115)..(115): n is a, c, g, or t
  misc_feature (157)..(157): n is a, c, g, or t
taccctgagagaccgtgttgcaatgctcttgatgtgccagctgcttttaaaccacatnaatcttgaggctatcntacatttatctggcttctctgatgttagcttctgggctatnatttaagcttccttttatgtaactgatgcttataagcttccnaaatcgctgtattttattacttgaagattttagcaagattgagtatatcaaatatacactctggggaagggtacttgctcatattctgctctattcatgtttatttggaaaatgttctatttgctttttcctacagtcacacagcccctgtacacaaactctgaccattgcaacacgtctctcagggatc

SEQ ID NO: 630030 - DNA, 163 bp, Homo sapiens
  misc_feature (65)..(65): n is a, c, g, or t
gcccgggtcggcgggactaggcggacccggccggagcccgctggggcagctgtgcctagcgacangaaagacctgcgccagccctggatcccgctgcgtgggagagggcttcggggatccgactggtactggacacccccccgatcacccgcagggagccaag

SEQ ID NO: 630031 - DNA, 987 bp, Homo sapiens
tccactggtccagggtttatgggggggtttaagtgggtataacactgggatagtgggtggcttggttggtttgtaaatcttttaacttttatatgggtattggtacactactggttattattgttcacaaaataagatctcttgggaagatattatgcacaagacatgattatgggatttatacactgggatccccaggtatgtgactcactggggaaaaaattgttgggactaggcttgtccagtgaagggacgccaggaatgtttattataacacaccggtaaactatccaccgggctcagggggcaaatggcagtactgtacagctattgggcagtgggtgctgtcaagaggtgggcaagaatcttattctcacatctaaaccatgttgaagatctacacagagattaatcacctatccagaatcggggatatagctgggggattttacaaaccattcttatttctaacttcaggagttgatggttttccccagtccattcttaaaatattactggttaaatcacagatcagataaaagggacaacttgcacaacctccacctagaatcctgtgtgtagcctagacggtgaatgattatgactatcagaagactttaaaatggcagctcctttgggatcccccaaagtgtttctgcactcttcttcaaaggggcctcttcctcagaagtcagagtcactttcacagggtctgagattccattctgtcccaaaatgcagggaccacctaggaagacatcatccttatatccgaaaagaccccttatcctggggaacacgtggggtgcaccccgctaaagattttttgaaaatactctcttggacaaatgtgtctacagaggatttcaaatagccccgggatttgttcccttgaggttgatccccttataggggtttcaacacctgttgataacttcttcacggggcatgatattaaaggccctaaatgggtggaagttaagagac

SEQ ID NO: 630032 - DNA, 1176 bp, Homo sapiens
  misc_feature (739)..(739): n is a, c, g, or t
cgaccgatattagcatgctccagcctcttgtcacgttgatgccctgtgcttgctcggtaacggtgctgggtccctagcacgacaagaaggccctcatcatatacgcgctcgctcaactttggacctcacaagcctccataactctgagagaagcagtacacgctatgctactgagatggttctgaagaccaagtagtcgtgaccgcccatgacctagttcatccgaaggagttctatctaatgccttataaccacttggctatctctacgcatcgtctatcctcagtacgcaacatgcacgcgatgcgtggtgtggtaactacacgcacagcatggatttaccacgtgcaagagctttatgccagtactcgttagaacagagtgtgctagtgaagactcagtttaggacacgttgactcatgaagatgaacgaagattggacgttcagtatccaagaagtcaatgagagaaggcacgaactgctgtaggaccctagataattcacattggctactatacgactgcctccctaggaggatcgtcatacacagataagccagggaaagaggaccctaaggcggaacagtagaagaagatctggaagtgcatcctgagcgcatgagatcgcacgttgtatcactctaattcgttcgtaagggaacaggttcgccacaggaggattcacctggggggaacgtttgtattagcacagacatagaggaactaaaacggtgtgttntcacttggtgcagggctttgtctattgcgctcagtctttaccccttagggtgtccaaggaagccaaattagttagatgcaagcaatgtcagcgacggtgactagtgtagtggaaccgaagaaaatgtgaatgaaatggcaatactgcagagcttcggtcacacaaagcggagcccccaatttgtggcaaaactgtccggattgcgtgggaaaaccctgcggcaatcggaaacctctatcttcccacggtcttccaccctgtcaacccccttctaaaggcgcttggcaaaatctcagcagtaaccacttcgttaccgttccccctgcctccttgacaacctcgcgccccaaggccttttccgggaaacacccccctgtgtggagaacctgtagcgacaccagcagcggtgtgggcatgcacctgttcgccttggtgca

SEQ ID NO: 630033 - DNA, 443 bp, Homo sapiens
  misc_feature (443)..(443): n is a, c, g, or t
gccttacaatcatggcagaaggtgaaaggcatgtctcacatggaggcagacaggagaagagagcttgtgcagggaaactcccctttttaaaaccatcagatcttgtgagacttattcactgtcatgagaacagcacaggaaagatctgccctcatggttcaattaccttccaacacatgggaattcaagatgagatttgggtggggacagagcctaaccatatcattcagcccaaatctcatgtcctcacatttcaaaaccaatcatgccttcctaacagtcccccaaagtcttaactcatttcaacataaactcaaaagtctataatccaaaatcttatccaagacaaggcaagtcccttccacctattcagaagcaagttagttacttcctagatacaataggggtataggtattgataaatacagccattccatggggtn

SEQ ID NO: 630034 - DNA, 93 bp, Homo sapiens
ctagaagattcagcaaagtacttttgtgctcttggggaactaccgcgctacgtacgtcgggactgggggagcaagtacaccgataaactcact

SEQ ID NO: 630035 - DNA, 193 bp, Homo sapiens
tgtactgggcatctgccgccgggagagtcggcgacgccgccagcgtccgcgcgcgaactgccgtccatggcacgtcaggtcggcgtgctgcccgagctgctcgagtctcgcccgctgcctgcgccgtacttttaggcgagtgcggaggtcgaaggcggaggggaagtcatgcgcggagcgtgcagcctcctcg

SEQ ID NO: 630036 - DNA, 155 bp, Homo sapiens
  misc_feature (96)..(96): n is a, c, g, or t
ccacatcttatgccctcttggccctactgcagctaaaagactttgactttgtgcctcccgtagtgcgttggttaaatgaacagagatactacgggnggtggctatgcctctgcctaaggtaattccaagagggaggacccagccattagctttaa

SEQ ID NO: 630037 - DNA, 283 bp, Homo sapiens
  misc_feature (40)..(40): n is a, c, g, or t
  misc_feature (75)..(75): n is a, c, g, or t
  misc_feature (185)..(185): n is a, c, g, or t
  misc_feature (233)..(233): n is a, c, g, or t
  misc_feature (255)..(255): n is a, c, g, or t
gggacaacaggcttgcaccaccctgcctggctaatttttntgggttttttggtagagacagtgtctcaccatgtngccaaggctggtctccaactcctgggctcaagcagtcctcccactttggcctcccaaagtgctgggattacaggcgtgaaccaccacacccagtgaggataattattttnattgcctgtaagtttaatattctaagtagacaatactttttttcactnttttcctccttttaaaaattgngatataaatttagtgaaacttgtatatc

SEQ ID NO: 630038 - DNA, 559 bp, Homo sapiens
acacagagactaacagatttctccatgtctcttccctttaagagctaaactaagtagtgatcttggctggatcttagattagcaaattaaagcgatcaagagactcttttttggtacaggtggtaacaattaagaatatggtttatactttaccattacactgtgttattcatactaatcttacattgcatttgcattacttatactattcttgtacttcagagatgctgttgtaagtattcaggggtgaaatgtcattcctacattcaaatagattaccaacaccctattcactgtgtccatatcatgagaacgcccatgtgggcaattgttttttagtagctgagcagtctgcttgctgtataacccatgatcgtatcatagtctgcctggcctttgagttctgcagccctctgtggagttagggcaaaaaggaagagtgagaatcgagttagggaatgaagagcaatcagctcttaagatgtatctggttaaccttatctttttttttttttttttccttttttggagacctagaattaggagggagtccattcgg

SEQ ID NO: 630039 - DNA, 182 bp, Homo sapiens
agtaggtgcaggtacaatagccatcatattgagaagacaacaaacaagtcattgacagctgcctggggactatacaggggagcagggagattagaatatttaaatctgtatatcccctaagtattattttcttatattttattttttagagctgggatctctctaggctggtcctgagatcc

SEQ ID NO: 630040 - DNA, 524 bp, Homo sapiens
taagccctcactacagaaatcataacacaaatagcagaaaaatcataaaagaaataaccaatgctatactagaaaatatacatttgatacaaaggaaagcagtaaaaaaggaatttaaaaaaaacaacaaaacaactagagacatataaaagcacaaaatatataatggcagataggaatgcaaccgtatcagtaacattaaatgtgaatggactgaataatccaatcaaaaggcatatattgacagcatggatacaaaaaagaaaaaccaactatatgctatctacaagaggtatataagattcaaagaaagaaatgggttgaaagtaaaaggatggaaaaacatacgtatgtaaatatcaatgagaaagccggagtataaatactaataccagacaaaagatatcaaacttcaaaaaattattagcaattaacatgggcatattcacaaggataaaaatcatcaagtcataaggataataaaactaggcagataaacaaaagaaccctaggatcaaaacaat

SEQ ID NO: 630041 - DNA, 503 bp, Homo sapiens
cacgaggctccagcgccacggtgtagggcacgcggttggaatggaacaccaggtccaccagccggtaggtggtcagtcgccgtggcggcaggatcagcccgtagggtgagatgtcggccagcccgatgtggctgcgcccggccaggggatggtccagcggcatgatcagcagcgggtcgaagttgtacaccggcgcatagtcgaggtcgttgggcacgtcgagcatcgagcccactgccaggtcgaccgcatccgagcgcagcagcgccaggccgtcgcggccggtcacgttctccagcgccagctggatctccgggtgttgctggctgaaccgacgcaccaggtcgggcagcaggtagaggatcgtcgaactgccggccgccacccgcagctcgcccgactcgatgccgcgcatgcggctgcggaattccgcgtcgataccgtcgatgccctccaccagcgggcgcgcgagttcgtacagcgcctcccccgcgtgggtgagg

SEQ ID NO: 630042 - DNA, 262 bp, Homo sapiens
  misc_feature (54)..(54): n is a, c, g, or t
tggatcgcgcccatcatgaccatggacagagcctttttcagcctgcacacgcgngtcgaaaccctgcagcaggcacgggaaaccttcgctcggatcgccgttggccgaggcagtgcccaagagcagaagcttcgggctgaaggctttggcgacaaccaggtctatccgtttgaaattggcgagaacccggcgcaactgctgctgatgggacgggtcgacgcctggttcaacggcattcccgaaacccagagcatctggcgcg

SEQ ID NO: 630043 - DNA, 174 bp, Homo sapiens
cggtttcaaagagtaggatacagtaccatcgccatcggggaccccatgtgcagaccagagagaaagcagcatctgcaagccatggacagaggcctcagaagaaaccagcccactgacaccttggtctccagcatccagcctccagaactgtgagaaaatacatttctattgtct

SEQ ID NO: 630044 - DNA, 103 bp, Homo sapiens
cgactagcattctcccctatggaaatcagtcataggaggagatgatggctggtgttataggccagattatagccaatccaactgacctagtgaaggttcagat

SEQ ID NO: 630045 - DNA, 485 bp, Homo sapiens
gatctagcaggatcttttttgcggctgctttccatcataggcctgtgaggctgaggaggaaaaaatgatttcatgccctggacccaggacccccttgctgtttgcagcccagggacttggtgctctgcaccccagcagctctggccatggctgaaaggggccaaggtacagcttgggccgtggcttcagagggtgcaagccccaagcctttgcagcttccatatggtgtagagcctgtgggtacatagaagtcaagaatcgaggtttgggaacctctgcctagatttcagaggatgtatggaaacgcctggatgttcaagcagaagtttgctacagggctggggctctcatggaggacctctgctgggccagtgcacgcacggcaactggggggtcagactccctactagtgcactgcctacctggagctgctacacagaggccccccatcctccacaatggtacatcccactacagtttgccct

SEQ ID NO: 630046 - DNA, 317 bp, Homo sapiens
  misc_feature (75)..(76): n is a, c, g, or t
  misc_feature (84)..(84): n is a, c, g, or t
  misc_feature (116)..(118): n is a, c, g, or t
  misc_feature (122)..(122): n is a, c, g, or t
  misc_feature (143)..(143): n is a, c, g, or t
  misc_feature (146)..(147): n is a, c, g, or t
  misc_feature (161)..(161): n is a, c, g, or t
  misc_feature (175)..(175): n is a, c, g, or t
  misc_feature (180)..(180): n is a, c, g, or t
  misc_feature (189)..(189): n is a, c, g, or t
  misc_feature (197)..(197): n is a, c, g, or t
  misc_feature (207)..(207): n is a, c, g, or t
  misc_feature (214)..(214): n is a, c, g, or t
  misc_feature (226)..(226): n is a, c, g, or t
  misc_feature (253)..(253): n is a, c, g, or t
  misc_feature (305)..(305): n is a, c, g, or t
tagaaaagtattaaaaaaaaaggtggtacggtcggaaatacgggaaaagcagcttgcgcagcatgaaataagaannggaaaaangggctgctgctgacacacacccaatggaaaannnaaanatccaaggtgaaaaaaaaaanaannaagtggtaaaaaanaaaaacggtccgcnggaanaaaaaaaanggcccaanagaaaaagangtggacnttgaggaagaanaaaaaaaagaaggcaaagaagaaggcngggttctagaacaacaagaaagggtggtcggcaaatgaaaggcaccgacganagaaaggtcaca

SEQ ID NO: 630047 - DNA, 914 bp, Homo sapiens
aataaaggagcaataaagtcacgagaactttctgtcccccaatcgagagccctgaggggcaccccagtcccgcctcagctcaagaaacacaagaagacaaacacatcgaggacgcagaaaacaggacagagaagagaacgaagagaacacagaaacagacacagcgatagaaagaagaagagcagaagaagaaagaagagaacgcagatgatacaacgcagacacgcacatacgcacccgaaaacgtcaacgacaacagacacacagaccatacagacacataacagcaaaaagaacacagacagaaagtaaaaagacgacataacacaaaatcataaaagaggacacacaaggagaataaagaaaagtgcaaacaaccccaaaaaaacgaaacaacaacaaaaagaagcgaacaaacaacaagcagaacgaaccaaaagcaaagaacaccacaacacacataaaaaaaacacacaacacaaacaagacgacacagcagagaaagaaaacagagagacaacaaaaaaaaccaaaacaaaacaaaaaaaaaagaaagaaaaaaagcaaacaaaaacaaagaacaaaaaaaagatgacaaaaaacaaaacaccaaaacaaaacacaaacaaaacaacaaaaaacacaacaaaacacaacaaacaaaaaaacgaaaaaaaaaaacaaagaacagaacagagaacacacagaacaaaaagaagaagaagaccagaaaaagacaaagacaagaaagaagaaaaagaaacagaagaccaacaaagagcacaacaaagagacgagaaaggaaagaaacaaagaaacaagagaagggcaaaacaacaaaacaaaaaaacacaaaaacaacaaaaacagacaaacaaccaaaacaaaaacaaagccacgaagaacaagaaaca

SEQ ID NO: 630048 - DNA, 292 bp, Homo sapiens
cgtatagtgtgtagggggtgtggagtgtgtgtggcatctggagtgtgtgtgtgtggtgtgtgtgtggtgtctgtgaagggtgtgtgtggtatgcatatagtgtggggggtgtgtggagtgtgtgtgtggtgtgtgtgtgtggtatgtagtgtgtgtgtgtgtgtggtgtgtagtgctagctactcagaaggctgaggtgggaggattgttagagcccaggaggttgaggctgcagtgagttctaattgcgccactgcactccagcctgagcgacagagtgagacactgtctt

SEQ ID NO: 630049 - DNA, 721 bp, Homo sapiens
gcctctttgtgcccattctaatcgtaatggcatacctgccatgcttaccgaacgaaaaattctaggctatatacaactacgcaaatggccccgaacgttgtaggcgccctacgggctactacgaaccccttcggctgcacgccgaataaaatgtcgtctcaccaaggtagccccgtaataacccgcgcatcatcgtagccgatcacccatcatactatcatcgcgtaccccgtactttagcttcttcaccagtcgctcgtgtctactaatagaatccccccataccccagtacgcgcaaaagcgcgcgctggtcaaccgtgcaaccctaggccctcctagtttattctagtccacactctaagcctaagcgcgttatactcaagtcacttctgatcaagaggttgagcattcgagagagctccaaaaattacggcaccctggaattcgagacgactacttgtcgaagacaagataaggacgcgcgagagatcaaatacttcgattgatggacaggctcagccccgtaggcgcagtccacttcttgaggtcattcaaaccagtttagctttaagtcaacgcttgggtgtccttctaaaacatcattcaccacggccgttaatccaacgagactaacagaagaggacacaaggcttctttgaagtttaacatcacatgctctattctattgaacccactttgtgaccaaataaagttattgaa

SEQ ID NO: 630050 - DNA, 373 bp, Homo sapiens
  misc_feature (25)..(25): n is a, c, g, or t
  misc_feature (27)..(27): n is a, c, g, or t
gtcccctcttgatcgggaactcctngncgccttttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatttgcaaaggggggtcggacaagtgcagctgctgcgcctgatgctgggacagccccgctcccagatgtaaagaacgcgacttccccaaacctggattttttatggacaaccctggccgtggccgtttgctatattcctttttttatgaaataatgtgaatgataataaaacagctttggcttga

SEQ ID NO: 630051 - DNA, 697 bp, Homo sapiens
  misc_feature (25)..(25): n is a, c, g, or t
  misc_feature (27)..(27): n is a, c, g, or t
gtcccctcttgatcgggaactcctngncgccttttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatttgcaaaggggggtcggacaagtgcagctgctgcgcctgatgctgggacagccccgctcccagatgtaaagaacgcgacttccccaaacctggattttttatggacaaccctggccgtggccgtttgctatattcctttttttatgaaataatgtgaatgataataaaacagctttggcttgaaaaaaaaaaatatagccaaaaaaaacaaacagattggttggggcgcccatggccccggagaaacgttttgcaaaaccccattcggtttgggagccgcgcgggccccaagattgagttaaacggcaacccttgtgcgcccaaagaggggttccctgaaggaggaacctccggggcccgagactcgggggcggtggtttctcccacccaaataaaaagggcgcgcggggaacaaccgagcgtgtttgggacacactcccagaggggcgtccgaagccatagggtcctacacacggggccagggactgataatagccggcggggggc

SEQ ID NO: 630052 - DNA, 198 bp, Homo sapiens
  misc_feature (22)..(22): n is a, c, g, or t
  misc_feature (98)..(98): n is a, c, g, or t
gcatctgggatgtgggaccccnctgccccattttcttgggaatcaaaacatcaaagaaagcaaaatttgtagctgggtgtggtggctcacacctgtanatcccagcactttgggaggctgaggtgggtggatttgcgaggtcaggagatcgagaccgtcctggataacacggtgaaaccccatctctactaaaaatac

SEQ ID NO: 630053 - DNA, 654 bp, Homo sapiens
  misc_feature (25)..(25): n is a, c, g, or t
  misc_feature (27)..(27): n is a, c, g, or t
gtcccctcttgatcgggaactcctngncgccttttcagctcgccatggatcccaactgctcctgcgccgccggtgactcctgcacctgcgccggctcctgcaaatgcaaagagtgcaaatgcacctcctgcaagaaaagcgctgcatttgcaaaggggggtcggacaagtgcagctgctgcgcctgatgctgggacagccccgctcccagatgtaaagaacgcgacttccccaaacctggattttttatggacaaccctggccgtggccgtttgctatattcctttttttatgaaataatgtgaatgataataaaacagctttggcttgaaaaaaaaaaatatagccaaaaaaaacaaacagattggttggggcgcccatggccccggagaaacgttttgcaaaaccccattcggtttgggagccgcgcgggccccaagattgagttaaacggcaacccttgtgcgcccaaagaggggttccctgaaggaggaacctccggggcccgagactcgggggcggtggtttctcccacccaaataaaaagggcgcgcggggaacaaccgagcgtgtttgggacacactcccagaggggcgtccgaagccatagggtcctacacacggggccagggactgataatagccggcggggggc

SEQ ID NO: 630054 - DNA, 251 bp, Homo sapiens
  misc_feature (25)..(25): n is a, c, g, or t
  misc_feature (27)..(27): n is a, c, g, or t
gtcccctcttgatcgggaactcctngncgccttttcagctcgccatggatcccaactgctcctgcgccgccggtgactcctgcacctgcgccggctcctgcaaatgcaaagagtgcaaatgcacctcctgcaagaaaagccatttttggcatctaatcaagtgacttgaagggcgggtccctgtgtgtgtgtaagctgatgtttcctgggagcccagattcctagtaacctggctgggacagccatacccc

SEQ ID NO: 630055 - DNA, 422 bp, Homo sapiens
acggtggaaactcatggaccttgatcgcctttcattgacacaaagtagtacggagatgatgacatggcttaaccagcgcaatcctgaagacaaacacaacgcagtggtaccaatatagtagtcagttaaagcacaagaggactggttgagagcaaaggtcatggcaacagctttggaatgctcacggcatttggcttgtagactttctgtagggccaaagaatggtaacgtgcttatcatggggagtgtttggagaaatttagccaaagcttcagcagaaaaatcccctgagaaagaccatagagtacttcaccacaacaaatgtacctgctcatccctctcatcaaacaaggccattttgcaagagtttagatgggaaatcactaggcatccaccctacagtcctgatttccaccttgcca

SEQ ID NO: 630056 - DNA, 414 bp, Homo sapiens
ccccttccctgtcctccagcctgtcccctttccaccatcctcaggggaattaaagcagtttggggatgccccattgggcggaaattgttgcctcctcagtgatccttatcagggagagcaggaatccttattcccggggtcggtaggaatcatttttgccgcctcctgtttgcccccagggtgctgctcctgctgccctgtgggctgtgccaagtgtgcccagggctgcatttgcaaaggggggtcggacaagtgcagctgctgcgcctgatgctgggacagccccgctcccagatgtaaagaacgcgacttccccaaacctggattttttatggacaaccctggccgtggccgtttgctatattcctttttttatgaaataatgtgaatgataataaaacagctttggcttga

SEQ ID NO: 630057 - DNA, 268 bp, Homo sapiens
tcagctcggactctccctactgtatctagactaaggaatttgagctgtataataggaactcattgtggaattgtaagtctggaaataccatgatcatatttgcttctttttttttttgagatggagtctcgctctgtcgtccaggctggagtgcagtggcgtggtctcggctcactgcaacctccacctcccgggttcaagtaattctgcctcagtgtcccgagtagctgagattacgggtggctgccaccacgccgtggctgatttg

SEQ ID NO: 630058 - DNA, 680 bp, Homo sapiens
  misc_feature (14)..(14): n is a, c, g, or t
  misc_feature (78)..(78): n is a, c, g, or t
  misc_feature (121)..(121): n is a, c, g, or t
  misc_feature (133)..(134): n is a, c, g, or t
  misc_feature (143)..(144): n is a, c, g, or t
  misc_feature (157)..(158): n is a, c, g, or t
  misc_feature (249)..(249): n is a, c, g, or t
  misc_feature (272)..(272): n is a, c, g, or t
  misc_feature (297)..(297): n is a, c, g, or t
  misc_feature (323)..(323): n is a, c, g, or t
  misc_feature (336)..(336): n is a, c, g, or t
  misc_feature (340)..(340): n is a, c, g, or t
  misc_feature (354)..(354): n is a, c, g, or t
  misc_feature (361)..(361): n is a, c, g, or t
  misc_feature (408)..(408): n is a, c, g, or t
  misc_feature (412)..(412): n is a, c, g, or t
  misc_feature (418)..(418): n is a, c, g, or t
  misc_feature (498)..(498): n is a, c, g, or t
  misc_feature (535)..(535): n is a, c, g, or t
  misc_feature (542)..(543): n is a, c, g, or t
  misc_feature (552)..(552): n is a, c, g, or t
  misc_feature (561)..(561): n is a, c, g, or t
  misc_feature (564)..(564): n is a, c, g, or t
  misc_feature (567)..(567): n is a, c, g, or t
  misc_feature (576)..(576): n is a, c, g, or t
  misc_feature (581)..(582): n is a, c, g, or t
  misc_feature (588)..(589): n is a, c, g, or t
  misc_feature (591)..(591): n is a, c, g, or t
  misc_feature (593)..(593): n is a, c, g, or t
  misc_feature (597)..(597): n is a, c, g, or t
  misc_feature (609)..(609): n is a, c, g, or t
  misc_feature (660)..(660): n is a, c, g, or t
aaatatagatatgngcgactctagagtgcacaatggtttagtcacgtaagaaattcgaatgggatcgttggagaatgnatgcagatccagggtgcagtgaagatgagctgggatgctgtgnactggtttaagnnttcctggcnntgcatctcttggnnactagctgaatcttgacgtggaaggttttagctaatgccaagtggggatgcagaaaatgctaagttgacttaggggctgggcacagggacnaaaaggcaggaaagtactaaatnttgctgggggcatccaccccgggtngggcttttccttccaggaggtccaanctggcaccacccncagngctcacatggctgnctttatnctccgtgttccatttggcgcagcaagtggcagtgtctccgccacctngtgntggtgntgccgcgcgcctgagatgtggctttcaccacctcatccatgagagctttggttccccgggcaaaagcttcccgttcgatnccgcgccgcggggccgttccgcgcaatctgcttagcncgagtgnnagcctcagnatacttctngcngcnttcagggcnacagnnaaagcnnancnagcnagcaggtatgcnagatgccacagtggcttggcaagtcttggcattctcatcaaacttgtcagnagtgacaaagtcaacaggca

SEQ ID NO: 630059 - DNA, 277 bp, Homo sapiens
gagtggcggtgaaagttgagagcagtactaagagagaaccgagcagagtgtgctggtgcaagtcgaaatggtaactcaagctaaagcccagaggggagcccattgcaccgcacctgtctttcaaggattggcagtatcccgatctgccatgtatacagaaggcatgtacagaggaggtactcagccgctaaatccaaggttgaaaggaaaagaggagaggttctcgcactgttacaaaccagtggtggtgacagacggcggtaccggggtggtgatc

SEQ ID NO: 630060 - DNA, 321 bp, Homo sapiens
gaattccccccccccccccccccccatagggtcatctcctgtcttatgctttaaaatccaaggattctttcccctgggggatctccctccaagttgggtgtcagaaccaaagtcctctccatggaatgcgagactcacaatctgactgctttcccattgtttggggggacacacaaatatctacatgatttggagaaactctatgtaaaactatttccttttctttaaccctcctcctttttttttttggagactgagtttcatgctcgtggcccaggttaaagtgaaatggaacgatctcggttcactgaaaccggatcc

SEQ ID NO: 630061 - DNA, 116 bp, Homo sapiens
gctcactagaggatccccattaacattcccaatagttgtccagggtcatattcaatgatgagttaaacacatactgtgttctaggatcaggagatacagcactaactagagagacc

SEQ ID NO: 630062 - DNA, 1600 bp, Homo sapiens
  misc_feature (665)..(665): n is a, c, g, or t
  misc_feature (958)..(958): n is a, c, g, or t
  misc_feature (1020)..(1020): n is a, c, g, or t
gcgtcgggttgttcctaacaccgaattgtgtggtggttggattatggttgcggccacgttgttcgttccttgtgtgccccgccgtctgggtagcgaccccctggtgggtgttgtgaccgcaacgcacccgcgcggattgtgggggtgcccccacccgctgcggggcccccaccggtctatcagctttgtttcctcctcgcgcggggagtggtgtaaatatttctcttggtctgccgaaatggtgctcccccccgcttggtggccgtttttgtgttgagtgtgggagaggcgctcttttggttttccccccccgggggcggggcacaccaccaactgatgtgggggggcctgttgacccaaaagtggtccccacaggtacagatagttgttggttttcctctgtgtctccaccaacgagtaagtgatgtttttctgtttccgtgtggggcacaaacgtgttgtgctcttgtgggggtgcgccccccgcccccgaagtagatgtggtggcccccctccgccccccagtggggggatatgccactagccttggggcgttgttcacgcatgggcgttctcaccggggtggaggttttgttgtcctccgttggtggaccccgacattgcccacgggccggcacacgagtttattaagccgcgtccccggngctgtattatggccgccccccggtaatttcgggattttggccaccacaccaccggcgtgctacacacattgggcacagcgcacaagttttttgtctcggagagctctgagagagggatacaaagagtttttgagttccccccgtgtgtctcgggtgtatataaacgcttggggagaaagagttgggcccccgtgaaggtttctctgtgagagaggtctctgtgggtgagagtgcggtcgcgcacaggtgtggggtgttgagagatagtgggggtgtctcctggggcccacagncgcgcacactgtgtgtgtgttttgagagagagccctttctctccagagcctatgtctccacncgctctttggggtctgccctgttggcctgcgttcgccgtgagatatatgaggagcccacagacccccactttgccgcgcgtgtgggtgtgttcacatctcacaagcccacgcgtgggagcccacagagaagggcgtgtgctgtgagagcactgtgcccacaagaggttccccccccacaggtgctgtccccacgcaaaaggctccacgagaggggctatataatgagaatattatttccgctcataatattcctctgccacccccgacactctcttataatccacgctgggtggagaagagaccgcgttctcacgagacctcttttggtgttccacattggccactttataagtttatagtatgtaaaaaagactggttataatgagtaacccacatgcactcgttaaaccctcacgaaaggaaaaggaaaaatgttttgtggagcccccttggttttcttttttgcctgtggcacgcttttaagttattagtttttataaatcagtactttttaatgggaaccaccttgaccccaaatttgtccccgaattttgagaccccctttaaaaagttaaatga

SEQ ID NO: 630063 - DNA, 712 bp, Homo sapiens
atccctactatctttggtctactcatactcctattcaccattcatcaactatctcatacacaccctgctcttgtgttacactgccggtgttacactgtttctccaagccatcacagctgatgtctcttgagtgctatccccaaactgcacactctaagctcttaatagtaaatgaataatctttgctggaccaggactatgactgaatctccttagtgcactctctaatcgagatgtcctaggtcctcccaattcttagaccttttatacctgtttttctccttctgttattccatttagtttcttaattcatccaaaacggtatccaggccatcaccaatcattctatacgacaaatgtttcttctaacaaccccacaatatcaccccttaccacaagacctcccttcagcttaatctctcccactctaggttcccacgccgcccctaatcccgcttgaagcagccctgagaaacatcgcccattctctctccataccaccccccaaaattttcgccgccccaacacttcaacactattttgttttatttttcttattaatataagaaggcaggaatgtcaggcctctgagcccaagccaagccatcgcatcccctgtgacttgcatgtatacgctcagatggcctgaagtaactgaagaatcacaaaagaactgaaaaggccctgccccgcttactgatgacattccaca

SEQ ID NO: 630064 - DNA, 369 bp, Homo sapiens
  misc_feature (31)..(31): n is a, c, g, or t
attagagatgggggtcttactctgtcatccnagctggagtgcactggcatgatcataactcactgtaacctccaatttctgggcttaagtgatcctcccacttcagtctcgggagaaactaggactaccacacctggctaatttgttttctttgtgtagagatggcctctcactatgttgcccaggctggtctcgaactcctggccttaagtgatcctcctgcctcagcctcccaaagtgttcggattataagcataagccattgtgcccagtcttttttcttctttttttttcttaatacataaaacaagacttgaagccaatgtcgacgcggccgcgaatctagtagtagtagtagtaggcggccgc

SEQ ID NO: 630065 - DNA, 181 bp, Homo sapiens
aaggacgctgtactgtggtgtaccgtcagtctagaaattgtgtatgaaacactcgcttctcgcaggcccattttccactgcctcccacctagaaccattatttccaaaataagtatttcatcccacagctcagtgaggatgatgggatattcttttagtccctttctttcttcgtctccta

SEQ ID NO: 630066 - DNA, 262 bp, Homo sapiens
tctgaggatcctcgtaacgagcctcgtaacgagcgctcgttacaccctcctaacagcgcctcgtaacgagcgcctcgtaactgtccgtaacgagcgccttctgtaacgagcgcctccgtaacgtcctgtaactgatgcgcctcctaacaccctaacgagcgcctccgtaacgacgcctccgtaacgagcgcctccgtaacagcccccctaactgaccccgagcgcctcctgtagggtacctatgctcgaacttcgtacatca

SEQ ID NO: 630067 - DNA, 389 bp, Homo sapiens
cagctcttacccgtactacatagtgttggtcttgtggggttggttgttgtaaagtctttttcaggcctgcataatggtcggcctgattgtgttttaggtcagtagctcaattggcagagcgacggtctccaaaaccgtaggttgggggttcgattccctcctgacctgccagattcacgtggtgtgtctggctttcttttcacaggatcttcatagatgactcctaaggctgaagctcaaagctctcgtttcgatctggtaaagtggctcgctgtagtcgccttggtggtcgtaggcgttgttggcaatcagtactattctgcttcgccgatcctgtaccgtgtactcgctttgcttgccctcgctgctgtagctgcctttgtaggcct

SEQ ID NO: 630068 - DNA, 399 bp, Homo sapiens
agacaatgagggcagttctctgtgtactcccaggcatctacctactgttaaatagaaaaaaagtcatcaataatgtacaggacacaatagcattttaccacttctatagcacaagcaaccatgcaacacgtttttcaagatacaaacatggaaagtgaataaggcgcgttgtagccggaaacacagcaaactggtaacactggttacccctctaggcagggtgggggattggtagtgccacacggtcgtagctcgtacacctttcaactctgtgtcaggagaaaacagccacatattcactactacacaggacacctagagaaaccgtgtagatgagaggctagcagaggcaatctagtacacatgaacttgagagcactgctaaactaaactgaggta

SEQ ID NO: 630069 - DNA, 1334 bp, Homo sapiens
agcggaggctcggtccggaggccgagggcgagcacagcagtctccgcctcctgctgctccggactattctgcgctgggctagtcggcggttgaccctgtgactgcgcccggtcatttggcttcgggggctgactgcgtcgcctagtgggctctcgcgtgtggagcagcgacatcatggatgacgtgcatgggcgctgctgggggcccggtgctcggggccttgggctgtgtggcctcctgggagaatgccgggcagtgctgcgctggctggctgtgtgcgttgcccagcggcgcggtcctcaggggtccctgggcgggggtatgagcgggccgtccgtaggcgtagggtagctagctggcatcttatcttctggttggctaggctgttgcgtacctgagggtcctgggtctgggaaaacaaccctgggggttcgcaattcctgaaattcgcgcgggcgccgcaggccttaacgtgctttcatcccaagtttggggaacaatcggcgcgtggctccgtagcttgtggagtgcggcccgaatcggggctttccctgtgcgcctttggatttccggccgtgcacattgtctgggagtccgtggtggagcctacagaaagaagcggtacacccggggaatatcgttgggtggcccttccatttgacacatttcgcatattcgcatgtcatcggagtataccggcgggacagaacctgtgggtcctgtacgagaattggccattgacgcgttaattattcgagagaccttagcgtcccctttaaacaccaggcaaagacattacattccgcaattcgcgcttgtgaacccagcacctggttgtgaacacccttggggccatttggggccatgtgggtggttcccaacactctcgcgcttcaccttggcaactgggccgaggaccacacctaattttcacgttcatacaataagcggaaccgcgagtggtggattatgcaacccttggcccagcgagtattgcgcacacatagcgggggtgccccaacctagggccccacaaccgagccatttcgtttgtgacccatcttcaccaaatgtgcgcttcccacggagtaataaatctgttagagcggcacgcgcaactacccaccattgtctggcgcgaattcttataagacaaccattgtgggcaccccacccactatgtgcgtaatggtgttcacccccagctatccccccccacgatggtggctcgtaccccaattcacagcccctccgctttctcctcttgtgcgcgcgcacgcagaacgaacgaccgacagatcacgcgggcgcgccaacaaactattacaaaacgc

SEQ ID NO: 630070 - DNA, 263 bp, Homo sapiens
ctggcttgctcaggtctctttaccgaaaaccacacgtgctaagcaaaaacaccaacggtcaggagcttgcagaacggcctctgacttactcctgaggcggtgagcgcacagcaggaaaccccgcacgttcacgcaaacacatcttgcagaactggcgcggcgcggcgggaggaccggggcaagcctagcagaggaaacgggagctctgcacgtgcaggattcagacccctaggcgatgaaactgcagacctgagcaagcccgg

SEQ ID NO: 630071 - DNA, 264 bp, Homo sapiens
cggtagaagatgaccagatatgtttgagacttcaacacccagcatgtacgttgctatacaggctgtgctatacctgtactgcctctggccgtaccactggcatcgtgatggactccggtgacggggtcaccacactgtgcccatctacgaggggtatgccctcccccatgacatcatgcgcctggacttggctggccgtgacctcacggactacctcatgaagatcctcacagagagaggctattcctttgtgagcacagctga

SEQ ID NO: 630072 - DNA, 310 bp, Homo sapiens
gactccctaacctcatgagatccactcacctcggcctcccaaagtatcgggattacaggcgtgagccactgcgcctggccctaaacaacctttaaaaagaacaaagttggaggactcacacttcctgatttcaaaacttacttcaaaactatgagtaatcacaacatcatggtattggaataaggaaagacacatggaccaatggaataaagtagagaactcagaaataaactctcccgtatattgtccattgattttcagcaagggtgccaaaagtatttagaggggaaaggacagtcttttcaacaaa

SEQ ID NO: 630073 - DNA, 834 bp, Homo sapiens
agcgggtgcccgcccgcgccgccaggctcgcaagcaccgcgtaggccagctggccggatcccgccgtctgtcatggcggcccccatcctgaaagatgtagtggcctactgttgaagtgtggtcatccaagtggaacagaaagattattcaacgacatttacaacacagcttgtggatatgggggcacaggtttccaaagacttttaacaaacaagtaactcacgttcatcttccaagatggctacccagagcacttgggacaaagctccagaagagaggcgtaaagctcgtttcggtgctccggggttgaaagaatgccaggacagctgtgagcacacgattgatgaatccttgttccctggcagctgaatatgaatggacacacttatccagcctatagttaagcaacaaacacggttacatggtttgcaggcccaagattttaacttttaaaagcacccggaacaatgattccgacgatttccgaaggaaactttgacgaaaagtggctaaagaagctaccaaggggcaaaaaagcgaagtctagactgatgatgtaccttattctcttatttgaagtctaatggttcattaagtatatactcccacaattgaaacttaatagtagtcaccacaggcgcaatgggagaagacgattacccagagatgcaccggaggacacggggacaaatcttttcaaccacctcttccccaatgattcagcagtctcattgataatcccaagtaactctctgttgtggaagcacctttgaaacatttcacgtgatactttgtgttcccgatgaatactttgctggggggtttacactcatg

SEQ ID NO: 630074 - DNA, 375 bp, Homo sapiens
agacacacagactagctgcaagtgcgattgggttgatggagcagttttacaatctccaaattaagagcttatgtgcttccttttgattatgaaaataatgtgttaattgtaactaattgaggcaatgaaaaaagataatactattaaagatataaaatataaaaaccacccagaaataatgatagctaccattttgatacaatatttctacactcctttctatttatatatacagacacagaaatgcttcatattttgattaaccgggattgtactatacctaagctgctttttctagttcgtgatatctatcgacatctctccatgcctccttcctggccttatttccctttgtaggacttaataccctcccac

SEQ ID NO: 630075 - DNA, 420 bp, Homo sapiens
agatcagttataggacagagagagacatatggtcgcacatctgagtataatgccagtgaatttgtgacctagccgcaggggttcagatttcatcctggaaacagtggggagtcactgaagaattttgagcatcatcggagtgatgtgatcatagccagaaattagaaggatgatttgggccattgggtagaaaggagttttaaaagcgtttgagagtgaaagatactcctacctttcacaatgatgagggagtaaaaatacatccttgacagagcagaaacacactggggtattgaggtacatcagtaggcagaactcagaaggcagggcaagtaagaagaggacattctggggtaactggttaccagctgcagcacctgggaggcagaggcaggtggatttctgagttcggtcgacgcg

SEQ ID NO: 630076 - DNA, 1213 bp, Homo sapiens
ccccatatctaacaacgtaaaacataaaactgacagctttgaacatacaaaacccaccccattccaccccacactcatcgccctataccacgctactcctaccatatctccccttttatactaataactcttataaaaaaacaaaaaaaaaaaaaacaacaaaaaaacagacacgcgcacacagaaacacacaaacagcaagtacaacagtacaaaaacacaaagcgaggtgggcgaggggtaaagagagcagttgattcaccaccatacgcgcgcgctcatcaacgtgaaccaagcagcaacaccacactattgtggtttgtgtgctccaggcgtgcgacgaccactcaaagtaagtcgctatgcgtccgtgtcatctatctccctctcgcgattccaggagtccagctaggaagaatcacaacgaaatacacaaccagaccgtcggtcgtagcgccgtggacgccacctctctccgtccatcttcgagagagtctttcgctggccatcccagtgtcgattactaacaccccacattagttggggtggtggtacacatgcaaaactcataggccgacaaacggcgagcgacgactcacatcgacaatgcattcgcgcacaccccggcggcaggtgttgagggcttcccatattcaagaacaggtgagagaaacgggcgtggatacatagagtgtcccaccacgaccattcagtcggcgaggacgcatcatctagcacgactccaatgagtcgacgcacgcccggatcacttttatgtatcacaaacggaagagagggatagaaccgcggcccatggccgaatgaatgaaaataacgtcacgagccccaagggctagcctagtgaagaaaaagtacgcggccggctcgcacaacagcggtaggatgcatggggactgggcgtctgggctgccgtggtgcgtccgtctaggagtaacacgggccgactgcgatgtcgtgccagccggcctgtgctctgctatcggcgcggcataggtcgaacgagagagcaggacgatgagcgccaagacattcgcggaaagcgagctcgtccactcggacgaccacccacagacgaccactccagacagaccaagacaagcgactatgcacaagagaacgagaagagagcgcacgacaaaaagacaccacggtacgccgcgcaactctagttcagctcatcaccgacgctctg

SEQ ID NO: 630077 - DNA, 1038 bp, Homo sapiens
  misc_feature (76)..(76): n is a, c, g, or t
gagcacatctgtgcgagactttctgtgcgagctctacctgagaacggcagacccaggagacgcgcacgtcacgcantccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagccttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaattataaaactcataat

SEQ ID NO: 630078 - DNA, 434 bp, Homo sapiens
tgcaatgttccgagtatgcctgtctaagtcaacctcgtcagccagtgagctagaggtagggtcgctcaagtagccttcaatgatggcagggaccgctagaccgttggtctagtcagaggcatagagcaggtgctgcatgcgtatcagatcagtcagggtctatgtattgagtagcgcggtctgcgacatctctgcgtaagctggccacgcgcgcgtgcaactgcttggcaccgtgtatcgaatctgagcgagtcaagcagctgggctgtaggcagcatagctgtcgtgctagcatgtatgtcaagatacgtcacacgcgaacgcagcattcgagtgtaatgccgtaaggatgtaatagcacagacagcttgataaccacatccagacccctgacagctcagtgcatcggggatcgctgcactcccggtgcacgc

SEQ ID NO: 630079 - DNA, 483 bp, Homo sapiens
ctgaggatctcatggtgtcatccccctggcacctgcatctcgctctctatggggcaggacctgccctgccgtggatggacagtgaggacacttcggtgtccactgcaccttggagcaggcggtcacggccacctggtggtcgtgcgttggagacacagatggcggggagcgtgacttcttcttgggtggatgctccaggctagaagcttcaggagcccactcttcttctctttcttttcacttttcttctcgtctagtttgcatcccgtgttggtggggctggatgtggacagaacaccgatgggcccccctccagcctccccgttgaggtttgcggcactgacgttgggaggtgtgatggctgatgctgctgatgtgagggggatggccggccgtgggcacatctgcaccgggggctggtggctgtgctgcggggacaccaccgagtggggcctgaggctggtggcaggcaggcgggatgga

SEQ ID NO: 630080 - DNA, 411 bp, Homo sapiens
gattattttcttttaatgaaaaggaagcttctgggtgggatgcagtggctcacacccgtaattccagcacttagggaggcagaggtgagaggattgcttgtggccaggaatttgaggctgcagtgagttatgatggtgtcactgcactcaagcctgggtgacagagcaagactgtctcttaaaggggacagggggccgggcgcagtgggtcatgcctataatcccagcactttggaaggctgaggcgagcggatcacgaggtcaggagatcgagaccatcctggctaacacggtgaagccccatctctactaaaaatgcaaaaaattagccaggtgcggtggggggcgcttgtagttccagctgctctggaggctgaggcaggagaatggcgtgaatctgggaggcagaga

SEQ ID NO: 630081 - DNA, 338 bp, Homo sapiens
  misc_feature (309)..(309): n is a, c, g, or t
  misc_feature (322)..(322): n is a, c, g, or t
tagaaacctaaagtgtcaccactctgggtgactggggcaggagtgaggagaagcctggaatgatatctgcttgctccccaccccaccctcagcacctccagaggctcctcaccagaacccccagagttccttggggctctgcttgaaaacctctcctccctaagaaatccccccgcagcttgctctgcaggtggacagttttgacagctggtctctaccttctcaggcttggggacgtaggaaaaaggagagccttctaagtaaggtggaaggattggaatcaagaaatagcaagattctgtgggtttngccccagtcaagntttgcctagggtagtc

SEQ ID NO: 630082 - DNA, 211 bp, Homo sapiens
tcttctttttttattcggccagttcgcgagactcatggataactccgagtgtccccatcaaaagattggtggaacgaagggcccgaacgagacgcttaggcgcccttcttggtcttgatgtagttgattacgtcgcctacggatttcattttctcggcgtcttcatccggaatgtcgacttcgaactcttcttccatcgtcatcacgagct

SEQ ID NO: 630083 - DNA, 215 bp, Homo sapiens
aaaaaaagggggggggtttttgggcccccaaattttcccaaaacccgggggtttttcccccttaaaagggttttttttaaaaaaaattttgcccccccccccgggggacctttttttaaattttttttcccctttggccgggggtttttttttttttttttttgcggttttttttttttttgcccccccccaatttaaccccccccaggggccca

SEQ ID NO: 630084 - DNA, 137 bp, Homo sapiens
  misc_feature (123)..(123): n is a, c, g, or t
tctcacgatccccccaccagaaagggcatgtcacaagaactcttcatcatgctgtgtattccctatcttccctccgtctgctccccagggttcacttgtgcacttttcgcgcggattatggangatatgcataccca

SEQ ID NO: 630085 - DNA, 146 bp, Homo sapiens
atatgatacacttacacatgtgaacaaccttacatctagcttgtctttctgctaagctgttaaatgtatttatagtaaaggaagaaagaaagactgtcatttccttataagttagagtaacatcctcctctggataacttgactgt

SEQ ID NO: 630086 - DNA, 861 bp, Homo sapiens
ggacccttccatcagaggacccttccatcggaggacccttccgtcacaggacacttccgtcagatgatcctgcaagccccttcccaggattctaatttcacctgcgcttctggccacagagagttagctgcttcctggaacgtgttggctagttgagtcacccttaaagtgctgtgctcaagtccctcttcactcaggaacatgaagcctgaataagccataacactataagagagcatgaacagtataaaccataagatatgattcttcctcaggaatgactgttgcctgcagttggggtcaggagggaccagcactccttatacggagaggacaagtgaggcacttggaccacttccttggtgcacttggtggatgctccccaccccagtcctgcagtgtgtgcaggaggccagactaagctactccccagatagacacgtggcaacgcccccaagcgacaatcccttggctagcagtgtctgtcatcctgacgctgggtgggctgtgtgggacccagtggctccaaggggccctgtctcatctggagccactctggacttgcatactgtgtccccctcattgtctctttatcacctgctcctcactagcctccatcatgtcaatggcaggtcatgattccacccagcaagcagacgacatgtccataatcctccctaattagcagcaaactcatcttgggaccatctcttggtaccctttgctcagcttctggtcactccagacccctgactgacagcaaggactacgaaaacagtgcacggacaacccgatttaaaccccaaggagatagggcatctatgatacttaggacaacagagaatgcaggattacgggcaa

SEQ ID NO: 630087 - DNA, 229 bp, Homo sapiens
tatagcaagcagagacaggtcatagtctgcctccatgtacagaacgagcacacgggtatcggctaaaagaaggacagatcctagagtgttgtgacttatgacctaggctctggactccggaccgcccacattcccgcgaccgtctatcaatagagacaaacgaacagcacacgacagacagacacagagtcttggaggctagacccagaacttagtgaggaccctagaa

SEQ ID NO: 630088 - DNA, 120 bp, Homo sapiens
tcgacttagaggatcccgctcacccgacggggttggctctttgactcctcggggtgcaatgtcgttgttatcgtctccggggtcccggcttctccctcgtcccccttgaggccggggtag

SEQ ID NO: 630089 - DNA, 358 bp, Homo sapiens
catgtcggtgtatctcttctctccccatactgcagattttgaggtactgtgctcaagcatcagccctaacacctgtcacaatgcctagcatacacgcaggtgctcaatatttgttgaataaacgaaaactatcaagctggttgggcgtggtggctcatgcctgtcatcctagcactttggaacatccaagacaggcagatcactggaggtcaggagttcgagacccagcctggccaacatggagaaaccctgtctctactataaattaaaaaaattaaccaggcatggtggtgcatgcctgtaatcccagctactcaggatgctgaggcaagagaatcgcttgaacccaggaggcaga

SEQ ID NO: 630090 - DNA, 260 bp, Homo sapiens
gaggatccccccgcaagacttggacctctgggactatttacagtatgcctatacaatgtatgtacagcgtagtatacactatagcacaagtttcactgctggaatatggcttctagtggaaagtgcatattttgccagaggtggcaatactgtctagaatttcccgggttacagatactccgtaaccacatccaaagctgaagtagaatgtggactatacttatctacgaaagtgctatctaaacggtccagtacactgc

SEQ ID NO: 630091 - DNA, 818 bp, Homo sapiens
ctttgcgaaagccccggagggtgaaggtccctttttctcccccactagaatgtttagtgttgtgctcccaaaaggggcgcgcccaaggcggggttcttaaagaggggattctccttggagggctggtgcgaaatcacacactggggtgggtagtatgtgatgaccacacaatgtcttatagtctctagaggttgaatattgggcgccctcacctcggtcccggcgagccatctcggcggtttccggccccctggtttggctgcccgcgaggcggcggtgggcctcgctctatgatgagtgtttccccctcttccggggccgcccgcccccccagagaggggatgttgtatctgtttttccccgcttgtgtccatttctgccacacaggaggccctcctcttctgggaggggaggtggtatctgtgtgtgaaaatactatttggtgccccgcccccatcatagagattttttctccgggcgctgttaatattccacccatcttgtcttccagacgagagaggtgggaaatttgtggcgctgccgcgcgtgtgaaccaccgccccactctgtttcccgtcacacaagagtttgtgagaaagctacacaacaggtctttctcataaagactcgcgacagtggcatcagatgttaacaagtgccactctccttcccacgcacccccaccacaccgaccgaggggtgggcggtttttttatcaccccccccacccttgttctccccaacctccttctcccgttttttttttccccgcggggggggtttttcccagaaaaaaaaaaaggggtggagccccccca

SEQ ID NO: 630092 - DNA, 139 bp, Homo sapiens
tgtgagagtatgacagttactcatcactcacacccaggcggtaggtgggagaaatttaattcacgaacaatggtgaatggacctggaggatggggatttcctttgtgggggactactcgttggccttgccattatgcaa

SEQ ID NO: 630093 - DNA, 958 bp, Homo sapiens
  misc_feature (4)..(4): n is a, c, g, or t
tctnttcggtcatgtgtgttgaatgtcgacaattacttagtcattacactactaccataacttggtccgaccgtgtgcggccgctattttaaattgctcccgtcataggcgtctccacgggggacacaaacaatttgttgccggcaatttattgggcaccggcattttccaggacggagaattctctcaacggggaaagtgggttcaccattccaccgcccttgtcctgggacccaccactacagacactggccgaggccatatttaacctcgggaacttgcgtccccaagcccgtgtgtttagtcctgtctaccctccgtgttaaacgctggatatccacgaccccgcggccaaaaaaccatggccccaatggaacgccacatacacgtgtggcgggcgccgccccctaaaaaaagggagtgattctgaagaggtagtcacgtagcgcccacaccaccaacatgttggaccacacgactgggggctagcgccaactcccgcgtgggcccccacaaaagggagacacaggctggtccttgccccgcacagttagcgggagcggccaccccgcctgctaccacaaccggtgatgggaagcaaacggggggacacaaccccaccagggttcttgggaggagcagaccaagcagagatcactttggtttaccaaccagagaaggcgggcacaactttcattgttaaacgtttgcacaaatgcgtgtttcactcgccggcgcaacaaacaagtccggtactgtcatttgtcgggacgataacaatctacgggcctcctccacccgcgcctttataagatcatccgttgttcggtcatggcaacaagcgccatttttctattcgagttaactcgtcgcgcagagagaccactgctgtgccccagacgtcaccagtgaaatatagtcccaaattaaaataaaaccgagcccccccaaaataaca

SEQ ID NO: 630094 - DNA, 85 bp, Homo sapiens
gcgaggatggggatgagaatgaagaggatgacgaggacgaagacgacgacgaggatgacgatgaggatgaagataatgagtccga

SEQ ID NO: 630095 - DNA, 361 bp, Homo sapiens
tatttgggattatgggtacataccaccacgcggagcttatttttgtatttttagtagacatggggattcaccatgttggccaggctgatctcaaactcctgacctcaagtgatctacccacctcaacccccaaagtgctgggattacaagcttgagccactgtgcccagcctcgagcatgatttataaggctggccggagacccttctttctttgggtttgaggtgctccgcaggctgactgttgctggattataaatgtgatttataacagttattgtgcatctgtgcagcacaagccaaaggcagagttttgtgaaagctgtggccagttgagaggtacattctttcctttcttttacc

SEQ ID NO: 630096 - DNA, 265 bp, Homo sapiens
gaaaccctaataacgtccaatgtatttgcgtagatcagcttttcacgtgttatttaccccttgatgttcttaagcttccagctctctattctgaacctgtaccaatgcagcaaaacgaggctagaggaaaacatactatccaacaattagtgtttcttcatttaaaggcaaacatcaagtgagtcaaaatcactaccatgtaatcgtattgtacatcactagtttttactgcgtagttagggtttcgaaaccctaattagggttg

SEQ ID NO: 630097 - DNA, 140 bp, Homo sapiens
atgctaatttgtctattactactcttccaaaaacgtctcatataattggaattaagcctagcactttacttgagtcattaaactatattttttctgatagaacagggtatacacgcatatgaaagttgcaggctctttta

SEQ ID NO: 630098 - DNA, 236 bp, Homo sapiens
  misc_feature (5)..(5): n is a, c, g, or t
  misc_feature (17)..(18): n is a, c, g, or t
  misc_feature (66)..(66): n is a, c, g, or t
  misc_feature (79)..(79): n is a, c, g, or t
  misc_feature (105)..(107): n is a, c, g, or t
  misc_feature (132)..(132): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (168)..(168): n is a, c, g, or t
  misc_feature (177)..(177): n is a, c, g, or t
  misc_feature (235)..(235): n is a, c, g, or t
gactnttataatcccgnnagtgtgtaccttggtgtatagttgttaagccaagtgcacagtgccttntgagtaccagggntcccatcagacaaactagaaaagggnnncctagacatgctgctgctgtttcantgtggngcatgncttngcagtattgaaacagatctnactttttgnttggagcacaaaaatgatgttattttagaaactcttttggaaaggtataggcatgaanc

SEQ ID NO: 630099 - DNA, 102 bp, Homo sapiens
tctagtcgcgcactacgaatgccccagacgtcctctataatcatggactcgattccgaaaacctacaaaagagaaccgggtcctattccatatattcctagc

SEQ ID NO: 630100 - DNA, 503 bp, Homo sapiens
ctgctggatgcaaggtcctaggggcacttgcaggactccggggggcagaggatggggcccctgccagcacccccacaggcctgctgggggtatgggttagaaagcctcatatgaatcattgctacatgtggtggcatgacccttataaagtctcctccctttccaaggcccacatcctctccataaaagggtaataacagcagtgcatctgtcaggtggaggtcaggaaggaaggggatcaaaagcatgggagcctgcgggagagatttacacacatacctgctgcaagctaggaaacgcagagctggcctcccaggccttgtgggaggaacatgtaagcaaataagaacttgtccctaaccctagagcacccagggaactagggagctgaacttggttcagagagaacagcaggggcaaagggtaggaagagaatgagtggaggccagggatgagggcagtaagttgacataggagagaggtgagtggagtagggttgggta

SEQ ID NO: 630101 - DNA, 912 bp, Homo sapiens
cgttcacataaatggcatcctcgtgtaggacatgtgaagatgatgatgttctaagcttctactcgctgttctgtatggctgttctcttacacagaatgtaacagaagttgcgtgactctttatttttacagaattggtctctcggtatgctcacgcaggaagcactacgagagaccccaacctttatgtacagaagttgcgtggagacatagcgaggtcacgtgtggacactgcctgaacgtactcccaaacatgtaaccgtagccatccactcgtgacattgctagactagattcacacatgaaaccattaatatatcgatgaccataaattatgccttacgaagagacaatgagattctaaatataccactacattgtttgaaaggaactttatagatcgtgtgtacattaagaatggtcaacgttagctctactataaaagcagtctacctgcgaataattacggaggagaaagctcagctaatgttataacaaaatgctctaataagggagatagggttaaaattgacgacggaagtatgcggagattcacgagaaaggtgaactcgattattagtaggcctggtggaagaaatgtattgtcacagtaccatgtaagagtgttcataggttgtggatcaagggaatatgcccttaggggaatgagtactaaaatgtcttttattcgttaggaatgctgaataatgcggacttaggattaagagggcttgctctatttagagggagagactagctctttttataaattggataatcctataggatggggaagcaaaaagatatggtcatgctgttgaatatgggtcttcgggcaattaattctttttaagcactatggacactgtgtcaaaggaatgggttctcaaggaagctgataatagggtagcca

SEQ ID NO: 630102 - DNA, 187 bp, Homo sapiens
gcaaatgactatatgacgataatctgaaccaacaagatagtgatagatcgcgggaagtagctcgacgcatcataatagcatcaagtgtgagcagcagcatatggaggctatactatactacgacttcaggctcagccgttgagctctcgaccctcgtcatcaatgacgactggtatgcatgacgctt

SEQ ID NO: 630103 - DNA, 534 bp, Homo sapiens
  misc_feature (14)..(14): n is a, c, g, or t
tccggggtctccanacatttttcccggcttggtggtcctaaatcttgtccaaatgtcagagtgcagttgtgagcttgagagttcttgcttgggttgttgaaaaattgacttgaggttacaaaactgggttgggtggtattgggaaggcaaggtgtgggattggttttgggggacaacaaggcgcactgacaatccagctaatccagaagccacttgtggtagcactgcaatatgtatccccaagcccaattaggagggaattccttaccaggaaagacacaaggtgggttctactagaacttcggcgctctggaaaaaaacctccccccgcatgctttttttgcgggcgggcccgtcattcatatcgattccgaaaatctctggggggggagtcttacttcgtggcggaaaccaaattttaaaaccccttcgtgtgtgcaactttaacacaaacttggttcctcttgggtgtgtaacccaaaactcgcaacacggactgcttaaacccaagtggattgggccccaaatattcgg

SEQ ID NO: 630104 - DNA, 426 bp, Homo sapiens
  misc_feature (79)..(79): n is a, c, g, or t
ttttttttgttttgggacagagtctcactctgtcacccacgctggagtgcagtggcgtgatctcggctcactgcaagcnctgcctcccgggttcatgccactctcctgcctcagcctccagagtagctgggactacaggggcccgccaccacgcccggctaatttttttgtatttttagtagcgacagggtttcaccgtgtcagccaggatggtctcgatctcctgacctcatgatccacctgcctcggcctcccaaagtgttggactacaggcatgagccaccgcgcccggccggatggttaaaacattttaaaaataaatatttagtgctaagacaggatatggagcaacaggaactcctatatgcttgctggtggggaatgcaaaatgggtacaaccacttttgggacaaacagttttagtaa

SEQ ID NO: 630105 - DNA, 226 bp, Homo sapiens
tcctagcctcgccagtggctgggactacaggtgcccgccaccacacctggctaatttttgtatttttagtagagacgaggtttcactattgtgggccaggctggtcttgaatttctgaccttgtgatccgcctgcctcggcctcccaaagtgttggggattacaggcgtgagccaccacgcccggccaacttgcttttctctaatggctggcgatgttaatttttt

SEQ ID NO: 630106 - DNA, 1174 bp, Homo sapiens
gccccgggcggatgcccaaagactccgggttcccaagagcccctgcggccgggcgcgaataatggcggcggtcgtgcgacggccgggcagctcctagaatgcacgcacgttatgagagcttccctcagggccagagggccggagcaggctcatttagactctgacaccagtgcttaccgggtgactagcttcgctagctagctcgtgctgcgtagctctacaggcgccagtcggggttctgcctctctcgtcctgcgcctctttctcgggatccagctgtcttgcctggtcatgctgccgctgctgccatgacagctgtccttccgcagattcggtacgtgctggacgcatgtgttgctgcgtgctactgggctctgtgtgccctggcatggacggactccgtggactccggagatcacacgtagtcagaggtacctcatttccataccattgtagacatccttattcgaaccacaatcataggtcaacttttgctataccacctgtaagcgaccccttcttactctaatgagtacccacgcacagcatattagctgtgcgtggtctcgtgggcttgcatggagcatgactgggccggctgagcgaaggatagggagagcagttcactccacaggacgcattcctagtagctttcgcaaggagagcgtagccacctcgagtccctcatgccagcaccttgcccctgcacgcgaagaattgccaccaaagtggtcctggccacctggctcccttgcggcttccaggtcaccctcgggctcatctcatcgtagtccaaagcatggtggtcacaagcgctgcattgccccttgcaacagtcaccgtaccaaccccataggtcgtcgtgtcgcccaggctcgctggcaacttgcccttcctcggagatctcacgcaacattggctggggaacctgttctacggagccccgctacccacggacgccacatcacacgcgaagcgctcagcatcgaaacctgcaccaaccgcaacaaagaccgagacacggagacagacaggcggctagcgacgcccaggcaaccaaccgtggcgctgccccagcacacatgggcgcgtatccgcgaccgctgcccacaaccacaccggctcccgaaaccacgtagagcccaaaagcccacgaaaaggccccgtaccaaag

SEQ ID NO: 630107 - DNA, 410 bp, Homo sapiens
cagcaggacactgaagatatgtaaattatcaaattaaaagcaattattggtcacacaaatgatggtaaaataaaggattggtgtcacaaatcatgtatttgtgccaccagtccatctcttcaaggttacgtgagttattagtctaaccacagctagctaaatgacagaaccagggtctcgaagacgttactgttactgagtctcagcttcctcgtctacgaaatgaagataataatacctaccttactacggaaacttatgttaagaacttcactactattagttctctctgttccgactctaggtactacacctttcattcacatcagtagctccttccataaggtctaagaccaacactacagatcaggtattcgcaaaatacttgtcaactgcaagtcccagtcact

SEQ ID NO: 630108 - DNA, 444 bp, Homo sapiens
ccgctaatcgccgctttactggcgaatccgggtattgagctctgcccttgttctgcctccggtgatggtgagccagtcaaggagttgagtggttagtgccaacctgccagatatggaggactactccccggtgtgcactacccccagagtttgtaccgcagatctttcccatagtgctgtcttccagtgaatagtgacatcccataagtagttttgattttgttgtatgggttacttgcccaccagaaacagccctagtccccactccttgacgttcctttggcccctccctgcctacctaaaatctgcctaaaatggctggagatgggcactattggatttgaatcgaattcctgcatcccgatgaatccactagttctagagtggccgccacctgcggtatagctccaacttttgtaccctttactgagggttaattgctca

SEQ ID NO: 630109 - DNA, 504 bp, Homo sapiens
ctctggatgcaagtgtccttcccacctagttcatgtactcatcgcacgttatcagccagagcttctgcggcggtggctataggcgtcaatggtatgagtgtctgcagccaactggacttgactgagcatctcctgttcattctcactggttctgggcttgcttgatactagagcagtacactcgatgtcgcctgaaatgtccgcacacatgatcatggtccgcctccctctgacttgtcgcctgtgcatgtgcccagccgtacccatgggatactgttttgtgctacaactgacactatcaaacgatttgcagattatgtgactggaacataaaatgcatattcccagagcacttatttatagagcatacccttctgtgggttgatcatgaggctgtgtatgaggtctgtgtggaggcagagctgaggagacgtgggcttggtccccacagatcatgctggctggggggcttggcacgttgggcagctgctgtgattcttcgcc

SEQ ID NO: 630110 - DNA, 763 bp, Homo sapiens
  misc_feature (24)..(24): n is a, c, g, or t
  misc_feature (86)..(86): n is a, c, g, or t
  misc_feature (89)..(89): n is a, c, g, or t
  misc_feature (94)..(94): n is a, c, g, or t
  misc_feature (100)..(100): n is a, c, g, or t
  misc_feature (110)..(110): n is a, c, g, or t
  misc_feature (124)..(124): n is a, c, g, or t
  misc_feature (154)..(154): n is a, c, g, or t
  misc_feature (200)..(200): n is a, c, g, or t
  misc_feature (203)..(203): n is a, c, g, or t
  misc_feature (224)..(224): n is a, c, g, or t
  misc_feature (229)..(230): n is a, c, g, or t
  misc_feature (236)..(236): n is a, c, g, or t
  misc_feature (238)..(238): n is a, c, g, or t
  misc_feature (248)..(249): n is a, c, g, or t
  misc_feature (254)..(254): n is a, c, g, or t
  misc_feature (278)..(278): n is a, c, g, or t
  misc_feature (285)..(285): n is a, c, g, or t
  misc_feature (292)..(293): n is a, c, g, or t
  misc_feature (298)..(298): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (323)..(325): n is a, c, g, or t
  misc_feature (348)..(349): n is a, c, g, or t
  misc_feature (377)..(377): n is a, c, g, or t
  misc_feature (382)..(382): n is a, c, g, or t
  misc_feature (387)..(387): n is a, c, g, or t
  misc_feature (389)..(389): n is a, c, g, or t
  misc_feature (392)..(392): n is a, c, g, or t
  misc_feature (400)..(400): n is a, c, g, or t
  misc_feature (415)..(415): n is a, c, g, or t
  misc_feature (446)..(446): n is a, c, g, or t
  misc_feature (472)..(472): n is a, c, g, or t
  misc_feature (480)..(480): n is a, c, g, or t
  misc_feature (483)..(483): n is a, c, g, or t
  misc_feature (497)..(497): n is a, c, g, or t
  misc_feature (507)..(507): n is a, c, g, or t
  misc_feature (519)..(519): n is a, c, g, or t
  misc_feature (524)..(524): n is a, c, g, or t
  misc_feature (537)..(537): n is a, c, g, or t
  misc_feature (543)..(543): n is a, c, g, or t
  misc_feature (578)..(578): n is a, c, g, or t
  misc_feature (629)..(629): n is a, c, g, or t
  misc_feature (703)..(703): n is a, c, g, or t
  misc_feature (763)..(763): n is a, c, g, or t
tatagaggttttatcagccaaggntgccttcatattgaaaaaaataccttatctcacttgtaatcataaacattattccagtagangangtacnttttcnctcctttttntcttcttgcctgtntaatcaccataataagttataatgaaatanctcttacataatcaaaggagaaaagaaagacaaaaccaacatgccncancctagacaattccatccagcnctgcnncctccngntctgttttcnngctcnctccacccagcactgccgccctcngatctangttttcnngctcncnccncnccccactccaattaattnnncccccccccccatcctactttgnnggggggggggttcaccaaatgggggggnttgtncgggngnganacattttntggtgagtgcgggtnggatagaaagtaccgggggggggggagggcngcccttctcttttaatcatcataggngggtttantantactcaagagtgtnctttaatgantgatccctgatnaaggntttggcccttcanactgcngctgttcagaacgtggaatgtttctgctgaatccnttcttgatgtctctctttggtggtcttctcattggtggtcttctcttcagntgggttgttttctcactaggaaaaaaaatgttccatctctggaattaacgttgatggtgttttgctcattctgnaagtttttatcctcccttctcaagcatgctctgtttggcatgattgacacagtgcatatn

SEQ ID NO: 630111 - DNA, 1261 bp, Homo sapiens
aaaaataaagacaaatgctgcgcccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaagagaacgagagagaaaagagtaaaacaaagaacccaagagaaagaaaagcacagcaaaaagaaagagagagagagggaagcaaagggagagagtaggaagagaggagaaggggagaggaaaagagaggggcggagaaaggagagaggaggaaaaagaaagagaggagggaggagagagaagcagaaggaagaagaaagaaagagggagaacgagaagagaggagagcaagaagcagagaggaggacaagagcgaaaaaggagagagagggcgaggaaggaaaaaaagggagaagaaagagagaagaaaaaagaggagaaagaagaggaagaaaaaaaaggtagaggagaggagaacagaacggaaaagtagataagggaaagaaaaagaagagaggggcgaaaaagcaaagaaaagagagagaagagaagggaaaggaagagggaaagagagaaaaaagaagaaaaagaaaaaaaaagaggagagacaggaagaaaagagaagagagagaaggaaagagaagaagagaagaagagaagagaagggagaaggaaagaggaagagcggacaggaaagagagaggaagagaagaggaggcgggagaaaggggagaaggacgaaggagaagggaggagaggaagagaagaaaaagaaaagagagagaggagagagagaaagaggaaagaaacggaaggaagaaaaagagaagggagaggaggagagaggagggaggaagaagggaagagaagaagggaaaagagaagagagaaggagcgggaggaaggaagaggaggaggaggaagggacaaagagaaaaaggaaaagaaaaaagagagagggaagaaaagaagaaaggggagaagaagaagagaagagaaagaaaaaaaaaaagaagaaggaaaagagagaaaagaaaagagagagaaagaagaagagaaaaaggagggaaaagaaagaggaaagaaaaggaaagaaaagagagggagagagaagagaagaaggaaaagaaaaggaaagaaggaggaagcgaaaggaagaagaaagggaagaagaaaaggaagaaggaagaagaagaagagagagagaagaagaaagggaaaagaaagaaaagaaaaacaaagaagagagaagaaaa

SEQ ID NO: 630112 - DNA, 116 bp, Homo sapiens
atgttccctagcgggagaatcgcttgagccttggaggtggaggtagcggtgggccgatgatcgcgtctttgcactccaggcctggacaacaagatgtgaaattccgtctcaaaaaa

SEQ ID NO: 630113 - DNA, 951 bp, Homo sapiens
tgaaaagggctgagatgccgcgccaaacggttagcagatcctctatcggctggttcctgtgccggcatcgtcgtcgcgtctcctgatcctctgacagtttgtgcctccctcttctgcctccgttctttatctatcccgtcgtcgtgaagatgttgcactgagaatgcattgatcaggagtactacgcagcaatgcgtcgaacccagaagacttcattcatgtctgctgcccagtcacaaggtgactcactgagccgaacatggtgccgtcacctatactgcgtcccctcttgtcccgactaatctatggagaaagacagttggaatgcgccattctgatggggggaatagaatgctgtttacaaaaaaaacaactgtataagactggatgttaacggggatcatagtctactcgagctcaatgtccatagtcacttgtttggtgaagatgggtgcgagaaccggtagatgtattggaacacttttgtctatcaacaagtaatgcgcatgttcggatcgtgaccacgaattagacatatacgggcctctcgtgtgaagcattaactatccagaacaacccatgggtgctatagctcctgtgcctacagatatgtgcgatcgtggacccgaataccagaacgtaccggatgcaccttcgtacacatgctttggctggaatgcactgagagatgctgggctggcaactgcgttgctggagcaaacggatttgcctgtgcccggccctgcggagcaccgacgagtaacctaggatcaaggctctcccaacagacaggtgttcccctgcgtggtgaaccacagccctggctgttgcggcgccctgggtgtgcaaggctctgacaggaacacaacggtataacaaacagtgcaacaaggctatgtacccaccaccgcttgggcacaccacacctcggggcaacgtatggctcagccc

SEQ ID NO: 630114 - DNA, 218 bp, Homo sapiens
  misc_feature (18)..(18): n is a, c, g, or t
ccgagtaagttgactcanaagccatcattaattcattcaactgagaggtgctggaattctcttcagactgcagcatctctattatctcaaaaagcagtccaggtgctatcagagtgatgaccttgtgctcagctgcgtgattgccaggtatgcttccaggaaatgagtctcgcattgcacacgcactctccacaggttcttccaacccgggcttttct

SEQ ID NO: 630115 - DNA, 445 bp, Homo sapiens
  misc_feature (25)..(25): n is a, c, g, or t
  misc_feature (431)..(432): n is a, c, g, or t
  misc_feature (434)..(434): n is a, c, g, or t
ccttccttaccctcaactgccccgncagggtcctttgcctggatttagccagaagggatggccagcattccagcctcaggctcctggccttacacaaaagcacgatggtgtcacctatgagactggtaacattcctttcacttgtcccatcctgccctgcacagctttatcctaaaactgttctgaagttggtttccctctgggagaaaataaaagtttgcagagcacagaagtgattctaacagcaacgtttatcggctggttatatgttgagttctagtctccaactttacttatcctccccttctatagaccccaattcacttcataataaaaacagctcctgacagtctttgcgttctcgtttttagaaagatgacaaaatcacttataaaatcaaaagcatagctataccttaaaatacatattgnngnttactatctgc

SEQ ID NO: 630116 - DNA, 650 bp, Homo sapiens
  misc_feature (243)..(243): n is a, c, g, or t
  misc_feature (281)..(281): n is a, c, g, or t
attctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattntaccccatccctgcatgactgtgaagctggcgaggaanggaggaagaggggcaagttcaaaatgcaggcttggttggcttggaccagtttgctaagggactaccttggagggcttttttgcctggattggcccatttgggcccaaccccggtttttgcaggaaccaaaatcccctcccaaaggggggggctgcctttgggaacaggggtgtttttttcccccaaaggcccctcccccctatggttaatttctttttgtcgcacaaaaaaaaaaatttttcccccgggggaacaaaaggggtaaaaaaaaggggggggaaacaacccccccccgtgaaaataaaccctttttaggaccccccccttggggcacaccctttgaggtagtattaggccggggcccccttt

SEQ ID NO: 630117 - DNA, 513 bp, Homo sapiens
tggaatcagttattggcagaggcatcttctggtcgcatggggtgaacgatgtctatagatcctcatgtcacacgaagcctgagaccacatgaactgttgtgatgtcttccttagaaagggtaggcatggaaaattccacgaggctcattctcagtatctcattaactcattgaaagattccagttgtaatttgtcacctggggtgaaaagaccagacaggctttcccaggcctgggtatccaggaaggctctgaagccctggtgaaggaccctaactagagttctagagtttctgcattctgtatctcagtagtccatattcgaggcttgatatactaggtctgcaacaaggaggtcgcacttataatgtatgaagaatgggatgcatatgatcctcaagactaagaaagctgtcagagggatgctctggccctggtgtgcacggctgtagcaacagttgatgccagtgtcctctacctcatgctgtccttgtgcttaaacacctctatctcc

SEQ ID NO: 630118 - DNA, 534 bp, Homo sapiens
gtagcagttactatactacttctagtataggtacagcaggttatcaactgcaaccttattactctggccaaaaataacaaaatcaaaacaatcataaagactcaatattcagacaataatcttgattaaaacccagtattgctcaactgggtgtggtggctcatacctgtaatcccaggactttgggaggccaaggtgggaggactgcttgagcccaggagttcgaaaccagcctaggtgacatagcaaaattccatccccacaaaaaaatttaaaaattagccaggcatggtggtgcacacccctagtcccaactacttgggaggctgggttgggaggaccacacgagcccagaaggtcaaggctgcagtgagccatgatcgtgccaatgtactccagtctgggtgacaaagtaaggctgcctcaaatataagcaacaacaaaaaacaccaatattcctctggctcgaatgcagctacctatatttagatatccccaaagtgaagttgacacagttctccaacacaataacag

SEQ ID NO: 630119 - DNA, 712 bp, Homo sapiens
cgacaggtggtatcggtggtgtttcccctttctctcgttgcgtcgtctgttttctcgctgtgctatcccgtcccgccgccgcctctcattctttttctattcctgttctttctctcgctctcccctgtacttgttcgctctcctctcactctccgcttgcgtggtctcggcgtcgctcgcctgccgctctcgtcgctgcgtgcgcgttcgttgtttcttgtcgtgtcgttctctctcctaagttggattatgccttcacttcttcgttcttgcactctcctcttgtgtgtcgtctttcctctcgcagcgcgttggacgggtgttgtggtctcccctctccctgctcggcgctgggtgattcatctcctgttttcttctcccctccacgctgcctccctcccccccccgccctcccgggtggtgcccttctctctcccccctcccgtcctggcttttctcttgggctgtccctttcttcccccctctgcttcgctgtgccccccccctctgtccttccgctcccccctctctttgttctccgtgtctctgccttctttcttctgtgtggcttgtccttgtcgtgcatctgttcctccccctctcttgtcgtgtgctggcatacaatattaacaactctataacaaaataacataacaaataataactaaataatatatacacaaaataacaaaataaaaaaatacagaaaata

SEQ ID NO: 630120 - DNA, 109 bp, Homo sapiens
gcgcaaatggtgatgcattgccaacaggctctccaaggttcgatgtttccttctgagtgccatttcagcactataggcatttcggtctgtttctcctagtatcgggtac

SEQ ID NO: 630121 - DNA, 304 bp, Homo sapiens
  misc_feature (132)..(132): n is a, c, g, or t
tcatctcttgagtatgaacagcagtcggcagctgtctctgcagaacatcagggatacagaagtcaccgcagcggaagggccagctcaagtctgaagcgcggcatgccagaccatgcagcacatacagcccgncagaggtgtggctggaccacgtggacaggatccggtcagcagcccctgtggctagaggaacaccagcacaaacgacaggctcaagtctccttcgagctttatatccatttggggatgaagtctactttgacagctagcaaggcgacatgcaactgttgttgaatgatgacag

SEQ ID NO: 630122 - DNA, 114 bp, Homo sapiens
  misc_feature (97)..(97): n is a, c, g, or t
ctagaggatccggctcacttgtgcgggcctcagtggccagggagagggtgcgctcatgttgcctttctcgagaaatgaggtgagccgccgaaggggnaggagcaaaggagcaga

SEQ ID NO: 630123 - DNA, 167 bp, Homo sapiens
tgaagctcctgctccactttcaagcttgtccccctccagcgtcacctgggaggcgaatgtgccctgtggccagtccagatatccagctgtcatctgccctgtctggttacagtcatcatcgatgacctgtttgcgcagcagcaccaggtccaccttctccttctctg

SEQ ID NO: 630124 - DNA, 235 bp, Homo sapiens
tatacctcaaactcctgagtctgagcgatccttccacctcagcctcccgaagtcgctaggacgtacaggcgcatgtcaccacaccagctaattcctttatttttttttttggtgcaaaaaataggcccctctagttaccccagaagggttataatctattgggcccaatgtacggtccttccccctctggcttcctaaattgatgatcttcggggccaaagctaacctttgttgt

SEQ ID NO: 630125 - DNA, 436 bp, Homo sapiens
acctacttatgcattgcttttgtagactaatcccgctgcgtattagagcaaagctttacttagtgcatatggaccaagctgcttaataaggtgattatcgttctctaaaagagaatattgtacctaaaatataacctgtgtttatttgcccactcataatgttttgaactgatctcagattccaagatagatcatactgggacagactgtcaattcaccttccacatttaaatcttccaaaatgaatgaggcatccatagactaggatgtgttcggtttttttggtattgtttagttatgtttttcacttaaacctgagaggtttcatttaagtattctttccatttattcctgctactttgcagatgtttgtttttttaataacaatacagaaaaaggataaagtaccattgaactacaacccttataatacctg

SEQ ID NO: 630126 - DNA, 366 bp, Homo sapiens
ctcacattcccgaccaaagccagtcacatgccatcctcagctcaggaggttggaaggcattcccactatgtgtctggatccagcaactcagaaatatttggtgagtgcctctgtggctactggtagtttagttcttatgcctatgttccagttttgtcctctgaaaggccaaatctgaaattcaaaatcttacaaacaggtttatacttgaaaacgggtaaacattctcataacataaagcttaataatattcatgagcttatttttgcaaactctgcatcacaccgaaaagagaagttctctggcttcctcagctcaggggctgtctcattacttggtccctaagaccacagctggggactggtt

SEQ ID NO: 630127 - DNA, 224 bp, Homo sapiens
ccttcgtcccatcagcataaaaaacatgctcaaaatcattgttatcagagaaatgaaaattaaaactataatcagaggtcaaatacacacatattagattgttaaaataaagacgtgacaatatgcgtgtttcaaggatgtagagcaagattcccatcaggatcttggtggtagtagcaaatattcaaacaagaacttcgaaggctgatgggagaagactgcga

SEQ ID NO: 630128 - DNA, 100 bp, Homo sapiens
aattactctccgcgacagtgaaccataaccagtactaccaaatcaatactcatcattaataatcatatctggctatcctctctcatcaaatatactctcc

SEQ ID NO: 630129 - DNA, 407 bp, Homo sapiens
  misc_feature (379)..(379): n is a, c, g, or t
gctgtagctcaattccacataccatacggatcagtatgcgtgttacgggggatctttgctcactatcagctctgccctcgattaagtgggcgcaaatttggtagaaatgaccgagcttgagatttgaactcaggcaatctgactccagaatctacacttctaatctctatctaccccacctcaaggaacagaatatacaccatcttgttagcattatatcccaccccacttcctacaatcttgctgtcctaaagcacccgttacatggcaatgcttgagggctcagtcgtttacgaacactgctaggtcctctatcacttctttagaatggtggttctcaaactttgaagtgtatgggaattgcctgaggatctggctnacaagcagatcgattcacgaggtctgag

SEQ ID NO: 630130 - DNA, 604 bp, Homo sapiens
tttgattaaaaattaatataataaaaaaaaaaaaaaaaaaaaaaaaaaaaaaaaaaaaaaaaaaaaaaaaaaaaaaaaaaaaaaacaagaaaaaaaaaacaaaaaaaacaggggggggaattggggcctaatgggccaattggccctaagggggggcggtttaaaaacaaagggccggggttttaaaagggcgggacggggaaaacccggggggtccccaacttaaacgctttggaggcaacccccctttcgccaggtgggggaaaacgccaagggcccccaccggtcggccttcccaacagggggcgaaccctaatgggaaaggggaattcgcgggcggcaaatttgggtaaaaccccggcctctcgggcacaccgggcatcgtactccccaagggccccacgggcgtcccccttaccacccacccggactctccccgcggggtcggcggcgctccccactttcgacacccggcccctcttcccccctgccgccctcatcagccacggcgcgcatccccgctcccctgggtcccgccctcccgccctcccgcctacccgccctcctcctcggtctctcccccgtccccttctcccttcctccc

SEQ ID NO: 630131 - DNA, 919 bp, Homo sapiens
  misc_feature (3)..(3): n is a, c, g, or t
  misc_feature (94)..(94): n is a, c, g, or t
  misc_feature (303)..(303): n is a, c, g, or t
  misc_feature (311)..(311): n is a, c, g, or t
  misc_feature (315)..(315): n is a, c, g, or t
  misc_feature (371)..(371): n is a, c, g, or t
  misc_feature (383)..(383): n is a, c, g, or t
  misc_feature (389)..(389): n is a, c, g, or t
  misc_feature (397)..(397): n is a, c, g, or t
  misc_feature (399)..(399): n is a, c, g, or t
  misc_feature (403)..(403): n is a, c, g, or t
  misc_feature (413)..(413): n is a, c, g, or t
  misc_feature (415)..(415): n is a, c, g, or t
  misc_feature (431)..(431): n is a, c, g, or t
  misc_feature (465)..(465): n is a, c, g, or t
  misc_feature (476)..(476): n is a, c, g, or t
  misc_feature (483)..(483): n is a, c, g, or t
  misc_feature (504)..(504): n is a, c, g, or t
  misc_feature (517)..(518): n is a, c, g, or t
  misc_feature (534)..(534): n is a, c, g, or t
  misc_feature (618)..(618): n is a, c, g, or t
  misc_feature (620)..(620): n is a, c, g, or t
  misc_feature (655)..(655): n is a, c, g, or t
  misc_feature (686)..(688): n is a, c, g, or t
  misc_feature (691)..(691): n is a, c, g, or t
  misc_feature (755)..(755): n is a, c, g, or t
  misc_feature (782)..(788): n is a, c, g, or t
  misc_feature (800)..(800): n is a, c, g, or t
  misc_feature (821)..(821): n is a, c, g, or t
tgncccatctgcacagccagggcctggtgcaccttgatgtcaagcctgccaacatcttccttggggccccggggccgctgcaagctgggtgacntcggactgctggtggagctgggtacagcaggagctggtgaggtccaggagggagacccccgctacatggcccccgagctgctgcagggctcctatgggacagcagcggatgtgttcagtctgggcctcaccatcctggaagtggcatgcaacatggagctgccccacggtggggagggctggcagcagtgcgccagggctacctgcccnctgagttnactnccggtctgtcttccgagctgcgttctgtccttgtcatgatgctggagccagacccnaagctgcgggcnacggcngaggcccngntggnactgcctgtntngaggcagccgcgagcntggggtgtgctgtggtgcatggcagcggaggccntgagcggaggntgggccntgtggcaggccctgcttgccntgctctgctggtnntggcatgggctggctnaccctgccagctggctacagcccctgggcccgccagccaccccgcctggctcaccaccctgcagtttgctcctggacagcagcntntccagcaactgggatgacgacagcctagggccttnactctcccctgaggctgtcctggcccggaannnggngagcacctccaccccccggagcaggtgcacacccagggatgccctggacctaagtgacatcaantcagagcctcctcggggctccttcccnnnnnnngagcctcggaanctcctcagcctgtttgagganaccctagacccaacctgagccccagactctgcctctgcactttaaccttttatcctgtgtctctcccgtcgcccttgaaagctggggcccctcgggaa

SEQ ID NO: 630132 - DNA, 165 bp, Homo sapiens
ctttgtaacagccctttttacaggggatcagtggcagccacaggtttcttggtggtgggcctgggatttgagctgatgtgttcagacctgggcgggtgtcccagctttcagtttcagaaataagtaataattggctatggttgggggtaattgggtccatggttg

SEQ ID NO: 630133 - DNA, 411 bp, Homo sapiens
gcctgtgcctcacagcgagaccccatctcaaatataaatacctattattatttttgctagtctttcttctgtatagggccttccatactattacttgcctcctgtctcatctccctttatatcctttccttttcctaatttctgggagtattagagttgaccctccatcttgtaggagaaggtggtatgaaaaagaccacattcataaatcaatgtaaaccaatatagaacaggttcgaagtagaaataaaaagtacagagattgaatctttcataacaagagtgtatcagttgaattttcaatcttatacattcatctataaagaatacaggagtattaaccccttgaaataagacttcatttcgtagtcattaagcatatcttttaagcagtgttgttaacaatgcatg

SEQ ID NO: 630134 - DNA, 127 bp, Homo sapiens
tgtgtggtggaattccagctgtcatcgggtgctgagcttcgccacgtgctggccacgctgggtgagaggctgacagaagacgaagtggagaagttgatggctgggcaagaggactccaatggctgca

SEQ ID NO: 630135 - DNA, 257 bp, Homo sapiens
gggtcagtattcatctaggtcatctttctgggtcataacagtaatctctccaaagccagtgatggcactcagatatttgatctgaggattgagagattcaggcttttggtggaaaagccataccagagcttctgttccattatatggtgtcaaagtgaacgcgtttgcaaaaaagcgaagtagcaatattgccggcatcaacagcgtcgatacaagcggaggctgatttccatatgtctaattggtcaatgctgcta

SEQ ID NO: 630136 - DNA, 1382 bp, Homo sapiens
  misc_feature (1)..(1): n is a, c, g, or t
  misc_feature (628)..(628): n is a, c, g, or t
  misc_feature (630)..(630): n is a, c, g, or t
  misc_feature (892)..(892): n is a, c, g, or t
ntccccctttgtctgcctcggggggggtcttctctttgcttgggagggcttcgccgccccacgtgttttccggcgcatcctgtttttctcgtgagctctccgcacttgggcggccccacattggggtttttgacctcgccgtccgagaagatttttgtcattttctttttgggggggttatactccagccgcgccccccagcagtttttgtgtctaaacgaccgggcaccgggaattttgtgcctgtgagaattttgctgagcgagccgactggtttgtggttgtttttgagaacggccgactgtagaacttgtgttggaagcacttggggttgccccctctctcggaaaagtggaccaacggaaggggcgctgacaccaccccgctggtggcgcgcccgaagatggatgatggaccctatggagatgtttcctcctcacgggagttggccacaccgcccccccgctgcggtaatatataggtgtttctcgcctctttgtcccctcacagagagagagggaaaagaagaaacttctttttatgagaaaactcgcccacatttggagatgtctcttataagatgtggttgtaatttgtgggcgacacacacccccccatcggcgctctntnttacacgcgggtatagaaagaaatttgtcccccccagtatagggagaattgagattgttgtatacagagagaggagagagttgtcttttgggagaaacccacttgggggtttatacacacagcgagaaaaggggctataccttcataagctctgcacacacatattttcttgggcaacacaccccacagagtgccacagcccaccctcacagccacttttaacttttaaccacactcacgcgagaatattgtgagtgttgtngaaattgtgagagtgttccctctgtggtgtgtgtgtcgcacacaatacttctgagagcgacacaccactactgtgtttctcttttgatgaaaacacactactggccacacctctcacaaggtctctggagggccgcgttggcgtccacacaccctcgtgtatttccccgccacctctttgggagggcccgagaggcgcggcgcgagttctcccgcgaggtgttcgcggaggtttttgagagagaccacgccctcgagacccacaccactcggagaggataccccctactctctttatctataaaaataccacaattatgccgcggcgctggtggcacatgcggcctaatatattctcacgctaacttgggagggctgaggccacggagaaattgcttgaaaccccggagaggcgcgagaggtttcggtgaagttgaagattgtgcccttgcactccggcctgggccaccaccagccaaactccgtttcca

SEQ ID NO: 630137 - DNA, 124 bp, Homo sapiens
ggagcaggtggaagagtatggtggatgcgcgagctcggccgccggctcggtgcgcgtccgggttgccgggacggcggtgctgggcgtaggaccggcctggtcccccgccgttaagtatccccag

SEQ ID NO: 630138 - DNA, 265 bp, Homo sapiens
ccactcaagccccttccttggagctgccggacccagcatatccagtacgtgctaataagggagaatccagaggctttgcagcagagttccagggatccccctggcgtgaccaggcctccgttggctcctctccggactgctccagctgctgacactggacacctttgagcacagcgaccaggagaagccagcgcagcccagtctccatggtgagcgtctgtgttgagtgcgatcactgagtggacacctgggagtgctggggctg

SEQ ID NO: 630139 - DNA, 310 bp, Homo sapiens
tttttttttgagatggaggtcgctctgttgccctggctggagtgcagtggtgcgatctcagctcactgcaagctccgcctcctgggttcacaccattctcccgcctcagcctcctgagcagctgggattacaggcacctgccaccacgcccagctaattttttgtatttctttttagtagcgacggggtttcaccacgttagccaggattgtctcgatctcctgacctcatgatccgcccacctctgcctcccaaagtacaggcgttacagccgcgcccagccaaaaaacattcttaggatgatttttct

SEQ ID NO: 630140 - DNA, 972 bp, Homo sapiens
aaaaaagaaatgatgcccagcagcgtgaatataaaaaaaaaaaaaaaaaaaaaaaaaaaaaatttgggcggccgccctctcgccccgatcgagaaaagcattttcatagaaacacattcgccgttgggggcgcgcgcgggggccccagtgagggatagaggtgcaacacgggcgccccaatagcggtgttccctgaagagagagaacacggggcccaaggaacatcaggggggtgggcgtatttcctcaatcctaatataaaacagcgggacggccggcggggacaacaacgcaggcaggcgcggtttgcgtgaaacacacaactccaccaagaatgtgaagtctagcagggagcagctccaaatagacggggcgatctcctacatataaaacaggaggggggagttctccaacgagcgcgagaagcgccgcgcgaatataatatcaaaacatttaataggcgcccccccgccgcgtgtggcgtgcactaagcaagcaaccaacaattaagacgagatgcaaactacacaacgaacaagacaacgaacaagaaaaatcaagcgaatgaacaagcaaatgcaaggacagaacaacgaagcaacacagagataagagaactacaagtaaaaaaacaagaacaagaaaacaattatcaaataaaaaggagaacagacaacagcaccacacacgcagacaagaaagaaacagagagcagagcacgaaaggaacacgaacagaacgaaacagacgacagagaaggagagaaacacaagaaagtacagcgcgagaaaagaacaaacaaaaaagacaaagaagacaatgacactaagcagacagcgacaacgacaaaacaagcaagcaagagaagaaatgccgcgacacacagaggaagacggaaggaaacaaaaacacagaaacagaacacaaagaaaagtacacaacgaacaagaaaacagaccaacaaacaagaaa

SEQ ID NO: 630141 - DNA, 144 bp, Homo sapiens
  misc_feature (19)..(19): n is a, c, g, or t
gctttcaattaccctggcntccagaaattgtgtattcagggggcgacgatggccttctgaggggctgggacacagggtaccggcacatttctcttcaccagcaaagacacaccatgggtgttgcagcatcagagcagccctcat

SEQ ID NO: 630142 - DNA, 671 bp, Homo sapiens
  misc_feature (614)..(614): n is a, c, g, or t
gcaaaacaccaacatggcgagatgacgccgagtgcagcgggggggcccgggggccctggtggccctgggatggggaaccgcgggtggcttccgtggaggtttcggcagtggcatccggggccggggtcgcgggcgtggacggagccggggccgaggccgagtgagactcgcggtaggcgaggtgcgagtgataaggagtggatgcccgatcaccaagattcgggccgcttggttcaacggacagtgtaagatcacagtccctggaggagatctatcgtcttctccactgccctagttatggaatcagagatcattgattgtcttcctggcgggcgcatcatctcagaggatagacgggtttttgacaggagttagtgccaagtgtcatgacagcgaaggacaccgtggccggtccagacgctaccagtgtttctaagggcatatgtggtgtgcgtagtcgcgggagcttactacactgtgcacagccgtgcgcgttcgtggtgtggttagaagttgcatccaaatggaatgtgttggtctacctgcacagtctcgttgcgaggctcatgcaatctctagtagcctaaagcttccttcctatcggtccgcccggntgtctgcagaaggcgtagcttgggggcgaatacaagaatccgagcagaggcccccac

SEQ ID NO: 630143 - DNA, 349 bp, Homo sapiens
tccacggttggctactagtccacgtgttggtatagtccacgggtggctactagtccactcgcagtcgtacaaggaggcttctctgtgctggtgagaattacccaggcaaccgtgtcgacttagccaatgtccaagaactggtttcctgggtgtgccactgtgatgacgacatggttcagagactagagagagacttcaagatgagtcttcagctgaagagcagcctggagcagctgggttgcgtgagttgataatgtgatgattgaaggacttgaaagcttatggaatggaagagccagttaacctaaagcagtgaggcaggttctggtacaatggtctttctacaggc

SEQ ID NO: 630144 - DNA, 713 bp, Homo sapiens
  misc_feature (13)..(13): n is a, c, g, or t
  misc_feature (70)..(70): n is a, c, g, or t
  misc_feature (82)..(82): n is a, c, g, or t
  misc_feature (85)..(85): n is a, c, g, or t
  misc_feature (92)..(92): n is a, c, g, or t
  misc_feature (108)..(108): n is a, c, g, or t
  misc_feature (204)..(204): n is a, c, g, or t
  misc_feature (212)..(212): n is a, c, g, or t
  misc_feature (219)..(219): n is a, c, g, or t
  misc_feature (264)..(265): n is a, c, g, or t
  misc_feature (275)..(275): n is a, c, g, or t
  misc_feature (281)..(281): n is a, c, g, or t
  misc_feature (369)..(369): n is a, c, g, or t
  misc_feature (372)..(372): n is a, c, g, or t
  misc_feature (380)..(380): n is a, c, g, or t
  misc_feature (408)..(408): n is a, c, g, or t
  misc_feature (520)..(520): n is a, c, g, or t
  misc_feature (534)..(534): n is a, c, g, or t
  misc_feature (570)..(570): n is a, c, g, or t
  misc_feature (591)..(591): n is a, c, g, or t
  misc_feature (626)..(626): n is a, c, g, or t
  misc_feature (636)..(636): n is a, c, g, or t
  misc_feature (652)..(652): n is a, c, g, or t
  misc_feature (687)..(687): n is a, c, g, or t
ttgatgtttatanattatattaaatacagtgagaaggggagtggggggaagagtcagagaggaacttatncccacactttanaanatcatanatcaagaaatcagagnaaagacaaagacttagggagaggagaaagacattctctcaatccatcctccttccccagggcagaaaattaaacaacgttactgagtaagcctctnagcagaangctctcncatctatgcacagacttcactcctcctccccaggccttcctggannatgtccaggnctggcnttagccaacagaaatagaggggtcaagggggtccaggagtacggaagggtcagcagggaccctcaatactgattcttctctggctggnggngggcaggnagcagagatagctcaaatactgagcagncaaaaaaagaagaagatggcgagaaacaggaagagggaatgctgccagctggaggcatgggtgaccctgtaccagatccacaccatgataaccccggcggaaaggctcatgnggcattagaagacnggtgtgtgaaaaaagccaaaggggaaaacgcaccanacaccaaaatgagaatgtggnaagcccccggttatcaccaaaatgcgctgggaatnccccctctgnctctccgagagctggntctctggtccctggggggcgggggtgggagtcttntaatctggggatcctgggggctttct

SEQ ID NO: 630145 - DNA, 198 bp, Homo sapiens
taatgaaatataatctatagctttgttataaattgtagcaaagccacccccttatcacagaattcacacatttataaaaatgcttacaaaattctatttgctacattttaacctgctttactgtattcttcaaatatttttactagactctgattttcctttggtaaatactaaacaattgatttttcactttcacac

SEQ ID NO: 630146 - DNA, 989 bp, Homo sapiens
gggttcctgcttcaacagtgcttggacggaacccggcgcctcgttccccaccccggccggcgccatagccagcctccgtcacctcttcaccgcaccctcggaactgcccaaggcccccgccgcgctccagcgccggcagccaccgcgcgcgcggctctccttagtcgccgcatgagaccggtcacctcgaggtgcgccagaatacaccaggactcagaggccgccatctaaccgccagatcaaccttggtagcactacgcctcctacgtttacctgtccatgtcttactactttgaccgcgatgaatgtggttttgaagaacttgccaaatactttcttcagcaaactcatgaggagagggaacatgctgaagaaactgatgaaggctgcagaacaaggaggtggccgaatcctacctacagggatatcaaagaaaacgcagaactgttgactgactggcaaagagcgggcctgaacaagcaatggagtcgtccgcattaccacttgtggacaaaacaaaatgttgaatcaggtcactacttggaactggcacaaaaaagggcactggacaaaaatgaccccaatagtgtgaacttcactggagacaacaatcaactggacatgaacacggtgaaagccaataaacgcaattggggtgacacaagtgaacaattggcccacaacaatgggagcgccccgaaatctggctaggcgaggactatctccaagaaaaaagaaacacccggagcaaacgaaataaagccaaacccgagccaaatgccccaaaccagcgagagacacacgagcaccacagcaaggcagcatgggaggacccaacagcaatagggacccacaaaacccctaacgacaatgaaccaacacaaacaaacgcacccacaaaaacgggcgacaacacacaacaaaaacacccaaaacaccaaggcaaaccagaacaaccgaacaacaaaaaacgcaaacacaacaacaag

SEQ ID NO: 630147 - DNA, 527 bp, Homo sapiens
  misc_feature (2)..(2): n is a, c, g, or t
  misc_feature (83)..(83): n is a, c, g, or t
  misc_feature (86)..(86): n is a, c, g, or t
  misc_feature (108)..(108): n is a, c, g, or t
  misc_feature (112)..(112): n is a, c, g, or t
  misc_feature (114)..(114): n is a, c, g, or t
  misc_feature (139)..(139): n is a, c, g, or t
  misc_feature (148)..(149): n is a, c, g, or t
  misc_feature (151)..(152): n is a, c, g, or t
  misc_feature (160)..(160): n is a, c, g, or t
  misc_feature (163)..(164): n is a, c, g, or t
  misc_feature (166)..(167): n is a, c, g, or t
  misc_feature (171)..(172): n is a, c, g, or t
  misc_feature (179)..(179): n is a, c, g, or t
  misc_feature (182)..(182): n is a, c, g, or t
  misc_feature (184)..(184): n is a, c, g, or t
  misc_feature (204)..(204): n is a, c, g, or t
  misc_feature (209)..(209): n is a, c, g, or t
  misc_feature (218)..(218): n is a, c, g, or t
  misc_feature (220)..(221): n is a, c, g, or t
  misc_feature (225)..(225): n is a, c, g, or t
  misc_feature (233)..(233): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (244)..(244): n is a, c, g, or t
  misc_feature (249)..(249): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (278)..(278): n is a, c, g, or t
  misc_feature (286)..(287): n is a, c, g, or t
  misc_feature (289)..(291): n is a, c, g, or t
  misc_feature (296)..(298): n is a, c, g, or t
  misc_feature (300)..(301): n is a, c, g, or t
  misc_feature (305)..(306): n is a, c, g, or t
  misc_feature (308)..(309): n is a, c, g, or t
  misc_feature (338)..(338): n is a, c, g, or t
  misc_feature (359)..(359): n is a, c, g, or t
  misc_feature (362)..(362): n is a, c, g, or t
  misc_feature (376)..(376): n is a, c, g, or t
  misc_feature (400)..(400): n is a, c, g, or t
  misc_feature (426)..(426): n is a, c, g, or t
  misc_feature (444)..(444): n is a, c, g, or t
  misc_feature (488)..(488): n is a, c, g, or t
ancctgaaggagcagcagacttaccgttaccacggacacagtatgagtgaccctggagtcagttaccgtacacgagaagaaantcnggaaggaagataggaagatggnaccntnttatgcttctcaaggacaggagggngaacagcanncnngccagtgnggnngnnctannggaaatngangnggaagggaggaaggagattnaggangcggcccantnngccncggccgtnccngngccncntttgnaagagctgggctaccanatcnantccacncaccctcnntnnnaagtnnngnngtgnnanncagtggatcaagtttaagtcagtcagttnaggggaggagaaggagaggtnagncttcaggggctacngacagtgttctcaacttggttaangaggaagaaaacccagtcaatgaaantcaatgaaattcttgganacttccattaagtgtgtagattgagcaggtagtaattgcatgcngtttgtacattagtgcattaaaagatgaattattgagtg

SEQ ID NO: 630148 - DNA, 153 bp, Homo sapiens
gagctatgagccatgcattcattgatgctctggaggtcgacgttgtttcacctagcgtgcgtgtgctagtgcctctcgctgtacaagttccgtcgacacgtgagcacctgtgctgacctccaaatatctgttaagcgtggagccgtggtcgac

SEQ ID NO: 630149 - DNA, 231 bp, Homo sapiens
tgattctagacgatcccctcataatgtgtgcgcagactcagaagtttaactgggttatttgactctagatgaaaagtatgattgcatacgcgtttgcttaacaacaatgcttgtatctattttttaaacagttaggtcctgtcatggctggctcacactctgcgatccgcagcactttggtaggccgaggactaggctgatcacccgaggtcaggcagtttctgagaccag

SEQ ID NO: 630150 - DNA, 288 bp, Homo sapiens
  misc_feature (46)..(46): n is a, c, g, or t
  misc_feature (49)..(49): n is a, c, g, or t
  misc_feature (104)..(104): n is a, c, g, or t
  misc_feature (159)..(159): n is a, c, g, or t
  misc_feature (194)..(194): n is a, c, g, or t
  misc_feature (218)..(218): n is a, c, g, or t
agatgggggagtcgtcgggcgccgggccgggacatggagctgtggncgngtctggccgcggtgttgctgtagctgatgttgttggtgcagctgagccgcgcggncgagttactacgtcaaggtcgtcctgtactgtgcgctgtgcttcatggtgtccgnacgtggcctcgctcgtctgtctgttgcgccacggnggccgagacggtggagaacatgantatcatcggttggtgtcgagcgatggttcaagtacttcttacgggctccgctttcgaagtgcggcaaccc

SEQ ID NO: 630151 - DNA, 323 bp, Homo sapiens
  misc_feature (71)..(71): n is a, c, g, or t
aaaaaaaaaaggggcccccgtttttaacccaaagggggccctttgggggcccctgtgggtttaaaactaanctggggaagcataaaacccccaaaaaagggccggaatttttcttttttttttggggtacatttaaaatacaaccccttattgcccgggggggccctaatactttcccggaggttttttttctttcccggatggcccggctttttaacttttcccggcccaaggttgctttttccccttttttaaaaagggggagttaaccgggattttttttctgaaagaaattaaaagccgaaatccccgttttttgaata

SEQ ID NO: 630152 - DNA, 944 bp, Homo sapiens
  misc_feature (149)..(149): n is a, c, g, or t
  misc_feature (363)..(364): n is a, c, g, or t
  misc_feature (400)..(400): n is a, c, g, or t
  misc_feature (478)..(478): n is a, c, g, or t
  misc_feature (510)..(510): n is a, c, g, or t
  misc_feature (559)..(559): n is a, c, g, or t
  misc_feature (561)..(561): n is a, c, g, or t
  misc_feature (607)..(607): n is a, c, g, or t
  misc_feature (684)..(684): n is a, c, g, or t
  misc_feature (702)..(702): n is a, c, g, or t
  misc_feature (770)..(770): n is a, c, g, or t
  misc_feature (846)..(846): n is a, c, g, or t
  misc_feature (902)..(902): n is a, c, g, or t
gccactccaccttactaccagacaacctgagccaaaccgattagccaaatagagtataggcgatagaaatggaaacctggcgcaatagatatagtacgcgcgagggaaagatgaagaattatagctcaaagcatagatatcagcaaggnactgaaccgcctcatacctgtgctgtcataaggacattcaacatagaacataatcttgtgactagggaggagcgcagagagctgaaggacccgccggagagaccgaaacgcaggcttacctgagatgaaccagcgtaagcacagagcggacaccacggtcgtatggtcagcgaagaatgcagctggggcaaggcattctatcacggtcacgagnngcagacttacaacactaatcgcagatgcccttggtngcataaggctcgagttacgtcgcgcaagcaatcacggacatgccttgaggttcgagacgtatcttaagatgtctggcncgcagacgagataggaccactcccgtaacatntcaccacgtgtggtgaagagtgtgtacagcgtgctcctaggatacgcananacgcgaggcaatgcaaggtgtccctattggggagcagacctagggnaaacgaacgactcgcgtttgggtatgacgaaggaaggctacaacacgacattatgtaaatgcaggttccccagatangtataagggcgccttaanataggcacagcgcacagacctagatgttcaacgtaagatggcggtatccaaggacgtcaatagctagncgcgccatcgtaacacgttagagaatagagtcgccaagaatcactgattaaggctggacatcgtcgcgtcgagcancgcccacatgttggggagcccaagatcgtaatacacgcgcattattaggacagganagctagatatgatgtaggtcatcacagatacagcaatgcacg

SEQ ID NO: 630153 - DNA, 384 bp, Homo sapiens
tagtgtgatctctgaaagagtagtgtcaatataccattaccacgtcatagtgcgcacattgtaaaaataagcggccaaaaagacattatagcggatactggcataatcagaacataaaccgcggattaactaatagcataatgtccatgtgcaatttactgtaatgtgataactatactcacagtattcttaagagaacacgtctcaatacttgggaaatgcacactgaattattaatgaatcaagatgcatgatttcctgctactttcacctggttacaaaaacaattatatcgaaagaggctgataacatcgactaggccacatgttacactgggtgaatctgagtaaagggtatataggagttccttgcactattatgctt

SEQ ID NO: 630154 - DNA, 1079 bp, Homo sapiens
ggtctcgtgtggttcgtcgctacttccgccggtggggggctcgttgtgtccgcgcctcttcctacagggtactctctttgccaccggggtcctcttctcctgccgtgtctattcctccccgtgttctgatgtgagggtccacgtggtgcttttgggcgtggcccgccgcggaaatgtgcctccgcagggggggttccccctcgggtgatggggtgtaccgggcccaaggttctcgtgtgtgtacagaagggcgttagcagttgcgtcacttgcctttcttcgctcccggtctgttggggccgccttgtccgcgctgtctggtggggagatttcgctgtctacggaagatgggcggcgctgggtgtatggggcggcgcctcgttttatttcttgtgcccgtgctcttcacgttctcgtagggactttcgggcccgtgccccctgcgactcagcccgtggagctcacacgggggggcactcgcggtgcgggggctcccgcgctggggtgagaacctcgtttcctcaccaggggtgtctatccgctctgcccaggcttttccgctcacaggctcttttctgtctctgcgagtgcttcgtggcggtgcccttcagttctcacgccactcactatggcgctcacgctaagcgttcgttcaaagatatgttggtctcgtgggctactgactggctgaggcgcacctgtgccggtcgccacggctattctctgtggatgggccaatgccctcaggttgcaaaggccgtgccatgcgtgtaaactaatgagtggggccaccgtgcagttccatgcctgggtgacagaagtgaaatgcctgggcacagaaaacaaaaataagaagtatgccaggcactggtggcgggagcctgttgtcccagctgttcacgtaggactgaggcacgagattcacttgaacctgggaggtggaggttgctgtgagcagacaccacgccactgcactccagcctgggtgacagtgagactctgtctcaataaatataacagtccataaatactgtaacgtttctcccgcgggggagggtgggggggggggggggggggag

SEQ ID NO: 630155 - DNA, 197 bp, Homo sapiens
aggtgtggtggcgtgtgctgtagtcccagctactagggaggctgaggcaggagaattgcttgaacctgggaggcggaggttgcagtgagccgagattgtgccactgcactccagcctaggtaacagagcaggactccatctcagtcaatcaatcaatcaatctcagcggttgaactacccttgacatggttcagctc

SEQ ID NO: 630156 - DNA, 219 bp, Homo sapiens
cagctcggtccctcacaagagcctgtaatgctatgcctcaatttcaaaatacacttgcagccaggcatggtggctcatgcctgtaatcccaggactttgagaagctaaggtgtaagaattgcttgaggccaggaattcaaggctggcctgggcaacatagctagacgccatctaccaaacaaacaaattcccctcccaaatcccggcagaagcaggaag

SEQ ID NO: 630157 - DNA, 652 bp, Homo sapiens
tcaccccaaaaaattaaaacaaaaatgaaattaactcagaaccacacaactatgtggaaattgaataacctgcttgtgaatgactcctgggtaaatacctgaaattaacggcactacgactcacagacacattactttgacacactacactaacgacctaaacgaccacacactgtacccagaactctctgggatgcagctaacagaagtgttagagaccacgaacaattaatacgcactaaatgcccaattcaaaaagctagaaaagatctcaagttaacaacactcacaactaaaatagagaaccaaaaacaaaccccaaagctagcagaatacaagaaataaggatcagagcagaactcaaggatgacagagacacaaaaaatctttcaaaaattaacaaatccaggagctgggttttttggaaaaaaattaatagactggctaactagactattaaagcacgaaacgagagaagaatccaacacaatcagaaatgatacaaggggatatcaccaatgaccccacagaaatacaagcaaccatcagagaatattataaacacctctctgcacataaactagaaaatctagaacacgagaatcacatttctggaaaacataaaccctcataaggttgaacctggaagcaa

SEQ ID NO: 630158 - DNA, 838 bp, Homo sapiens
cactccaccttagtagcaggagcgagaccttagccaatagcattatacccgaaataataagtataggcgacagaaatagaataccatggtcgacaatagatatagttaccgcaatagggacagatggtaaattaataataccaaggctataatgatagacgaatggtacataagtccctataccttctgcataatgaattgaactagataatgaactatgcaaggaaagcccatgctgagagccccgataccagatgagtctacctatgaacggctaagagagcacacccgtctatgtagcaaaatacgggggaaacgacttgaatacggtaggaaggcgagagaactctaagccgacgcccgaggtgataaggcccgagtagataccagaggaatagacatcttaagttcaactgataagagtgagtccaacaggactcactcgtaaaatgcccctgatgaagttttagccgggttaagtccaaatgaggaggcgactctttgggacacgaggttaaaaccgcctggtgaggagagtgaccatagttatatccaccgcatgagtgaggcgcatatagaggtaggctcatacaaagtctagaaagccgttctatgcttaacagccaataactatggaatgcacaaatatggtaagtgggaagtcctgcacacccattgtggaccattctatgcacccctagtaggaagaactgatgtacgtataagtggggaatggcgaaatatctccttcgggttagcctggcgtccggattaaacatgaatttgggtattacggccaatttctcaattaaccaccagttttttacctcctgtacca

SEQ ID NO: 630159 - DNA, 239 bp, Homo sapiens
agcccactcaaacaacatttcactgcacccatgtcctcagtgcccgctctcagttttccagcctatgggcaggttttcattctgcacgttccatcgtgcattttgtgccatgtggcagcacactccctcatccaggcagcagttcacagccatggtgggcagtcagcaaccaatctccattccccagcagtccagcaggcagcaagcagcaccatgtcaccattgcacccatcggtccg

SEQ ID NO: 630160 - DNA, 959 bp, Homo sapiens
gggttgggaggggtggacagcagtctgctggatctaacgaggaaaaagaggtagggttgggaggagaaagacaatcagggtggcaagaatggaggagaaggatttgaacaggtgagcaagaattgcagaggtcgggttgtgatctgagtgcaaaaaggcctggacataaggaatttctccccatttctctagtcgttgtcaataattgcttaactcagttaaaactgtaaagtcgaatgttccatttgcgggccatttggacccattatccaattcgtatgtggccagactgaattgcaaaaaaagacaaggcgcttagggtggatattttgcctgaggcctaaggtttgcaggttttttatggggcagcctagagggctgtgttttggaagggaggaccgggagtttcccataacagagggtaggctcaggagaacagggaaacaaggagaccgtcctggacggccagagggagacaaaaggagcaatcatcatcaccgctgcctttttcattcctggaacgggatcaaaatggattagaggcgtctccctaagaccaggtgatgggatgatcagcgagtacctggcacacgccggagccttgctgaaccgacattggattcttggaccgtagacaccaagagaggcatgtggctttcccttgttgactgggctcctaggaaacttaccaaataggaaggccagtgacccaatgtgcatgcaacagagatgcaactgagctgaggagcttcctttgtcctgctgctgtgggctgttactcaagtgaaggggtagtcaaggggattggacaaagcctcccggacagagatgagatcggatcggggtggtcaacctgaaaccgcaagaaaaggatgtggcgaaaaatctgcaacgactcacgaggatagccaaagaacacaagaaggaggaaacgaaagaggcaaaaaaaaagagacaaa

SEQ ID NO: 630161 - DNA, 269 bp, Homo sapiens
gtcgacgaaaaagagtaaagtaaggctgaatagagatcttattctatggcagaggcttagaggctaaagaaaatggaagcaaggtcttacaagtctgatctacaagtgaatgtgtattgagagtccactaagacttttaaggagtaagaatttataatggttcagatcagttgtgtgcttttcctgtagcagatctcagctttaaaatagagaagataggctgggtgtggtggtacacgcccgtaatcccagctactcgggaagctgag

SEQ ID NO: 630162 - DNA, 300 bp, Homo sapiens
gacaaatgtggtatatataccccgtagaatactatttggccattaaaaaaactaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattaaaaaaaaaagtcgacg

SEQ ID NO: 630163 - DNA, 104 bp, Homo sapiens
tgatgttatcccaacacgaaccaaagctgctctctgtcacccctgcagagctacttatactgcaggttttgcccaataatacaaacaatagagcagataccggc

SEQ ID NO: 630164 - DNA, 325 bp, Homo sapiens
  misc_feature (156)..(156): n is a, c, g, or t
tgttctctgctcccctcctgggtgcccagtgcccactgcctgatgccccagctgctctccagctaccctgagtcccccacgacagcacccttcccagggtgccctaacaggttctgtaatgcagaattcccagaccctccttcaatcccagcccanattcccaacccttcccttaagcactcaacccaagcaacaacttaggaaaataaatctgactcggccgggcgcagtggctcacgcctgtaatcccagcaccttggaaggccgaggcgggcggatcacgaggtcaggagatcgagaccatcctggccaacacggtgtcgac

SEQ ID NO: 630165 - DNA, 204 bp, Homo sapiens
gtgatcatgcctggaatcgcagagcacttctgagaggctgcgtgcggacgacatttgagggcagtgcgttggcgaccagccatggccgagatggtgaaaacctgtgtcgtactaaaaatacaaaaattagccgtgcatggtgacgtacacctgtaatcccagctactcgggaggctgaggcaagagaatggcttgaacctggga

SEQ ID NO: 630166 - DNA, 459 bp, Homo sapiens
  misc_feature (98)..(98): n is a, c, g, or t
  misc_feature (108)..(108): n is a, c, g, or t
  misc_feature (286)..(286): n is a, c, g, or t
  misc_feature (292)..(292): n is a, c, g, or t
  misc_feature (358)..(358): n is a, c, g, or t
ccagcacagcgcacgccagccagcccggcagggccgcagcatcccaggccggggatcgccaggctcctttttcaagtgcatttctgagatacaacagncaatttcccnaactgcgcaagtgaaaacaatgtttggctaaggaggctggtgaggggctgacagtcttaattctaagggacgtctccagcggtgacacggggctccgtccccaagcagaccccctgctgggatcagtggaacccgacccagtgaccttctgcctggctgaagaaagccctatgggtgnattaancaagcgctgcgtgcctgcaagatctgactgtaaagctgttcccatgagcagcctctgagagccttngtggcccccaagcaggccagggcaggcccagactgaggggtgaggggaaggcctccctgcacttggtggagaagttagaaccagacgagaggaaccctcgg

SEQ ID NO: 630167 - DNA, 453 bp, Homo sapiens
atcctctgggcggcccttatggatggggtattgcaatagttcccatttggccgatgagggacctccccctttaggggaggatgccgtactcaaggtcacccaactgggggggggcaagctttttgtttaacccaaggaatctcgggggggggccaggactctcacccttcagtgggggccgcctttttttggcacacattcaggcggggataggcaggtttccggtccccggtctcggctggggccggtcaggctccccccgggaaaatggaggcctggcaatttttttgtggtgctgttagttcccctttaggaagtgaggctttttgggctctcgtagttaaaggtgtgttcgcctggcaaaaaaaaggaaccaaaaaagggagatttgcatcacaatgaaccttcaattcaacccaaataaaaccaccttttaaaccatgagagacagct

SEQ ID NO: 630168 - DNA, 390 bp, Homo sapiens
  misc_feature (5)..(5): n is a, c, g, or t
  misc_feature (14)..(14): n is a, c, g, or t
  misc_feature (51)..(51): n is a, c, g, or t
  misc_feature (116)..(116): n is a, c, g, or t
  misc_feature (196)..(196): n is a, c, g, or t
  misc_feature (316)..(316): n is a, c, g, or t
  misc_feature (343)..(343): n is a, c, g, or t
  misc_feature (361)..(361): n is a, c, g, or t
tagcnctttagagnccctaggaggatcatttgaggccccaggagtttgagncccacccctgggcaaacatagcgaaactctgtctctataaaaaaatgaaaaaattaccccaggcnatgggctgtgcacctgtaatccccagcactttggaaggccgaggcaggaagattgcttgagcctaggaatttgagatcancctgggcaatatgatgagaccctttctctacaaaaactagaaaaaattaactggcgtgttggtgcacgcctgtagtcccggacactcaggaggctgagatgggaggattgcttaagcccnggaagacaagcttgcagtaagctgtgnacggccactgcactccancctgggtgacagagccagaccttgtctca

SEQ ID NO: 630169 - DNA, 167 bp, Homo sapiens
gaggatccttcgagccgttcattacatccgttactgtttcccatattggccaggctggttctgaacttctgacctcaggtgatccgcctgcctcagcttcccaaagtattgggattacaggtgtgagccactctgtacctgaccagataatctttaaaaatctcctc

SEQ ID NO: 630170 - DNA, 347 bp, Homo sapiens
  misc_feature (49)..(49): n is a, c, g, or t
  misc_feature (145)..(145): n is a, c, g, or t
  misc_feature (227)..(228): n is a, c, g, or t
  misc_feature (243)..(243): n is a, c, g, or t
  misc_feature (245)..(246): n is a, c, g, or t
ctgacgtcgaggtgtggaaatcagaagtctgtgagagcgcgggactgtnggcagctctgggtcccaactggcccgaccgctctgcttcacctccagctctgtctcctctactcttgggtcgagatccctttggagccacaacggngaaccctgtggtcctcaggcaggtgtaccttgagtcagccaggagccctcttttcctgtgtcaaagcctgccctcgctcgtnngctcacctctggtcncnnctccaagactgcccctgctcctgcagtttcccctcatgactctaggcctctgcccccttgctctaagccacagccttctagctacacttttagcaattacc

SEQ ID NO: 630171 - DNA, 414 bp, Homo sapiens
  misc_feature (214)..(214): n is a, c, g, or t
  misc_feature (259)..(259): n is a, c, g, or t
  misc_feature (281)..(281): n is a, c, g, or t
  misc_feature (318)..(318): n is a, c, g, or t
  misc_feature (324)..(324): n is a, c, g, or t
  misc_feature (347)..(347): n is a, c, g, or t
  misc_feature (355)..(355): n is a, c, g, or t
gcgtttgtccagtattattcaaatgaccggacataatgaaggatggcgacaggacgaaggcttctgccctaagatttctctcatctcgtttttaccatcttgtcttcgtggccctcacttgtggttgtgtctgctgtggtgttatggacactgctagtgttaatacagcacaataagaaagtgtgaaaggggccgggaaaggtggcgggacggnggcggcacgtggggttcccctcacagcactgtgcacggtgcctgnttggggttcctccatgttggancagcaacgttgagcggcccaattttgcggcagggaantttcantgggtgatcaagggcaagccccnttatttancaagacaaagcaaatttggggtttaagccagttcaaggaggtttgcaggtaggttgggg

SEQ ID NO: 630172 - DNA, 268 bp, Homo sapiens
tcgctcccggctccgctctctgcgctcccgctcaaggtcccggtccaggtccctgtgcggacacggggaggggccggacctctcatcgtaccgggaggtgtcgtcgcgggctgaatgccggatgttcacatcagaccctcctcttctggtaccaacgaggcctcctcctaaccgctggggcctccaacccttcacggttcggccactccccacgtccacaaggaacatcctgccatcaataatcttgccatctgcgtgtttgtaagcg

SEQ ID NO: 630173 - DNA, 183 bp, Homo sapiens
gaggatccccgcgctttcgcccatgtttcccacccatgggctccctgagaagaagatgggcatcatggcttcagatacagcagaaagtgttactttgacgcgagttcggagtagcctaatcgcgagacacgttgcgtggcgtgatggttaggggagatggactttcaatgggttgtccagtgc

SEQ ID NO: 630174 - DNA, 165 bp, Homo sapiens
tttcaattggcagtgagccatctgctttaaccccttcccttgttgtgctcagttatggaaatgccaaagtccttaacattcagttccataaactttacctcaccttctttatcccccttattaaattgttggctttggggtcaaaagcgatggttcaccgcaatg

SEQ ID NO: 630175 - DNA, 231 bp, Homo sapiens
acatgtacaataagaacttcaataattgtatatacgcctttgctgtattttcccctcaagattatcacctgtgtgttcgacagtcaatattccatctggtaccagttcacatccttgcttatccatgtaacacgcattgtttcacaaacagaaaacatgtaaagcagtattaaaatttggccaaacaagtgttctgtatctactttaataaatggttattctttaaaaaaa

SEQ ID NO: 630176 - DNA, 450 bp, Homo sapiens
  misc_feature (22)..(22): n is a, c, g, or t
  misc_feature (29)..(29): n is a, c, g, or t
  misc_feature (56)..(56): n is a, c, g, or t
  misc_feature (277)..(277): n is a, c, g, or t
  misc_feature (407)..(407): n is a, c, g, or t
  misc_feature (417)..(417): n is a, c, g, or t
  misc_feature (442)..(442): n is a, c, g, or t
cccgtgggccctaccttacagntttaaanatgaaaagcagtattatgccctaaacncccctacagtgccaaatattttccacaatgatttccccctaaagataacctaagcaaaaagtaagaattggtggggaccaaagaggaagtggaaattgttggaaaggtggcccgggccgccaggttgtcacgccctgtaatccccagtgctttgggaggcccaaggtgagtggatcaccctgaggtcaggagttcaatacccagcctggcccaacatggtnaaaccccatctctactaaaagtacaaaaaattagctgggcatggtggcaggcgcctgtaattcccaggtactcaggagggtgaggcaggagaatcgcttgaacccgggaggtagaggttgcagtgagccnagattgcatnccagcctgggggacaagagaaaaantccttctc

SEQ ID NO: 630177 - DNA, 254 bp, Homo sapiens
gtgcataaagtcctttctaaccatttctggtttagaaaacattcagccatcctagaaactagcatatttatttttgcctctttcgttttaccttcctttttagggtgggggaaattggtttttgtcttttacttacagggtactaatgcaaaggtcccactctaggtggtagctgaaggcgaattggctatttggggctaccactaatttctggtttacctggtattttggcttccctaacttttatggtctaa

SEQ ID NO: 630178 - DNA, 436 bp, Homo sapiens
  misc_feature (379)..(379): n is a, c, g, or t
  misc_feature (388)..(388): n is a, c, g, or t
  misc_feature (412)..(412): n is a, c, g, or t
  misc_feature (424)..(424): n is a, c, g, or t
tctgtctataaaacttccaccacagggctgtgcttgaatgtcagagcctactctggctggctctgtgattcgtgaatcacattcattgctcagttaatctcctttaaatttaattcagctgaagtttttcttttgtcacgttgctgccaccctttttaatgcctaacccacctttgacagctctattttgaaccttgtttaacttattatttattagcaagcctttagatccataaaatgtctttggtcagaatatgtaaggcaaccatttaggctggggtataggaattctttctagtcaacagccttttcacttaaagtactatgtataaggccttgctttacagttatgtgggttttattattatggggaaattcngggggccgnccacatttttgtttgtaaatagcngtttttttgggngtgtgcacaatt

SEQ ID NO: 630179 - DNA, 172 bp, Homo sapiens
  misc_feature (88)..(88): n is a, c, g, or t
  misc_feature (90)..(90): n is a, c, g, or t
agcttttccattttttgcagcggcgtgatctgcgcggcttcgtataccggcgcgcgcagtaccgctctgaggtattccgccccctcgngngcggcgatcagggttgagactcggccatcataacccccaagtttcttatcgcgcaccgcgccttgtcgcgctgaagccgggc

SEQ ID NO: 630180 - DNA, 284 bp, Homo sapiens
cccaaggggggggggggggcccccattttacctttttttaaaattttttttagggggggggccccccccttccccccctttttgaaaaagaaaaaaaagaaaccggggttttttttaaacccccctttttttttcccccccgggggcccccccccgggggggggggggggaacccccccttttttttgtttggggccccccccctttggggggggggggggggggggttttttttttttttttggccgctttttttttaagggcccccccttggggggggggga

SEQ ID NO: 630181 - DNA, 257 bp, Homo sapiens
  misc_feature (6)..(6): n is a, c, g, or t
actagntccaaccatacccattttgctagcttttaatttgcttcaaaaagtactgtagtttcagctacttgggaggctgaggcaggaggatcatgtgggcccaggaatttgagactgtccggggcaatatagcaagaccctaccctatgtcaaaaaaaaaaaggggtaccaaaattgtctctcacttactgggtgaaattagcaccaactttgtgccactttgattagtttgggtgtcccaattctggtttccttct

SEQ ID NO: 630182 - DNA, 136 bp, Homo sapiens
agcactttcggaggacgaggcacgtggatcgcttgaactcaggagttcgagaccagcctggggaacatggccaaacctgtctctacaaaaaatttagctaggcatggtggtgtaggcctgtaagtcccagctactt

SEQ ID NO: 630183 - DNA, 223 bp, Homo sapiens
tgagtagcccagtaaccttgcttgctttataactgttcgtgcgtccgcagctgtatcttcttccttttttccccacttcttgggggtcagtagtgcacaggacgccctccccaaggtgttcgacaccattttggacaacatggtgaaacactgtctcgactaaaaatacaaatattagctgggagtggcggcagacacctattatcccagctactcaggaggc

SEQ ID NO: 630184 - DNA, 1091 bp, Homo sapiens
agccgctggcctcaagcgtgctgaggatcctgccagcgccgcacctgcccgcccggtcctcgggctgtcgcagcgcggggaccaccctactgggagctgccgctgacatgagcgcagtgtcgcagccccaggctgctcatgccccactggagaagccggccagcactgcgatcctgtgtaatacctgtgggaatgtgtgcaagggagaggtgctgcgtgtgcagaacaagtacttccacatcaggtgctttgtgtgcaaagcgtgtggctgtgacctggctgagggtggcttcttcgtgaggcagggtgagcacatttgcacacgtgactaccagcggctctatggcactcgctgcttcagctgtgaccgcttcattgacaggcgaagtggtgtcggcgcttgggaagacctaccaccctgactgcttcgtgtgtgctgtctgcaggctgccctttcctcctggggaccgtgtgaccttcaacgggaaggagtgtatgtgccagaagtgttccccagccacattgctgggcaacagtgctcacgtggcccaggtcctccggagttgtgggggctgtggccttagaaatcaagaatggccaggccctggtggctttggacaagcactggcacctgggatgcttcaagtgccagacttgtgggaaaactcctccatgccgagtacatcagcaaggacgggctgcccttactgcgaggtgattatcacggcaggttggcatccgctgcacgctgtacaacgtactccagggcccggtgcaacaggccgaagaaaggttacaaccttattgcgcattcgtcaggggcccaaagttcacaagggccaggaaatacctgtaaggcacccccaatgggcctcgcggagtttcagtggtcacggctctagacagagcgagcaccccgatcgcaagcattgtcgctcaccaccagatggccctcgttgtgagaacagtgagctactccgaagctcgttcacaagtacatatcgaccacagatatatacaagcaggtaccacaagcatcatataacaaacacatgagacactacaaccgactctcctctttttgtctactc

SEQ ID NO: 630185 - DNA, 2380 bp, Homo sapiens
  misc_feature (593)..(593): n is a, c, g, or t
  misc_feature (1891)..(1891): n is a, c, g, or t
agacggggtttgacgagtgtgggagcaacaagaggacgctaggcgccgagcgacatttgctcgtgctaaggaccccgcgggggacctcagagagagcaccggagggatgatgccttccagatgaactcgatccccaatggggcagcgctatcgacgactgacttcctggcgcgctgcacccatcacttttttcccccttctactacagcactcttgtggccctctgtgcttcatccaaattgagcccatctggtcggcatgcgacaagcaactcacaggaggaggaatgccggcacattgcgccccttgtggggcctgggcccactgagcgcctccccccttgggctctgagtgctttctatggggctgagccgggtggaatcgttggtggggctcccctacttcgacttgcggcgcggggccttactgcgaagccccattgtgccccccgtgcttcttggcgctagtgggccaaaacccctaccactcacgtgcctcttgggctttgcccaggcaattcgttgttccacttccactcccgggctgtggagcgtgccttgcgccaagaaagtggcgctggagaaacccgctcnccacttttcgcacgccagaggcgccgcactgtggaacagcttgcaccttggaatgaaacgaggggcgagttgaaggacaaaagagccggtgagtcacacaggaagcggccccgagagggttcagcaggtccctgggccgccctccagcctccgaaaaagcgggaccccggaccctcccgcacgaagccaagacgccaagaaggcttagggagaaaagacgggacgaaagattggggaacacagaaaggggccttctgaactacggtgctcaagagggacttagtaggagacccttccggttgcgacacccaaccgtgagcaaccactttggtccccccacgacgccaaaaggtgaggaccttggaggatatgagggaaaagataggccccaggaccgaggccactatgtctgcccaagagggttcgccagccctcccccaccccggccccaccaaggaaaagagcccagaaaaggacaacgcggatggggaaggagccccgcccatcaggatagcacaccaacgaccattaggaccgctcacgggtgcgggcctaccacaaacatcttgggggatacaccctgtaggataagacacacttggaaatattggagagaaacacccaattgaagtgagaccccaccaagacacacagaataaatggaattccccgcctgagacgcaaccctaccccatcacaactgtgaattaacaatagaaagaagagatagaaatgagaaaggagaacacacatccactgacaacacttaggagaagagaaatagccgccgaggaccgccccgcgccccacgagacacaccccccatggtgagacaccagagagacaccccccccggtgtgtagccccgttgtgcaagagagagaagttcatacacaaatatgaagcaaagattacaaagaagagaacactacgaaagagcagacgaacacaacgaagacacagatacccacatcccactagagtgcccgagagacaaaacaccgaatgtggcgagagaaaaataaaaacgacaagaacagcaccccacaattcgccgacccatgtagagaccacctcaaacacaccccgacataacagcgacaaaagagaaaaagaaggagatagacaaatgaagacgaaaaaacaaccaaaacaagagaagtaataatagaaaacaccacaccataggaaacgcacaaattataaataaagaaccacagacagacgataaagaacaatagagcaccacaataggttgaaaaaagggacgacaaatagcacaaaggaagtagaatacnaagacacacaagaatgagtgatatgatagaaacacccaaacacacacatgaagcaaagatataaccagaccaacaagagtagaacacaacaaaggaggaaaaacacaccatgatgcacacgaaaccacaacagtagccacaccaacacaacatatcgcacacacagtgagtgagaccgaagtgcaagagaacaatcactacggaaaagtgaacaagcaaatcgaacaacaacacatacgagcagcgcatgatagacaagaacacaagatagaagaagaataaacaaaaacaatgaggtgccacccgcctcgcatgccgcaaacaccacagagagagaaaacaaagaaaggaagaaaacacatcaaaaagtagaaaagcatcagaaggccaactacaacggacgaggcctcacaaccgacaccacaccacccagcgcccacgcgtatgatcaaaacacaaaccagatctacagaaacagagcaccaacaa

SEQ ID NO: 630186 - DNA, 504 bp, Homo sapiens
  misc_feature (31)..(31): n is a, c, g, or t
  misc_feature (78)..(78): n is a, c, g, or t
  misc_feature (87)..(87): n is a, c, g, or t
  misc_feature (126)..(126): n is a, c, g, or t
  misc_feature (283)..(283): n is a, c, g, or t
  misc_feature (288)..(288): n is a, c, g, or t
  misc_feature (428)..(428): n is a, c, g, or t
  misc_feature (443)..(443): n is a, c, g, or t
  misc_feature (476)..(476): n is a, c, g, or t
cagacacaccctcggttcccgatcccgaatnatggccagcctcagtcccccagcagaagagcaccaggtcggaaagancagcatgcnggcattcctagagcccccatgtgggggcttctgaaactntgaggaggtagcagccctgccagaggtgaggggactgtgctggcccagaggggagcccaccagtccacagtcagctcctgccagcacagtggggcaggcaggcagagagggcaccacctcagtgacacagcacctgggtctacaaacatgcagcagntgccnccatgataactgaaagttggggggagatgaccccccgggcgctgctttaacggaagtcaaaaggcctccgtccgagcccgcacacgggcgacctctgacatgagggtatggccagcacatgatgggtgggcagagcgcgnagataccccgcctgnggcagtgcaccagccacccggacctcccgctgnttcttcacccacgtctgcaacgggagat

SEQ ID NO: 630187 - DNA, 309 bp, Homo sapiens
  misc_feature (13)..(13): n is a, c, g, or t
ttttcaaacatanctgtggagtgagttaggtttgggggatgtgtggagggcttggtttggtttctcgagacgggttcttgctttgtcgcccgggctggagtgcggtgccagatcacggctcactgcggccttgacctcccggatttaattacattcaccaaccgggcggggtggctcgtgcctgtgatcccggcactttgggatgatgaggcgggaggattgcttgggccccaggagttggagaccagcccgggcaacatagtgagactctgtctttaaaaaaaaataaacaaaataattacattcaaa

SEQ ID NO: 630188 - DNA, 446 bp, Homo sapiens
  misc_feature (10)..(10): n is a, c, g, or t
gaattcccgngcccacattcatggccacatatgtagcaaattttgtgaaaacaccaccatttgaagcttctgtaattttgagccctgctctaacaacaagcataatataaaattagttagattttgcaagtctacaaatgaggtcttgcaacagaactcacagcccttttacttttttcccccaactttagcaatgtaggatcttgagcccttaatttttggggttttttaaaatccagaagggatatagaaaccctttcagatttttcatttgatttgtttttgcagatgtttttttatcaaaaaccctattttaccctacaaatatttgttgcccaggcagaaactgctggatttagacatttttatttcaggtcattaaaaactgcaaaacccatttggatcatggacccaactgacttaaaataaatttacatgtttattta

SEQ ID NO: 630189 - DNA, 367 bp, Homo sapiens
gagatactcaaagtcagagaattgaagagcgcacttaatcttaaatcggaaaatgacttgtgatccaaatacccatagaactccaagaatttaatggcacctggaaataatcaagataaagctatcttgattatttcaagacataatcaagaaataatcaagataaagctatcttgattattccaaggaaatatgacctatgccggttagatttacaaccaattcaagctaaccagcttcttctgggctcactacagtcctttaaacccagttatttgtgaatattcccttacctctctgaccacacctcagtttccctaactggctcctcctttcctctcctgagattcctaaaattctgctcgtg

SEQ ID NO: 630190 - DNA, 743 bp, Homo sapiens
gtgagattacggcagagagcaccgcccagcagccagtgggttcccgcgtcgtgcctgagcagtctgatgccttgatcctcgcccacagtatcctcgtagcgatggccgtcaacgaagatcgcgatcttcggcgccactggaccagatctggagactcaactacccatggcgcacgcgagtgccagcacgtgttactcgaattgacagtgctgcgtgcgggactcctctcatggctgctcatcagagggcggccggcggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggctgcacctcggctttcctgctctgggaccctaccaaggtgcccccacgactgcaggctgtgactgatgaccacatccggatgcacaaggtgctgcgggaatcaggcctgaagtacgtggctgtgatgccgcacacataggagaccagccactaaactggggcgtacacagtgaccctggatggacgagggccctcaagggtcatctccaaaacatgacctgggccatttcatgctgcgctgctcaacacgaatgagtacgacggacacaggactaaccctcacacagtacagtagcatctgtccc

SEQ ID NO: 630191 - DNA, 254 bp, Homo sapiens
caagcggaatgcggcccccaactttccctttatcccacctgtggacgtcttggtcatccttcaacctcttctgtgaagtctgtcctgcgagctgagctcacactgactcttgggaaacacttccgagactcttagaaccaattattgtatccacaggacatctgcgatgatccccgtctgattgtgggcaatatcagcaaccaccagctgatccaagggagactgggacacaagccaatggtctctgcgttttc

SEQ ID NO: 630192 - DNA, 654 bp, Homo sapiens
gcaggcaggcggcgggcgctccagaccgcttctcctcctcctcttgctcctccgtgctcctgcgtcctacgccgggaggccgcccgtcgagtacctgacgcgagcgccgaggtcatgcgcgctgcgcgccatcccgtcccgtcgggctacgtcggagggcagcgctgccggagggaaaggcttgaaccgcacggccctggcggagctgagcgacggctagcgggcctggagcagacccgtcggtcggcgcgcagggcaacctatgggagacggcgagcatgcagtgcccggaagcggcgggagcgagccgtgaaatgaacgcgccgtttggtgttcgtagtcttccatatcgtgcctccctagaggcagaggtggacgcacttgcgggatgacatgtgagtagcccgaagggacgttgtcacaatgactcagaccacagggacacccccagagacgtccttgccttgacgaagcgtcccgaactcaatacggtaaatgcccggcggcccaaagggttggctgcgggggacacgaaaaggttgcgtatactagtgcaaggcggtccgcgttcgggagaagggcgcgtctcgtagcaatcaattcgaaagacacgatttgatcgcatggtaccctccgggcttcgactcaaaaatg

SEQ ID NO: 630193 - DNA, 268 bp, Homo sapiens
cgatctagagcatccccttgggtgcatgcatgtgggcacttcccaaagccattccattagtacaagatgattgatttgcccgctcggggcaatgactatcttcttcctttgaagaaacttggaagcagagcccagttccatggaccatgagggaagggtacacaccaagtgttggggagacacagcaggtggtgtcccaccatgaagcagggtcctgagccaagacctacatgcacacatgcacacatcccacatgcattcacccagg

SEQ ID NO: 630194 - DNA, 113 bp, Homo sapiens
acacttgtagaattgattagattacctgtttatttaatgtgagttgtgccttttgtctcaatcttccaatacaggtatattgagaaaaaaagcagtctaataaaatcctagac

SEQ ID NO: 630195 - DNA, 328 bp, Homo sapiens
ccatactgtgaaggtgagactgcctaggaattctgtcacatttacacacacaccctgggcaaagtgatattttttttttccatgtagaacaaattatgggcagaaagtgaagttagttttagaagtgctgtttgtggttggagaattgtaaaaatcttttaaagggataagggaattagtggcttttaatataaccactgtgttaggccgaaacactcactgtgtacatgggtgtatgtggtggttacggtggctgtctccaaagactctcatctcttttaatcactgcgaataaagcaatactgtcttgagagaatgcacctttggg

SEQ ID NO: 630196 - DNA, 852 bp, Homo sapiens
ggagcagccctggaggctgtgaggtgcagcaaagttttaagtttacctgagcccgggaggcaggggtgcagcgagctgagatcgtaccactgcactccagcctgggcaacagagtgagaccctgtctcaaaaagaaaaaaaaaaaagagagaaatcaggaacatcatgaaagatacagcaaaaggttttaccccagcccacggcaccacaccggggatggtgacaattaactggataaatggttccttttccggttcggaactggactaggtggtgcgtggatggaccagtgaaaagaaaatccggttggggtagggaagagggaagtagaaaacctcttggtatctcggtgtccaagaaactgggaagagacatgagggagcagagacctcgcggttgagtgttgggctctgcactaaacagctgtgtgatctggtctagtgccttaacctctctgagcctcagttgtcacatcagtaagcatgggataatgacatccacatgcccacttcaccagagctgctgtgaggcctggatgacgaaatgtcagacaagtctctcgcacacataacgtcaaatacacgtgtggtccggaacagtctcaacgggagtggtagccaacctggatagccctccaattcaagaataagcgtgcatgagagatgcaacggcacaatgtgccgtgagtgaaacctcggaaaccccgagagaggcgtggcacatcagctcctatacaagggaccatcggtgggcccaacacgacatagcagactatcgaagcaccaggatccagaagaagggccaggcctgggaaggaagaccttaaccgacaacgacgtagaggcaacggga

SEQ ID NO: 630197 - DNA, 569 bp, Homo sapiens
  misc_feature (6)..(6): n is a, c, g, or t
  misc_feature (27)..(27): n is a, c, g, or t
  misc_feature (32)..(32): n is a, c, g, or t
  misc_feature (34)..(34): n is a, c, g, or t
  misc_feature (39)..(39): n is a, c, g, or t
  misc_feature (78)..(78): n is a, c, g, or t
  misc_feature (95)..(95): n is a, c, g, or t
  misc_feature (105)..(105): n is a, c, g, or t
  misc_feature (107)..(107): n is a, c, g, or t
  misc_feature (111)..(111): n is a, c, g, or t
  misc_feature (124)..(124): n is a, c, g, or t
  misc_feature (171)..(171): n is a, c, g, or t
  misc_feature (193)..(193): n is a, c, g, or t
  misc_feature (205)..(205): n is a, c, g, or t
  misc_feature (208)..(208): n is a, c, g, or t
  misc_feature (218)..(218): n is a, c, g, or t
  misc_feature (238)..(239): n is a, c, g, or t
  misc_feature (260)..(260): n is a, c, g, or t
  misc_feature (265)..(265): n is a, c, g, or t
  misc_feature (279)..(279): n is a, c, g, or t
  misc_feature (281)..(281): n is a, c, g, or t
  misc_feature (291)..(291): n is a, c, g, or t
  misc_feature (294)..(294): n is a, c, g, or t
  misc_feature (298)..(298): n is a, c, g, or t
  misc_feature (311)..(311): n is a, c, g, or t
  misc_feature (319)..(319): n is a, c, g, or t
  misc_feature (334)..(334): n is a, c, g, or t
  misc_feature (348)..(348): n is a, c, g, or t
  misc_feature (367)..(367): n is a, c, g, or t
  misc_feature (371)..(371): n is a, c, g, or t
  misc_feature (374)..(374): n is a, c, g, or t
  misc_feature (376)..(376): n is a, c, g, or t
  misc_feature (392)..(392): n is a, c, g, or t
  misc_feature (395)..(395): n is a, c, g, or t
  misc_feature (403)..(403): n is a, c, g, or t
  misc_feature (408)..(408): n is a, c, g, or t
  misc_feature (426)..(426): n is a, c, g, or t
  misc_feature (433)..(433): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (448)..(448): n is a, c, g, or t
  misc_feature (456)..(456): n is a, c, g, or t
  misc_feature (463)..(463): n is a, c, g, or t
  misc_feature (472)..(472): n is a, c, g, or t
  misc_feature (475)..(475): n is a, c, g, or t
  misc_feature (485)..(485): n is a, c, g, or t
  misc_feature (522)..(522): n is a, c, g, or t
  misc_feature (543)..(544): n is a, c, g, or t
  misc_feature (547)..(547): n is a, c, g, or t
  misc_feature (551)..(551): n is a, c, g, or t
  misc_feature (563)..(563): n is a, c, g, or t
  misc_feature (565)..(565): n is a, c, g, or t
taaaanaaatttattctttattaaganacaangntaggngttatgaaggatttctgttggaaaaaattttgaaaaaanagtagctttagtttaanaacttgcacngnaganaaaattgttaaanaaattcaaaaaaaagtccaagtattagttcaatgtcccgtatttgantccaagatcttcaaaggaaggncttctgcaaaanaanatgctcctanaaagccgacatatttaaggnngcttgatttccttaaaattantccantgaaagcttctggngnaatcccacanagnaagncagtcttcattgnaaaagggnaggaaaggcctcgancccttttcccccgnggcctctttgttgttgggnaccnccncncgcacctcgaacgccnctngcggaacnagganaaccccccggggaaaaancggctcnancgnggggangaanagccccangacctcnggagggagnagnaccccttgcncctcaaaaaccccttcctcaagctccaaattgaaaancttcaaaaccaaagtagggannttnaaanccaaaaagaaantnatgg

SEQ ID NO: 630198 - DNA, 923 bp, Homo sapiens
tgcggtgactcacacctgtaatcccagcactttgggaggctgaggtgggcggatcacaaagtcaggagatcgagaccagcctggctaacatggtgaaaccccgtctctattaaaaatacaaaaaaaaattagccgggcgtggtgatgggcgcccgtcgtcccagctacctgggagactgagtcaggagaatggcgtgaacccgggaggcggagcttgcagtgatcgcaccactgcattccaggtcaggcaacagagtgagactccatctcaaaaaaaatacaaaactaaaaataattagtcaagatataatgccatcaggatatgaaggacacacacagaataggtggaacaaaagtggtagggcatccataccaagaaactcaaaatcagtagggcaaagacatggacacactgaacagacatgggggactcaggggaaaaacttccaaggtgtcctctgtgaactaggagtacagaaaagtgcagagcagggaaaggagcacggagaacgcctgaagaagtagccatatcaggagatagaggggcttgaatacccatacgtaggacagtaggggccttccactgacaggagtttaaggaggggaatacatgattcaggtggtctgattgtagacctgccatcggaagagatgaggaacacggattaagcaggggcagcgcgggaggaacgagaaccaaccagggaccgtgcagataactgctgcaacgctacgccaacgcagacgttaaccacaggaagtctgaacagtgggatgaagcaaatgcaaactcaagccaatagcacaggggagcacacaggacgaaaggaacacatcaggccgggacagaaggacaggacaccgaagacaacaacgacccaccggcatgacccaacaccaagacgcagcaaagggagcaggag

SEQ ID NO: 630199 - DNA, 166 bp, Homo sapiens
ctgagccggaccgcgcttgatgccttggtgaaaaagggaatgtcttccataaaaactagacagaagcattctcagaaacttgttgtgatgtgtgtacccagccaaaggagttgaacatttctattgatagagcagttttgaaacactctttttgtggaaaatgcag

SEQ ID NO: 630200 - DNA, 418 bp, Homo sapiens
aactgcgaagaggtgacgatcccggcccctgggttcccagcagcacacgggaagtctgactctcaactcccccgctaaagtgcctgtactttagtgaacctgagaggtgatgtgagtaatccgcgctgttctttgcagcagtgcgttccaagctctgtttttggtgagccgaatgggcatggctgcgctggatcctgcgcctccggacgtgctagccatttccagtgtcccaactactgtcttcgtgaggtcttcatcgaaagtgccatttcccaacgtcttttgggatttacatctgtctgtgttaaaataatcaaacgaaaaatcagtcctgtgttgtcagcatgattcatgtatttatatagatttgattattttaattatcctgtctcttttatatgtaaattttatgtacaga

SEQ ID NO: 630201 - DNA, 507 bp, Homo sapiens
aattatgatacagaaaaataggggccgaattcttttttttaataaccccttagcctttgaaaaaaccaaggcttttggtaacaaaggcctgccggctcaaattccccactttgtttttggaactccaaattccataaattgggggtttggcaccccgcccctaaaaaaacccatgcccgataagcctgaaaatatataaggagaaatgcccaaacaggggaggctaaagccctcccccaaaaattttatatttccccaagagggcccaaaaggcacggaagtttgtcttctacacctatgcaaaaggtttctcttttgaccccattttaaaggatccttccaaactctgtagagacattctcccaacactcataagctgctttttgggcctggttttggactttctcatctttcaaacgttgccccgtggttgatataagccctctcatataaaaaatgctctttttgtgctcctccgccacgttcttttaaccgaatcaaaacttt

SEQ ID NO: 630202 - DNA, 1143 bp, Homo sapiens
tccaaattcggataactgcacaaatgtaaccgtttccatctcgtagtacagcctgtctggaaaaacaagggcactccatggataagcggtatacttcttctgcattctcaagagtatgtttacacacactgcaaattcgttttacttacctctccaatttctcacgacgccgcattccctataggccccttcgggacgcgtttggttctgtgagtcaccgcgtagtgcttccaaacgcctgtgatctgcgacgttcccagacctccatttgccacgaagatgtaacgccctcgagaatttagggcctggctggacagacgcttgacttgcctcttaacacaaggccactggattctcctatgcagaacctgaaggaagactcgctttcgttagtactcttctggagtaccactatgtaaaaaggcttctacggaggctgctaatgacgccctgatgaagcttgagtttggtccatcactgggcccataggcagattgctctcctgaagtatatgatgacttcctccactactgaaagcggatctaccatccacactggtctaagagacccgtttcaacccctttgagcatgactaatcatgctgttctgcttgtgggctatggcacgtgatctcaacctctgggatggattactggaattgttaaaaacagctggtgcaccggctcggcgcgtgagaatggctacttccggatccgcagacggaacctgatgagctgtgcaattgagagcatagcagtcggcacgccacaccaattcctaaacttgtaagggtatgccttccagtatttcataatgatctgcatcagttgtaaaggggaattggtatattcacagactgtagactttcagcagcaatctgcagaagcgtaacaaatacgatttccatgaagatatttgtcttcagaatgtaaaactgccccttgaagttgtgttactataccatttcaatcggccactaggccaggttatttctaagtattcaattaagtgggaattttgtggaagatggtcagctgatgaagtaatagagtttctgttataatcattagtaattcaaaacatgcaatatgttattaaaatcaatgtgaaaacatagagcttatgttgttaaagttgtaccaa

SEQ ID NO: 630203 - DNA, 1006 bp, Homo sapiens
agaattgtagccacctggctaactgggatgagcctccagccgcctctggaagaagtgtcctgtggacaggcggaaagcagtgagaagcccaacgctgaggacatgacatccaaagattactactttgactcctacgcacactttggacatccacgaaggagatgctgaaggacagaggagtgcgcaccctcatttaccgcaactccatgtttcataatccggcacctcttcaaggacaatggtggtgctggtactgtcgaggctcgggcagccggcaatcctctgtcattgtttgctgccaaggccggggcccgctatggtcatcgggatcgagtgtgccagtatctctgattatgcggtgaagatcgtcaatagccaacaagttagaccacgtggtgaccagtcatcaaggggaagcggtgcggagttgaggctcccagggcaagaagtgtgagacatcattcatacacgcgagtggatggcgctattagtcctcttctacgatgatctcatgactcaacaacgtgactctatgcccgtggacaagtggctggcgcccgatggcctcatcttcaccagagccgggtccactgctgtatgtgacggtcatcgaggaccggcagtacaaacgactacaagatccactggtgggagaacgtgtatggcttcgacatgtcttgccttcaaacgattggtggccatttaagcgagccccttagtgggatgttcgtggagcccccaaaacaggtggtcaccaaacgcctgctcataaaaggaggtggacattctataccgtcaaggtggaagacctgaacgttgacttcccccgtttctgcttgcaagtgagcggatgactacgttggacgcctggaggcctattcgactcggttcacgctgccagaggccggttgccacaacccggcccctaacctggagacagtctccgggagaccacggaaacgcgaggacttgccgggggcacaaacggcgaccggggcggtcgcca

SEQ ID NO: 630204 - DNA, 325 bp, Homo sapiens
gctcgacggaaaagccctttataaaactatcacccggtgcctcggtgcggtcgctcacacctgtaatcccagcactttgggaggccgaggtgggtggatcacgaggtcaggagatcgagatcatcctggctaacacggtgaaacccatctctactaaaaaaaaaaaatacaaaaaaattagccggacatggtggcgggtgctgtagtcccagctactcaggaggctgaggcaggagaatcacttgaacccgggaggcggacgttgcagtgagctgagatcatgccactgcactccagcctgggcgacagagcaagactccgtctc

SEQ ID NO: 630205 - DNA, 338 bp, Homo sapiens
gagagaactaggctagggcaaatcaattacgattatatataaaggggtgaatggtatggaacgggaatgatctattccatttgaaaagcaaactgtcctgtggtgataggcctgaaacaggaaactggagaagccaagtggagctttaccctactcatggagaacagggcctgagagaaagctgacagcttttagaacgcgatgagcctctgggcacccttcaaggcagagactgaccctatggagcctgatgttagcataggaccagggcatgtgctcacagcaccacagtcatgcccagatcatggtattaacccaccttgaggctgctcaggctt

SEQ ID NO: 630206 - DNA, 278 bp, Homo sapiens
tttagtcttctctgaacttagtccatatgagacaacacggcgttttttttggtcatagaccgtcgccaggtaaactcagtctctattcatcagctggatgtacgtgatgtcagtcgttagaacgccactcaaatcatccaaattcttcatgagattgggcttttgtggtgtgtcagtggtcgtcgtcggcttcttatatgacttcctgaccatgcgagatttaaggctcatctcattcatgagctcccaaaccaaacgttcaccatcttcagtgttca

SEQ ID NO: 630207 - DNA, 461 bp, Homo sapiens
  misc_feature (399)..(399): n is a, c, g, or t
  misc_feature (449)..(449): n is a, c, g, or t
gataggttctatagcaaattctactgtaaaggctgcagttgcacagtgattctaaattctcttgtgaaagttgggatagaaatggctaaacagaaaaagtatctgtgcagctgctggcacttgtggcctatggggaaatacatcaaatgaggattataaaaattcagtagtggccaggcataggtggctcacgcctgtaatcccagcactttgggaggacgaggcaggcagatcatgacatcaggagattgagaccatcctggctaacacggtgaaaccctgtttctactaaaaatacaaaaaattagctgggtgtggtggcgggcgcctgtaggcccagctatttgggaggctgcggcgggcggatcacctgaggtcaggagttcgagaccagcctgngagacagagcatggaaacctaaagtctgtacccaaaactacaggactatntgacatcataat

SEQ ID NO: 630208 - DNA, 279 bp, Homo sapiens
ttgggaggcagcttcccacttttattaagggggttgtaaatctcagaaggggaacaatcacttttgttgttttgtttttgtttttttgagaaggggtctcactctgtcccggctggagctcagtgatatcttgttgtttttctttttttgagaaggggtctcagtctgtcacccaggatggagtgcagtggctcgatctcgtctcattgcaagctccgcctcctgggttcaggcgattctcccacctcagcctccagagtagctaggacttcaggcgtg

SEQ ID NO: 630209 - DNA, 328 bp, Homo sapiens
attcgcgggcgcgtagaccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagaggatgcccaactatatgaagacaccctagctggacgatcagttcttattaagaacctgacccctcaaactctacaacctcgatggactggaccctacttaggcatctataggaccccaactgccggccgcctggaggatcctcccca

SEQ ID NO: 630210 - DNA, 320 bp, Homo sapiens
gtatagaatcactatagggcagtcattatttaattttaaaactctcatttaaatttagcaatgttttagccgggcgtggtggctcaagcctgtaatcccagcactttgggagggcaaggtggcacctgcctgtaattccagctactcaggaagctgaggcacgagaatcgcttgaacccagaaggcggaggttgcagtgagcagagatcactccactgcactccagcctgggtgacaagcaagactccatctcaaaaagaaaattaaataaataaaataaatttgcaatgttttaaatgaatatcacttaaagtagtaat

SEQ ID NO: 630211 - DNA, 199 bp, Homo sapiens
tggctgcgtcgcggtggctcaacgcttgtcatcccaacacttcgggaggccgaggcaggtgaatcactagaggtcaagagctcgaaaccagcctggcggaaatggtgacatcccatctctactacaaaataaacacacaaagttaactgggtgtgctgcttggcccctgtcatccccccttcttaggaggctgtggttt

SEQ ID NO: 630212 - DNA, 242 bp, Homo sapiens
agatcgaatacaacaccaagacccagggtttcctggtgcgctcggtggagcgcatcgtcaatatgagctggggagaaattcatccgccgcccaagggcacggggcgcgatcactacctgacggcggtgacgcgggtcgataaccagttggtggaaatcatcgacgtggagaagatcctcgccgaagtggcccccacctcggaaaccatttccgttggggtggtggatgccgaaacgccacac

SEQ ID NO: 630213 - DNA, 321 bp, Homo sapiens
tgtttgggagatgactatctctctgtcgcgcagtcgtgatttcagtgtcaagatgttgtgttactgcagtctcggcgtcgcgtgttcacgccattctcgttgctcatcctccgtattagctttgagtacaggcgcccgcaccacgcccggctaattttttgtatttttatcagagatatgatttcaccgtgttagccaggatggtctccatctcctgacctcatgctcgcccgctttgtcctcccaaagtgctggcattacaggcgtgacagctgcacccggccaagaaatgatttgtaaccttttaggaaagttatatgg

SEQ ID NO: 630214 - DNA, 225 bp, Homo sapiens
  misc_feature (53)..(53): n is a, c, g, or t
  misc_feature (68)..(68): n is a, c, g, or t
  misc_feature (86)..(86): n is a, c, g, or t
  misc_feature (101)..(101): n is a, c, g, or t
  misc_feature (105)..(107): n is a, c, g, or t
  misc_feature (111)..(111): n is a, c, g, or t
  misc_feature (114)..(114): n is a, c, g, or t
  misc_feature (126)..(126): n is a, c, g, or t
  misc_feature (137)..(137): n is a, c, g, or t
  misc_feature (174)..(174): n is a, c, g, or t
  misc_feature (183)..(183): n is a, c, g, or t
  misc_feature (210)..(210): n is a, c, g, or t
  misc_feature (219)..(219): n is a, c, g, or t
  misc_feature (222)..(222): n is a, c, g, or t
gagagagagagagagagagagagagagagagagagagagagagagagagaganacacacggggacagngatctgcagctggaccgnatctctgtgtactanaatnnngccnccngtggcaaatatnttcctcgtgcnatcccggtggatctagaacccgggaccatggactctnttcgctcangtcctttcagccagatctttagaccanacaacttcntanccc

SEQ ID NO: 630215 - DNA, 172 bp, Homo sapiens
ctctagagatccctatgtctcgatcgaatgatgttgtgagatacaaatcaacattgtattaaaactttttctttgctcttaacaatgtatcatgtcaataaaattcctccacattatttcaaatggctgaatactgttcactggtatgagatgttgcttaaccaaatctcct

SEQ ID NO: 630216 - DNA, 178 bp, Homo sapiens
ccctttttttttttagcttttttaaagggggctttttgggggccagtgtaacgttacattctttttttaaaaaatttaggatttttttttccccccttttttgttttaaaaaaaaaatttttttttaaaattaaaggtttttttttaaaaaaaaaaaaaaaccccattttaaagttta

SEQ ID NO: 630217 - DNA, 912 bp, Homo sapiens
gtgtgtagttttcttctatttctcttctttttctttggtagttgtccattctagtcaatcaaggcccagcttaagctctttcttcagccttcctccaaacaataagtatgtttacagcctggtttatgggacagataccttctaatgttagccttctatgtctatgtctggctgtcctgtaaactaaagatttgagactgaccgaaaactgtcatcccaatgccttccagaggccctaccttttatacccagtaaatagtcactaaaactttcctgatgtctttaaacctacactggatcatgttttgttttgtttttgagatgacagagcaagatcctggctggtgggggaaaaaagcatttggctgggcacagtagctcactcttgtaatcccagcactttggcagacagaggtggaggattgcttaaggccaggagttcatgaccagcctgggcaacaagcaaaactccatctcaaacaaacaaagaaagaaacaaaatattatgaaagaacaaccagataagctggtaattcattggatgcgagagaaaatttatatatcgagactttttgacttacaatggagttatgtcccaataacttctgttacttgaagatatcattaagtccaaatgcatttggccaggtgcagtgatttacatctgtaacccacacttgggaggcaggggggggttgctggagtcagagtcgagaccgcccggtcgggcgctggagtccttcaaaaagagtaaaaaaaaaaaaaaaggggccgcgagccagaattataaaataggggcgcccaagaaggtgaagctgacaggcagggggttcaaaaacggagggaaacgcaggtgtagaggatcagcacagcacaagagagagacgagagaggaaacaacagagaacaaca

SEQ ID NO: 630218 - DNA, 192 bp, Homo sapiens
aagaaatggaagccaaagctgaagattaacttttgttgggaaacagagtccaattttagggaccacagagcagcgtttcttggcttgtaaatctagacttgaaagttttcagtattgaaaacttcaaggctgatatttttatttctaggtatttaaagtttcttacagatagacatgaaatgccctcctaaa

SEQ ID NO: 630219 - DNA, 486 bp, Homo sapiens
  misc_feature (478)..(479): n is a, c, g, or t
tgggacaatgcacgctcaccccttgaaggcaaacttgtggcttggtgatccaggggttgcaaaacaggctgttcactgccttggtcaagaggagctgggatgtgctcgtcttcacaccaggaagcaggtttttccagcataaccaggatgacacttgcacttgtttggcccgatacattcaccatgtttgcatcgtggttggcacacagctgtgaaaagaagatggcatgcattatttctaggtcaacgaaacaccaatcatatagcattgatgtcgtgcactagtttaataataaaagaaaaaaaactagaacttacaacaaagtagccaaagtatacaaaatcagtttcctataaacactctgtaagctacacacacacacatgtgttatgtatgtatatgtgtgtgtatcagttggggctgaaaaaaattttaaattcaaggacaatactcaaatagacaaataaaactaggtannactaaaa

SEQ ID NO: 630220 - DNA, 282 bp, Homo sapiens
ccctcgctattcgatcggcactcgtattcatcggcacccatcttttctatgtttagatacacaaatgcctaccattgtgtcacagttgcctatagtatttagtacagtaacatgctacacaggtttgtagaccaggagcaataagctacactatatagcctaggtgtgtagtggtaggttatcccatttgggtttgtgtaaagatgccctgtggtgccgatgaattcgctattcatcggcaccccatggtgaccacgggtgacggggaatcagggttcgatt

SEQ ID NO: 630221 - DNA, 458 bp, Homo sapiens
  misc_feature (450)..(451): n is a, c, g, or t
ctacctgcaaacttatgctggggaagaaaaatcaagtggagttttttaaggagcaaactgagataataagagcatcacttatttaaaaagattatgcaggtttttccagcataaccaggatgacacttgcacttgtttggcccgatacattcaccatgtttgcatcgtggttggcacacagctgtgaaaagaagatggcatgcattatttctaggtcaacgaaacaccaatcatatagcattgatgtcgtgcactagtttaataataaaagaaaaaaaactagaacttacaacaaagtagccaaagtatacaaaatcagtttcctataaacactctgtaagctacacacacacacatgtgttatgtatgtatatgtgtgtgtatcagttggggctgaaaaaaattttaaattcaaggacaatactcaaatagacaaataaaactaggtannactaaaa

SEQ ID NO: 630222 - DNA, 328 bp, Homo sapiens
atcattaatatatttttattcaccagcaaaatagcagctcacatattttggaaaaatagccatggaaagtagtttgagataagaatatttttaatttgggagtgatagaggtgtcttcgattgtgtatttatgtcagactgttttcctaccttgattacaggtttttccagcataaccaggatgacacttgcacttgtttggcccgatacattcaccatgtttgcatcgtggttggcacacagctgtgagctgacactgtccccgaattcggcgagcccagccccagcagcagtcaatcctcccaccataacgacataggccaatcga

SEQ ID NO: 630223 - DNA, 311 bp, Homo sapiens
cacatccaccttctcatcatagctgcgagcgttgatcatctcagcgtgccatccagtaggggttgcccaccacggtgtagacgcttcttgcggtctggcttcttgaggctccgcaggccctcaggctgagtcttctcgtccacagtgatacgcgccagtcccgatagtcaggcatccaccacagttcttggttctcgccggaccaggcagttgtgggagttgaggtctcggtggatgatgttcctggagtggaggttggccatccctgatgcgatgtccttgtgccaagctcactctctggctccctgggt

SEQ ID NO: 630224 - DNA, 1845 bp, Homo sapiens
  misc_feature (211)..(211): n is a, c, g, or t
  misc_feature (930)..(930): n is a, c, g, or t
  misc_feature (943)..(944): n is a, c, g, or t
  misc_feature (949)..(949): n is a, c, g, or t
  misc_feature (1122)..(1122): n is a, c, g, or t
  misc_feature (1206)..(1206): n is a, c, g, or t
  misc_feature (1339)..(1339): n is a, c, g, or t
  misc_feature (1621)..(1621): n is a, c, g, or t
  misc_feature (1646)..(1646): n is a, c, g, or t
  misc_feature (1653)..(1653): n is a, c, g, or t
  misc_feature (1701)..(1701): n is a, c, g, or t
  misc_feature (1712)..(1712): n is a, c, g, or t
  misc_feature (1719)..(1719): n is a, c, g, or t
  misc_feature (1721)..(1722): n is a, c, g, or t
  misc_feature (1734)..(1734): n is a, c, g, or t
  misc_feature (1743)..(1743): n is a, c, g, or t
  misc_feature (1746)..(1746): n is a, c, g, or t
  misc_feature (1756)..(1756): n is a, c, g, or t
  misc_feature (1773)..(1773): n is a, c, g, or t
  misc_feature (1779)..(1779): n is a, c, g, or t
  misc_feature (1797)..(1797): n is a, c, g, or t
  misc_feature (1836)..(1836): n is a, c, g, or t
cagtggccacccttgttcacctttgagacacgctctgatgtcagcccctcgcaagtgatctgtgtttcctccagccatgccaccatgtcttccgcacagggctgctccgtgggcaccgtgttttctcacaaacacctggagtgtgccagagtgcagccccgtcaccttgtgcctgaatgacaggcacaggtcccctgaatgcatgaggcgnccgagaggtagcaccaagcgtgcagcttttcccactggggctttggctgccgacactgtcagatattgtccacctgctgggtccctgattggttcccagtgcaagtcattgtctttctccctgatccatccacaaagtccatggtcaaaattacaactgtgtaccagaacacctggatcatcctttgcttcatcgtctgcactgactcctctttctatttcaaatatttcaaacaagtcatttgaaggttgccgtggaatgaacacatctcctctgggtttctgagggtctgtctgtaccctgttgtcaactgtaatccctcctggaggtgtactggcagctggtgctatagttgtcagtccggtggttggcctttctggggttgtaggtggtagaggtgttctgagctctgttggcaggggtggtggtggtggtggagtaggaattggtgttggctttggtgtaggtcttgttgttggcttagaagtaggcctgttggtaatgataggaggaatatatggtgtcttcggaggccaccaagtacttccaacatcaggaatccaattattatttcctgtgtcaccctttaaaatggtaccatttccctttggtacatgaattggacctgaaggttcaatcataacttttgggatatacacacaagtcagtccatcaccctggtatccttctttacatttgcacttgtaggacccacgtangttataacatcgnncaaanctgctgcactgatactgaccaagtgagcattcgtctatgtcatgacattgatatttgcctccaatatacatgagatcgaagcctttatgacacttgcagatgtagctcccaaaagtgttgacacattgcctaaatctagggcaggaggctcttcctgtagcacattcatcaanatctacacaggtcctcccatcaggagccaggtgcaggccaggggatgggcactggcaccgtatttgtcctttaacaacatccanccatactgacagtttgccatggagcaggtcagggcacttgagcaggaaccatccggcatgagcatatatccgttgagacagtagcacttgtagctgccgtaagtgttcatgcacctgtgcttacagggccggngcttcaggccacactcatttagatcttgattacaggtttttccagcataaccaggatgacacttgcacttgtttggcccgatacattcaccatgtttgcatcgtggttggcacacagctgtgagctggcaccttatcctggctattctctgccttaagacgtagaaagctgcaaaacaaatgtccaaaaaaagaaattccagatcttttctctgtaaggaggctggacttgggtatttatcaacttgttacattcccggagacttacacatattcaactttnagtgctttttcttgaaacaaaaaanaatctangacatgtttaaaataagtaatatttttagtcaccattttgttataaanaaaacatttcntaacaananntattaaccaatnattggaagnttntgcctattcnttttataggtcccaaanttttanaattttaaaatatttccngacctttttgtggatggcctgttatttttgcaaattccnatctttttc

SEQ ID NO: 630225 - DNA, 250 bp, Homo sapiens
gtatttacccccttcttctctttgcggcactaccgtgtgctcttctttctaacacttgttaatattacccctattctaactaaaacatctgttcaggggctgatcaaaagcgttttggcgccgcacccatatgttttttcagtctgacactaagactaaaaacaattgtgaatatgcttgtttctcccaaattagtgggctaatgaaggttccctagttatgattctacggcgtcttaaactttgcggac

SEQ ID NO: 630226 - DNA, 198 bp, Homo sapiens
aacacaatttacaagctttgtggcagttgagaaaagggatgagaatgtagtcaccttttcctgatattccaaaagtttctgaacttatttccaaagtaagtatgttagtacttcctgtccctacatgtagtctgtgtcagtgtgtgtaacccaaagtatagttcgttcagtaaccagttctctttaagtcaatccctc

SEQ ID NO: 630227 - DNA, 380 bp, Homo sapiens
atatcggaaaccattgtgcttcactggtcatgcgttttgtgataggccacgctacgagatcaactcgtgcagtcttcctcgacaataagggtagaaagtgctgtgtcgcaacatttacatcactcattcgacgcatggtctttcgtaaagaccgtatataatggcatcaattgccgggtgtgttggcatgggcatgtgtatctgacagttttgggaagctgtggcggccgactcttaaggtctatagttcccagcacgcttggtcaacatggtacagccccgtctgtgtcatgcatacctacatcagcctggtgtgttgggtggcgtttagagtcccagaagctacacagtgttaggcaggatcatcgcttcaacgtggg

SEQ ID NO: 630228 - DNA, 1733 bp, Homo sapiens
  misc_feature (211)..(211): n is a, c, g, or t
  misc_feature (930)..(930): n is a, c, g, or t
  misc_feature (943)..(944): n is a, c, g, or t
  misc_feature (949)..(949): n is a, c, g, or t
  misc_feature (1122)..(1122): n is a, c, g, or t
  misc_feature (1206)..(1206): n is a, c, g, or t
  misc_feature (1339)..(1339): n is a, c, g, or t
  misc_feature (1725)..(1726): n is a, c, g, or t
cagtggccacccttgttcacctttgagacacgctctgatgtcagcccctcgcaagtgatctgtgtttcctccagccatgccaccatgtcttccgcacagggctgctccgtgggcaccgtgttttctcacaaacacctggagtgtgccagagtgcagccccgtcaccttgtgcctgaatgacaggcacaggtcccctgaatgcatgaggcgnccgagaggtagcaccaagcgtgcagcttttcccactggggctttggctgccgacactgtcagatattgtccacctgctgggtccctgattggttcccagtgcaagtcattgtctttctccctgatccatccacaaagtccatggtcaaaattacaactgtgtaccagaacacctggatcatcctttgcttcatcgtctgcactgactcctctttctatttcaaatatttcaaacaagtcatttgaaggttgccgtggaatgaacacatctcctctgggtttctgagggtctgtctgtaccctgttgtcaactgtaatccctcctggaggtgtactggcagctggtgctatagttgtcagtccggtggttggcctttctggggttgtaggtggtagaggtgttctgagctctgttggcaggggtggtggtggtggtggagtaggaattggtgttggctttggtgtaggtcttgttgttggcttagaagtaggcctgttggtaatgataggaggaatatatggtgtcttcggaggccaccaagtacttccaacatcaggaatccaattattatttcctgtgtcaccctttaaaatggtaccatttccctttggtacatgaattggacctgaaggttcaatcataacttttgggatatacacacaagtcagtccatcaccctggtatccttctttacatttgcacttgtaggacccacgtangttataacatcgnncaaanctgctgcactgatactgaccaagtgagcattcgtctatgtcatgacattgatatttgcctccaatatacatgagatcgaagcctttatgacacttgcagatgtagctcccaaaagtgttgacacattgcctaaatctagggcaggaggctcttcctgtagcacattcatcaanatctacacaggtcctcccatcaggagccaggtgcaggccaggggatgggcactggcaccgtatttgtcctttaacaacatccanccatactgacagtttgccatggagcaggtcagggcacttgagcaggaaccatccggcatgagcatatatccgttgagacagtagcacttgtagctgccgtaagtgttcatgcacctgtgcttacagggccggngcttcaggccacactcatttagatcttgattacaggtttttccagcataaccaggatgacacttgcacttgtttggcccgatacattcaccatgtttgcatcgtggttggcacacagctgtgaaaagaagatggcatgcattatttctaggtcaacgaaacaccaatcatatagcattgatgtcgtgcactagtttaataataaaagaaaaaaaactagaacttacaacaaagtagccaaagtatacaaaatcagtttcctataaacactctgtaagctacacacacacacatgtgttatgtatgtatatgtgtgtgtatcagttggggctgaaaaaaattttaaattcaaggacaatactcaaatagacaaataaaactaggtannactaaaa

SEQ ID NO: 630229 - DNA, 118 bp, Homo sapiens
  misc_feature (4)..(4): n is a, c, g, or t
ctgncagcttcctgacttcggtatgtgaagaaatagtgggtggatgtacagagctaagttctggcagaacacgatgtggaaactgacacagtaatatccccagttgttgctacacatt

SEQ ID NO: 630230 - DNA, 796 bp, Homo sapiens
  misc_feature (211)..(211): n is a, c, g, or t
cagtggccacccttgttcacctttgagacacgctctgatgtcagcccctcgcaagtgatctgtgtttcctccagccatgccaccatgtcttccgcacagggctgctccgtgggcaccgtgttttctcacaaacacctggagtgtgccagagtgcagccccgtcaccttgtgcctgaatgacaggcacaggtcccctgaatgcatgaggcgnccgagaggtagcaccaagcgtgcagcttttcccactggggctttggctgccgacactgtcagatattgtccacctgctgggtccctgattggttcccagtgcaagtcattgtctttctccctgatccatccacaaagtccatggtcaaaattacaactgtgtaccagaacacctggatcatcctttgcttcatcgtctgcactgactcctctttctatttcaaatatttcaaacaagtcatttgaaggttgccgtggaatgaacacatctcctctgggtttctgagggtctgtctgtaccctgttgtcaactgtaatccctcctggaggtgtactggcagctggtgctatagttgtcagtccggtggttggcctttctggggttgtaggtggtagaggtgttctgagctctgttggcaggggtggtggtggtggtggagtaggaattggtgttggctttggtgtaggtcttgttgttggcttagaagtaggcctgttggtaatgataggaggatatgactggttacactgaaggaggaaattttggcggtggtaactatggtggtggtgggaactataatgattt

SEQ ID NO: 630231 - DNA, 424 bp, Homo sapiens
  misc_feature (81)..(81): n is a, c, g, or t
  misc_feature (396)..(396): n is a, c, g, or t
attcggaacgaggagcaggttgcgccccagcagcttctcggccggctccgcgcggtacttcacgcctttcagcgccagganattcagcgcgacgatgatcagcgcgttgaagatcaccgccgacagattgccgacgtcgggctgtgcagccccatcacgttcagcgcgccgagtgccggatacgtcgcgacgaacgcggccgggatgatcgcgaaatacttcgcgagatcgttcgcgacgctgaacgtggtcagcgcgccggtgcaatggatcatctgcttgccgacctcgaccacctgcatcagcttcgtcgggttgctgtcgaggtcgaccatgttggccgcttcctttcgccgcctgcgttgccgttgttgcattcgcgaacggccaagtggnccttgcgcgaagcccgggcgcattcgtt

SEQ ID NO: 630232 - DNA, 994 bp, Homo sapiens
  misc_feature (211)..(211): n is a, c, g, or t
cagtggccacccttgttcacctttgagacacgctctgatgtcagcccctcgcaagtgatctgtgtttcctccagccatgccaccatgtcttccgcacagggctgctccgtgggcaccgtgttttctcacaaacacctggagtgtgccagagtgcagccccgtcaccttgtgcctgaatgacaggcacaggtcccctgaatgcatgaggcgnccgagaggtagcaccaagcgtgcagcttttcccactggggctttggctgccgacactgtcagatattgtccacctgctgggtccctgattggttcccagtgcaagtcattgtctttctccctgatccatccacaaagtccatggtcaaaattacaactgtgtaccagaacacctggatcatcctttgcttcatcgtctgcactgactcctctttctatttcaaatatttcaaacaagtcatttgaaggttgccgtggaatgaacacatctcctctgggtttctgagggtctgtctgtaccctgttgtcaactgtaatccctcctggaggtgtactggcagctggtgctatagttgtcagtccggtggttggcctttctggggttgtaggtggtagaggtgttctgagctctgttggcaggggtggtggtggtggtggagtaggaattggtgttggctttggtgtaggtcttgttgttggcttagaagtaggcctgttggtaatgataggaggaatatatggtgtcttcggaggccaccaagtacttccaacatcaggaatccaattattatttcctgtgtcaccctttaaaatggtaccatttccctttggtacatgaattggacctgaaggttcaatcataacttttgggatatacacacaagtcagtccatcaccctggtatccttctttacatttgcacttgtttggcccgatacattcaccacgtttgcatcgtggttggcacacaggctgacactgtccccaagactggcgagcccag

SEQ ID NO: 630233 - DNA, 877 bp, Homo sapiens
  misc_feature (48)..(48): n is a, c, g, or t
  misc_feature (81)..(81): n is a, c, g, or t
  misc_feature (98)..(98): n is a, c, g, or t
  misc_feature (156)..(156): n is a, c, g, or t
  misc_feature (192)..(192): n is a, c, g, or t
  misc_feature (253)..(256): n is a, c, g, or t
  misc_feature (259)..(260): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (327)..(327): n is a, c, g, or t
  misc_feature (331)..(332): n is a, c, g, or t
  misc_feature (336)..(336): n is a, c, g, or t
  misc_feature (339)..(339): n is a, c, g, or t
  misc_feature (355)..(356): n is a, c, g, or t
  misc_feature (358)..(363): n is a, c, g, or t
  misc_feature (365)..(365): n is a, c, g, or t
  misc_feature (367)..(371): n is a, c, g, or t
  misc_feature (376)..(376): n is a, c, g, or t
  misc_feature (378)..(379): n is a, c, g, or t
  misc_feature (381)..(381): n is a, c, g, or t
  misc_feature (384)..(386): n is a, c, g, or t
  misc_feature (393)..(395): n is a, c, g, or t
  misc_feature (397)..(397): n is a, c, g, or t
  misc_feature (399)..(399): n is a, c, g, or t
  misc_feature (402)..(403): n is a, c, g, or t
  misc_feature (416)..(419): n is a, c, g, or t
  misc_feature (423)..(426): n is a, c, g, or t
  misc_feature (429)..(430): n is a, c, g, or t
  misc_feature (437)..(437): n is a, c, g, or t
  misc_feature (449)..(450): n is a, c, g, or t
  misc_feature (452)..(453): n is a, c, g, or t
  misc_feature (456)..(456): n is a, c, g, or t
  misc_feature (480)..(480): n is a, c, g, or t
  misc_feature (518)..(518): n is a, c, g, or t
  misc_feature (520)..(520): n is a, c, g, or t
  misc_feature (529)..(530): n is a, c, g, or t
  misc_feature (533)..(533): n is a, c, g, or t
  misc_feature (544)..(544): n is a, c, g, or t
  misc_feature (546)..(546): n is a, c, g, or t
  misc_feature (557)..(557): n is a, c, g, or t
  misc_feature (561)..(561): n is a, c, g, or t
  misc_feature (634)..(634): n is a, c, g, or t
  misc_feature (874)..(874): n is a, c, g, or t
agaaccaaagtagagaaatatatacaatacattaagtactttcaatanagtggcatttttcatattaaattaaaagagggnactatgatttacaatgncatttcccgtagtttaaaattcaacatgtcaaaagacataatgtacattttttacaanactgacacagcagtattaaaactgctaatgattgtngtttttattttttctataatacactgcacctgtgttaccaaaaaaaaaaaaacaaaaacannnnggnngggctagagggtttgaatactgcataagtcagtatattaacacttgggggataagggngggngnggngggnnttanggngggggtcattcacaanngnnnnnncncnnnnngcgcngnnanggnnnagggggnnngngntgnngggggggggttannnngggnnnnggnnaaggggnaaaatgtcatgnngnnggngaccacaatgccatcacaaaagcngatatcgatataaccctactatttacaatacctaatangngccaaagcnnganaatcactcacngntaaatcatggnaaantattatagtttgtgggaaattttgaatatctataaaatattcaatagactacaaaagagcttgcaacagcttnttctcattatttttcttaggtcagaattagaaaaaagtaaatcctattttttaataagttttgatggcatcaaaaagcttcacatttataaataagatttttatacaaagcaacatgttactgacatagttttctcttgctactatcaattattctcgggactcatgttgtatgttaaggaaggaagtattaagatttcttcctcattcctaaattttcagaatatactctaggccttgnagg

SEQ ID NO: 630234 - DNA, 349 bp, Homo sapiens
  misc_feature (338)..(338): n is a, c, g, or t
gagctcggaccgtgttagcacaacctagggtcagttttgcaggtggtagccatttaccaagatagttgtaggtaagaagggcagatttattagagaaattgtgaaagtatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgctacnccacaggggat

SEQ ID NO: 630235 - DNA, 508 bp, Homo sapiens
tgctcgtcctgctctgcccagtgtgatgattgacattgctttatttgtggacaacatataggacgaagaagaaatgtgtctccggctacgggaccaagaatggtggtggcaaaaggaaacgaagcctgtaatcccagcactttgggaggccgaggcaggcatatcacctgaggtcaggagctcaagaccagcctggccaacatggtgaaaccccatctctactaaaaatacaaaaattagctgggcatggtggcacgtgcctgtaatcccagctacacaagaagctgaggcaggtgaattgcttgaacctggggggcagaggttgcagtgagctgagatcatgccacttcactccagcctgggcgagagtccatcagaaaaaaaaaaaaaaaaaaaaagagagaaagaaagaaaaaaaagggaaaaaatgtgtttgggaggtcagtcaccgtgggatctgagcacctccttaaacgtgtcttcaaattaaagcctttggccaatgact

SEQ ID NO: 630236 - DNA, 440 bp, Homo sapiens
  misc_feature (68)..(68): n is a, c, g, or t
  misc_feature (75)..(75): n is a, c, g, or t
ccaccctcctccccccaaagaaaaaagggaacctgggtgattgctttgatccaccttcctcaggggcntggggcntagagagacccgtgcccaccccggggacctcgggtcgcctctgggtgccaggaggagccaggagtccagggaagtccctaggctccgccccttactcggatgggcctttgcggcaaatgctccgcacccagtgacctcggttgggagccacagcggggctgggagtattcactgcccttccgcagggaccagaggcggatgtcgagggaaggtggcggcatgggcggcccctgcctctgagtggctcagcaggcactcagcgggcgccagcaccaaggacagggccggggcctccacagcctgccctcctcgccctccctcctctgacacggtcccagggccgctggaggcgctgcgggcggccg

SEQ ID NO: 630237 - DNA, 1290 bp, Homo sapiens
atccagagatcactctatgatcgtccagcctcatcatcagacagaaatctctgttcagactcagaagtccaaacacacctccatttcgagcatgcatcaactccagcacaggccttcaattatcaatttggcattctggttgcagcttacacctcatccaagttgcccgcaggcacatggcagtttattaggcgttccacaaaaattagtgtcccaccgtgcatctggctgctcgccaacgtcctcctggccaccaaggaacaaaatatgtgaagcatctgatagacttatggccatggccagcagcacatccatagccatgcattccgaaactcatggtagtcggacacaggcaggtcacccttatcattgcccgttgcaagtggcataggctcctgcagcagcaatcttatgacaaacactactaaaccaacaacagtggagatggactgtacatagggatcgtatatcgagacactatctggatactggagcagaatcctaaaaccccctttgagatggaaaaacccatataaaccccaggacaatgaatgtgtagagagtatactaacattacataacaaattaaggacatcaaagacgttgggattacccccgggaacagggaacacaagcacctagaagaccacagaacttaacccacgagagacacagatcccacaccggacggacatcccatcggctggaacaacatgcgcctagggaaaccacgactggacagaacccacgagacaagaacagcaggaacgaccaataccatgagagatcaaaccaagcatcggaacgatggacaggacatatggggcgggacaagacaaaactcaagaaatggaccgttgggcaacacagataacattctaaaacacaagacaagacttaaattggtaacggaacaaacagtatatgatagaacagtagagtaacacagagtatcaccagatcgagacaaaagacaggtggacaccaacacaaaaacaatagagaagagatagggcaaacaagcaaaatagacgaatgatacgaaacccataccaggacgcaaaaatagaagaataaacaaattaggagaaagattcataacaaataaacgaaaacagaaaaaacaacacaagagcaacacaaacagaaaaattcgacagggaactagagaacagaagtatatagaaaatggaaaaagagagcaagaaacacgaagagagataggataggaacagtaagagatatcaaatacatataaatacatagaacgaagaaacagatacagaacac

SEQ ID NO: 630238 - DNA, 642 bp, Homo sapiens
cgccggtgtttccctattgtctcctatctaccacgccttcctaaaatttctccccctttaaatactgaagccctcaaaatcatcttaggagaaaggcacagaccttgggcctgggtgcatgcccttaaccttggtacaataaacttctaaataaattgaggcctgtctcagatactttttggtttgcaacaaatataaaatggttttacaatttgcgtttacaacaacaacaacaacaataaaatggaacaattataacaataataaaagtaattaagtaaagttaatttttctagagagagtctcactctgtagcccaggctaggagtgatcatggctcactgctgcctcaaactcccaggctcatgcgatcccaagtagctggggctacaggcatgtgccaccacacctggctaattttcatcagtatctcagaagacacaagtatacccccaggtagcctgggctgaactcaaactcctgggctaaagcgatcctccagcctcggcctcccacaatgctgcgataacaggcatgagccaccacacctggccctaagattaaattcaaaagtatcacaataataaaatcacatacgggtcacttgaacacaagcatgggacccacgtgatgatgtgtaat

SEQ ID NO: 630239 - DNA, 509 bp, Homo sapiens
agaggatcccccacacctaaccccaccctgtgcttgtataggaaacacgctggatttgaaaggtggcaaggagtttgtggaagctgtggtggttctccggaaaaagaacgggcccttggaagtagctggaggtgaggtgggaaagccaccgtgcttatctggttgtgacacatgcagtattaggaaagccattttgtgagagggcttagaattcagaggtgtgtggcagcacagccgcatcttcaagatggaggccaaggacagcctgtagctttacatcttagagtttcaccacatgcaggttgtctgggaaaatcacctttgcatttttttttattacttaaaatagctcctatatgtttgatgtctagatcacaaattttaagaaattataggagctgagtttggtacatctaagagctgagagtgagtgatactgagccatctgcaaaactgctggtgagagatacaaattaaaaatcttcagccatttgtgtgtgtaagaggaa

SEQ ID NO: 630240 - DNA, 118 bp, Homo sapiens
tcccaagatgagaaattgctcccactctttccatcttctgcactgatctccagcaacttcactttctcatagtcttctcctcttgccgcacattcctttttcaatttctcatccttgg

SEQ ID NO: 630241 - DNA, 262 bp, Homo sapiens
agaacacctgacagatatggtctcgctactggtggtgcagtgtaaggagaagagggcttgaccctgaaatcttgaagacgtcagagctcatgactataggaaaagtcggaaaggtcattgagaccaaagacgatgccatgctctaaaaaggaaacggtgacaaggctcaaattgaacaacgtattcaagaaatcattgagcagtaagatgtcacaactagtgaatatgcacaggcacacaactgattgaacggcttgcaaaa

SEQ ID NO: 630242 - DNA, 138 bp, Homo sapiens
gagggtgtagtatctaagtccggcgatgatggtgtgggcacgagagagtgcggcagttctatacgggcgaggctggcgtttggtgagtgcgggtgaggtgtgtgtgtgaataagcaagagagagaggtgatgtggcaa

SEQ ID NO: 630243 - DNA, 400 bp, Homo sapiens
  misc_feature (400)..(400): n is a, c, g, or t
cgttagtgaatgaaatcttgtggctgatcctgacgcatcacaacacgatttttttggtagtgttgcttaatgttgatcaccggtttgctaacaatcctatcaccacctctaaagtgccggttcttaacactggcgcttccagtgtggacgggagggaggcccctctgaacacgtgacgtggtccatccaagccaaagttgtcaccctcctttcctcttctacctaccgctttaaaatacattcaaataaagtgtaagtgactgcacgtatttgcagcagccaggagagcagagaacgtgatgaaccagcactctgtttggagaataaatagtttgaaatcgtgggactgacgctggctgcttggggaccttctcaaagcatccttggtgggcataaggtn

SEQ ID NO: 630244 - DNA, 1094 bp, Homo sapiens
tgcttgcagcgcgtgagctgagccggctgggtgagcggcggccacggcatcctgtgactgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagaccatttgatcagctgacaccagaagagagcacggaccggcttggaatgattgtcgataaccatagacgtggcatacaacgatgggtttgtgacggaggcggagctgaacctcctggattaagcacgcccagaaccaactccatatatgacaactgtcgcaaaccaatggacaggagctctgcatctgaatcaacgcacggcttactctcctgggatgagtacagaaacgtgacttatggcacttaacctggaatgatccagatcactgatgactggatcacaactatacaaacagcatgactgcgtctagcagcatgcacggaaggtataaacatgggcacaaaaacgaatggacagacactacaatgccacacacggaagcgaaatacaacagagtataacctggacaaacatgaaggcagctctgcactcaccgtgacacgcatactactaaacaacaaggaaaacaagtagaagactcatgcaatacacctgacaccggacccaagaacgatgaacaaacaaacaagaaacctgacaccccagcaagcaacaaaccgacaaacacacacaggcgaagaaaccgagacacccagcaactcatcctaataaaacccactccacacattcaaaagaaaatatactatatatacattcatcaacatatacataacgacactataccacccaatcaataaaaacatcaaactccccacatccagaaatcaaaaaaaaaaaactttaatcaaccttacaacgacacaataaacaacagcaccccccactcacacaccacacacacaaaacagacctaaccacaataacac

SEQ ID NO: 630245 - DNA, 235 bp, Homo sapiens
tctacaagattacctgtcatatactgaagaatctcttctaccagtcttatgcagcacctggctaagaatgtagtcatggtaatatcaaggtacttacaaagcacattgactgtcaatgaacaagtatgccacatcgaagcatgctaacgatcagcactctaccacacgttgaattctgcactagttcaaagatttagccaaggctgtgtgcaaagtgtgtaaccttgtaaagctt

SEQ ID NO: 630246 - DNA, 394 bp, Homo sapiens
tacatctgacacagcataatcaaaagatgagggggtacatcttgttgccacttgtgcagaaaatgatggcacgattttgcagtattggagattccaggaaacaagcattttgattctttgagggccacaacggaggtcatgaagatgtccagcggcacatggtaatgacctggcttaatggggctggctcactgatgagtactagaagtgttcaagaaacctcagcagcatatatccacttggctgcagatatccacgtggccgcagatatgccttattcttgagcccatgtaaaacactgtgtaggggctcttagaaattatgggcagaggattttgcaaggagctgaagttcggcatcagcaagcaaagacaggagccaatgaaatacggat

SEQ ID NO: 630247 - DNA, 118 bp, Homo sapiens
gatacaatcgagctggtacccattccggatagccgagaaagtgttgtgaagaaagttagatttacgccgatgaatatatagtgaaatggattttggcgtaggttagcgtctacctggt

SEQ ID NO: 630248 - DNA, 1426 bp, Homo sapiens
ggtggtgaggagtgctggaggtgcggcgaaaggcgtacggacgtcgggtgaacgtggatgcgagccagatttatccgtgtgcatcccccaaggggtaatacgatgcttcaagttgataacgttggataggcacgcgtcgacctgtgaaccggagtagttgcaccattggagctttgcatatcgcttaccgactagaggtgtgatccgagatcaaggagtcgtttggaggagacatagggactccacctctgaaaaccaacctataggctccattctaccaggggacgataggcgaaagtggagatgaattgaggaagtgacagctagctgcattaactgagcagtgtgttacggtggatttcgagtccttccaccgtgagtgttggactcagtactaggagggactggatgtgtcctgtattgtcgaggtagactagggacccaccatcgcactattgtacttcttgctataatctcactgatcgtattcactaacttgagagcaatcagtagtactgcactgctacatgattcgtctgggtcgataaggcggtgtgcctagcatgttgcttcccttctaaccgtggcaatagtccgcgaggtcacaatgctcaattggttctactcgagggttgtgcgcacgcatcttgattggacgtggaatacccccatgggaatttcaacgttagttttgctgggggccgcgaggaagagagtccacctgtgtctttcgaggtaatctagggaatagtttaacgatggaggcaaagttcccgttggttaggttgacattccactccgtgcatgcggtttaatacgagcttggtagtcaccctttgaggattagtccgacatagaacctttcattttgcccgaagggaacctaaagattcccactatcctagggaagtttacttcaccgaggggcgatccgagatggaatcgcgggattgatcgggaaaacccaatgggggtgctacctggaaatttctgggccgattctggtccacaagaaaagcagatgtttttgacagtgacatcacaattggtcactcggttaacaacacggtggccaggaattctaggcagtatactggatctagatagggagacccccgaacaaaacacccagcacaaaggtgcaagtgtacacccaggtattacagagcgccggacaacaataaccagaaaacgggaaccgttcccagcaccagcacgggcccagctgccaggggagcacgcagcgggttaacatgagactgactccacgcctgaaaaagaatgagaacaaacgaagctacaaaaacacttgaaacaccgggcaccagatgccggaagacagaagagcgaccggacacagtagagagcacaaacaaacagagaggaaaacacggaagacacactaaaacaccacaagcgaccagag

SEQ ID NO: 630249 - DNA, 327 bp, Homo sapiens
actttacttgttggcatgccagagtctgcgtccgttatcagtgttgcccgggactaatcgctccaccaactcgggaacggccatccacgaccgcccacggaatcgataaagagctatcattctctcactcctattccgtgtccgggccgtggttaggttcccgtgttgggtgcaactaagccgcaggctccatccccattgtggatgccctaccgtcgacttcctttcatgtttcatggggatacctgcagtctcgaatccgatcttcatggctcttgacctttgcctgtgtgcaaagatcctacaacttctgaattggaaaaccct

SEQ ID NO: 630250 - DNA, 895 bp, Homo sapiens
  misc_feature (173)..(173): n is a, c, g, or t
gtaggagttcaagaccagcctcagcaacagcaggagccccaccccccgtctctacaaaaaaatttaaaaattaactgggcatggtggctgaggtggaagaatggaagaatcacttgagcccaggagtttgaggctgcagtgagctatgatgcaccactgtactcctgccttanaaaaaaaaaaaaattcccaatagtccatgaaggcttggatctctggggaagtccttcatagatgcggtcacaatttcttaaagcaaccttttaatttgcaggataataccccccaatttttttagagacaggccgggctcttaaaaaaaaatttctttggggagtgaagacgctgggtgtcactggccacctctggttttatccctgaatttaacgggataccatacagggagggactggggcctttctggacatcatcctgaaagagaccagggacttcggcgttttccctctggggaccctacaggcgatgagaattacatggataatctcctccatataaatcctctaaaggggggatttgaaatcaaaaccagtgaatcccataactcctagagaaacgagagattccttcaaagccttgtgaaggccatgtgttcacaacgaaagctggttggaaatccgtgtcctgaaggagcacttccaggcattagtaacacggtcccccgggattacaagccgaagtgggactctcctgcacacttataaagtgcagagtcctaaaacgcaaacacattttaatatcctgacaatgggtgcatggggtgataatcccaagagggttcccctatctgaagcccagcttgttcacgtacttacaacatagtgcgcaaggctttgacacatagccggattcggaggcggtcaagctaaaagggaga

SEQ ID NO: 630251 - DNA, 106 bp, Homo sapiens
cgattctactatctactcactgaaggaagaggtggtttccgtggtgctgctgtgagccacagctgctccctcctcccccaggtgcctggcctcttacaatggattg

SEQ ID NO: 630252 - DNA, 732 bp, Homo sapiens
caaccttctagcctgcgatctgcggagaagaacaattacaattgatgttcttgcaccatacataccttgaggcgagcaagaaaattaaagttttaagccatgagggaaatcgtgcacatccaggctggtcagtgtggtcaaccagatcggtgccaagttctgggaggtgatcagtgatgaacatggcagtcgactccccggaccggtcacctacgcacggtgggacatgcggaccggagtccgacgtcgtggagccgcatctctgatgtactacagatgaatgccaacaggtgcgcaagagtactgtgtcctcgatgccactccatggtggaatcataagaatactgtggaccataggcactctgttcgctcaggtcactttttggccagatctttagaaccagagaactctggtatttggtcagtctgggcgcaggtaaacaatgtgggccaagaggccagtagcacagagggcgccgacctggttgattctgtcctggtatgtggtacaggaaggaggcgagacaagcctgtgtacgtgccctgctagggcattccagcttgacctctagtctactgggggggtagctacaggctcgtggcaatgggcactctccttatgagctagatccagataagaataccctgatcgcgctcatgaataccttctgtgtggtggcttcaccctaacagtgtgtgacaccgggtctgagccctacaaatgctaccctt

SEQ ID NO: 630253 - DNA, 3883 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggcgtgcccctgtgctgtgccaccctgcagtggctccttgctgagaatgctgctgtggacgtcgtgagggcccgagcactatcttccatccagggagtggcccctgatggcgccaacgttcacctcatcgtccgagaggtggccatgaccgacctgtgcccagcagggcccatccaggccgtggagattcaagtggaaagctcctctctggccgacatttgcagggcgcaccatgccgttgtcgggcgcatgcagacgatggtgacagagcaggccgcccagggctccagcgctcctgatctccgtgtgcagtacctccgccagatccacgccaaccacgagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaaaaaaaaaaaaaaaaaaaaaaaaaaaaaaaaaaaaaaaaaaaaaaaaaaaaaaagaaaaaaccgcgcggggcgagacattcatagggcgcgggcgggaaaaagagagggagaagaacaaatagaccaaaacactcaactcaatcccacaagacgaaaccacccaattagctcttcaacaaaccattacaaacatacacacgcacacacaccacataaaataaaaaaataaaataaatactaaaaacacacaaa

SEQ ID NO: 630254 - DNA, 1324 bp, Homo sapiens
ccacctgccacttcccaagtagggtcctgcgagtggtgggtcccccagaggtacccagtgacatccccagggccaggtgtggggcctgagctgtgtctgcttcacctgcagacactgctgcgggaggtgcagaccctgcgcgaccggctctgcacggaggatgaggccagctcctgtgccaccgcccagaggctgctacaggtgtaccggcagctgcgccaccccagcctcatcctgctgtgaccaggcgggcctgcccctgggctctggccacgcttccagcctctgtcacagcccccccaggcctcatgggttagagggaaaccgagctggcctggccagagccgtcagggaaggtaggacctggccacgtaggagcagaacgctcatgaaagtgcttggaggccgtggagcacaaagcagattctgattgggagcaaccgaggcgggctctgaacctggccggtccagcttcgcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 630255 - DNA, 3148 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcgtcctctgctggtgtctctccttctctgaccgcggccgcagcccctgcactcgccttcctcactgctgggcagccttcccaccaccgcagcagcccctgaggccaggaggcagtgcagggcattctggacccggagggccagagaaacaggatttctggggtttggacttggggtgagtttgtaactgttgctgccacaccaccaggagcaccggctgcccctctgggtggcactaccaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaaaaaaaaaaaaaaaaaaaaaaaaaaaaaaaaaaaaaaaaaaaaaaaaaaaaaaagaaaaaaccgcgcggggcgagacattcatagggcgcgggcgggaaaaagagagggagaagaacaaatagaccaaaacactcaactcaatcccacaagacgaaaccacccaattagctcttcaacaaaccattacaaacatacacacgcacacacaccacataaaataaaaaaataaaataaatactaaaaacacacaaa

SEQ ID NO: 630256 - DNA, 323 bp, Homo sapiens
aacttcagcgagagggaagcatcgagactctgagtaacagctcaggctccaccagtggcagcatcccaagaaacttcgatggctaccgatctccgctccctaccaacgagagccagccgctcagcctcttccccactggcttcccataggcaccagccacctgcttctgactggctggcccactcaccctctagaggggccagggcactctcttcctcctggctgagcctctggtgcatttgctgaattttgccagcacctcggaagacttaccacatgccatgaccctttctgaacactacagagtttagctcattgaatcg

SEQ ID NO: 630257 - DNA, 2964 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggtgccccacggtacccttgtcacactgttcacacctgcccggctgcccactctgggaccccgaggtaggagggtgctccctgagaccaaagcacaaaacagcatgcagggagctcctgcaagtgcccgtggtctcgtgccacaccaaggaagggccagcgggtggcctgtggccggaatgctcaacaactaggtgcctccggccggggcagtacccagcactgtgcactattttcagggccactcagggtggcgctgtggccgggggggggccctgagccccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaaaaaaaaaaaaaaaaaaaaaaaaaaaaaaaaaaaaaaaaaaaaaaaaaaaaaaagaaaaaaccgcgcggggcgagacattcatagggcgcgggcgggaaaaagagagggagaagaacaaatagaccaaaacactcaactcaatcccacaagacgaaaccacccaattagctcttcaacaaaccattacaaacatacacacgcacacacaccacataaaataaaaaaataaaataaatactaaaaacacacaaa

SEQ ID NO: 630258 - DNA, 2377 bp, Homo sapiens
cagctggtacggctctggatttttggataggcggagccgccgccgcgcggccggggcttctcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggttggtggcactgcttggctttgctcagccttggggattttttttttttttttaagagacaggaacttgctctgttgcccaggctggagtgcagtggtgcaatcatggctcactgcagc

SEQ ID NO: 630259 - DNA, 472 bp, Homo sapiens
gcctacacgctggcactatggtcatggcggaggggacggcactgctgatgcggaacaggccgggcaccaacgcgcacgattcctataattggcctgatgaatccttagatgaaatggacagcacactagctgttcaacagtatatccaacagaacataggagcacattgctccaatattgacaaaatgcttgaaccacctgaaggccaagatgaacgtgtgcggaagcatgaacatttaaggcaggtctgccttgagctaaatggacttgctgtcaaacttgagagtgaatgccatccagatacttgcactcatatgacagcgactgaacaatggatttttctttgtgcagctcatacaactccaaaagagtgtcctgctatagactatactatacacacacttgatggtgctgcatgtcttctgaatagcaatagatattttctcagcatgggtatgataaaggaatcatc

SEQ ID NO: 630260 - DNA, 222 bp, Homo sapiens
attggatagcggataaggggggcgatacatgaggtcaggagatcgagaccatcctggctagcacatactgcctcttctaaaaatacaaaaaattagctagggtgtggtggcgcaccccgtgcagtccccagctaatttgggaggcttgaggcagggagaatggttgttgaacccccgtgagacggagttttgcagtgagcctgagatcgcaccacgtgcact

SEQ ID NO: 630261 - DNA, 1739 bp, Homo sapiens
  misc_feature (1404)..(1404): n is a, c, g, or t
  misc_feature (1430)..(1430): n is a, c, g, or t
gttcgcaccttagttgttgttgctgtcgtatcatcactgtatgttagttattacatatatagtgtgtgttagttcactactaggtagtgagctagcttcttccgtcgtagtgtcttgtttgatttggtagtatgaatagtattagtgtcttcttcccgttatataagtcggcggtcgtatggtatattactcggtggtgtctagttgttatctccccaacatttatttgttgtttatattcatcatctcgactgttttttttttatctcctctcgtgtgttgacacccaacaactacagcggatgttgttttaataatggagaaggggtgttttttagatactgtttagatagggtgttgtctgctggctgcaatagaatgtgtttgtatgcctgccgccccgctcgtgtgttttactctacgcataaagaatgttatattcgcctgtctttgtgtgaggcttgtctcccctcccgtttgtatgtttgaggggctcctccctcgctgctggtgctgctccgatcagagggagaaacaaaagagattgtttgtttgaacgggcgcccgctccggtgggtgtatcgatacttaatttaccttgcgggtcctatcaatgggtggtggcgcattactatgatgacataacctttggtgtgtgtcgctttataaaatttaatgggggggcaccccctctttattagtttgattggtgggcctcttccacaacgaagagggggtttatacaggcgtgtggttgttttttaatacctttttttatacacccaccgtgtggtattatgtttactcgtctcgtgctccctcgtgtagaatagagagcccgggggggcacatagattcacctctgctctcatagttgcgatggagtatagaccaccctctcatttgggaagcttttttttaatatttgtttattattagatcgcttcactcaccagcttgtatacttcttattaacatctaaatctcccacacgcgggtgttctctttaataatgtttttcccctaacacgctggcgcctcttttttataaataaaattggtttggcgttgttggtggggggggggcagcacatctcttgcggggagcatcaacgagagacgctcacaacacacgtctcgcgggggcgcacgcgtatatcacatgttcttatataagatgtgtttacacacacacttgtccataaggcggagtacatatatagataatatatatatcacatatgtgagtagttccacacatatatatctgtgtgcaccactttctgcgtgagcacacacatgtgtatccctctcagtggggtgatatacacacaggcgccacactttctatatgttgtatagagaggtccacatatatacgcacacacacatataggggtgttnttccacgacctctcagatagatgttnggagatacagcgagagacatctctccccgagcgggtgcgcacacccgcctatattataaagtggtttggtttgttgttacacacggattataaagtctctatacgggagtattgaggtgtctaagaccgcggggtaataccccgggcgggttgtttattttatcttctcaaattcgtcccctgtatcgaaaagagaacaaaaagaaaaaaagggctatattttccaaaagggcacttcccccggaaaagaaaaaatttccacttgggggaaaaccccccccccccccaaaaacaggggtttctccaaca

SEQ ID NO: 630262 - DNA, 1037 bp, Homo sapiens
  misc_feature (3)..(3): n is a, c, g, or t
  misc_feature (70)..(70): n is a, c, g, or t
gtngggtcccgagagcgaggggcctgtcactccgggtccctgtggtttagggctgtttctgtagcgcctncgacccccctggtcttcactgtgaaggctgcaagggagaaaagaggcccactaggaacattctggggagccaagggtggggtaatgcaccacccggcccctgcgtggcccagatgtgggtggtgcgcttctcatacctggcagattagcctaggtccccggagcaccagcttcatcctctgtcctctttcctcctgtggcccaagaggagaggtcaggtcagatggctggaggcagcttccagcagaggctcggtgtgggtggggccgggagaaacatgcccctggggcggtggctcactctctggtggtggttccacacccaccgtgtgctggtcgtggagccaggctcggtgcctaccaggcctgagtcaagatgtggcacctggtgctgtgggtgtccccccgctcccgggggtcatgtctgtccttcgcagagtgtcttttctaaagaaggcggttgaccagcggaacaaggcactgacaagcctcaacgaggccatgaacgtgagctgtgcactgctgtcaagcggcacgggccccagacccatctcctgcaccaccagcaccacctggagccgcctgcagacacaggatgtgctcatggccacctgcgtgctagagaacagcagcagcttcagcccagcccccagcctcctccctcagcctgggctacggcccacctcctggtgctggtgttttcatctggggagggtgctcgcgccgctcccgctgcaggcactgtccgcgatgagtgcgggtaggagccgtgaggtgcttctctgctgtgacaaacgaccctgtctgtccgtgaaccttcaggcctcggctgttttctctcgccccttcccaccctctctcactgggctccttccagagcctggcgctgcttgggagccctcaccaccggggtggcctccgaggaagacgcgtccctgtgacccagttacccctgaggaggctctgctc

SEQ ID NO: 630263 - DNA, 422 bp, Homo sapiens
  misc_feature (115)..(115): n is a, c, g, or t
  misc_feature (140)..(140): n is a, c, g, or t
  misc_feature (152)..(152): n is a, c, g, or t
  misc_feature (157)..(157): n is a, c, g, or t
  misc_feature (166)..(166): n is a, c, g, or t
  misc_feature (245)..(245): n is a, c, g, or t
  misc_feature (347)..(347): n is a, c, g, or t
  misc_feature (411)..(411): n is a, c, g, or t
ggcggcgacaccatgcgatcagcggcatggggcaggttatggtagtgcggactgcggtgtgagcagacgacacacggggccgccaatgcgccggcggccatgacatgggcgccangggtccaaagctcggggccatgtcntatcagcctcgnggccnggacggcgngcatcaagaggcagcaggagctgagcaagctttggtgcggcctcgggcaagcatgtgcccccttcgtattcacgcgccngcattaggcttctgctatttcagtctttgacactgggccagcagcatcttctggagtgagaccaacatgcccaggccaccacccttgcccactctagaagtncctgggtgaaggcaaagtcctgatattagaatggctgcccttgcttgaacaaatcaaggatgangactggccttg

SEQ ID NO: 630264 - DNA, 863 bp, Homo sapiens
ggaggacgcggacccgccatggcgcgaagaaggtgcgtccgcggtgatcgcgagtggcccgccggtgcgcgccctgggaagcactgaacaggccggcgatccagtctacgcgtgtgactacgagaccttgacgcggccgttctctgaacgcccggctgccggtccgggtctggcccgagtccgccggaaaaagccgctctttgcaggttgcttcggggcacgcctcccgactcttgcggcctgggcccgcttgttcaaccggcgacaaattccttgttggtggacagcacgaaaagcagccgttgcataagtgggcgccttccacccgcggggtgccggcgccccagaattaacggggggcggcaagaacttttttggacgccaacggggacggcctgggggcatcccttgacctttcccaagggacaagactttgaagagccggaaggcgcggggaaatcgaacacctttcgttgtacccaggactggggcggttggtccccaaggacacggagggagagaggccttacaccggtgttccagcccggccgcgaaaagaacaggctggcttccgaggcggtacacggcttcttcctacggcgacatgttttttgccaagaaacaacgagacaggagaacaaacaaattgtgttgccgcgctcggtgcccgaagagaatttttaacaccatgtgggggggggcgggccccaagtgaaaggaaccggccacgacgggtccgaggacacgtgtacgagaggggttgttttccccaaaaaacgcggcaagggggtggacatccagggtcggcacccgggccacggacggtctaccccagcggtggaccaaggaattaagggagagaa

SEQ ID NO: 630265 - DNA, 199 bp, Homo sapiens
ttcagcacgaagggacagtggctcctaatgacgattcttgatcacacgatgctgaccacttatacagtgcaaaggtaatgctgatggctagccctagtatggaagatttatatcataagtcatgtgctcttgctgaaggggccacaatgaactgcgaaaatggattccaacatgcctgctagacttgtaacagtattta

SEQ ID NO: 630266 - DNA, 544 bp, Homo sapiens
agttctatacaaatcgatcaaggggaaaaaacacagatacctcaatggaaatgactgagagatacacttctcagcagctgcagcagaggtcagaagaagaatgaagtaatatcttcaacaaactgtggaaaaataactgtctagcaagttggtatgctgccaaaccatcatttgagaactgaaagagacgtattctttagatatatagaggctaggaaaattagaccacctattaaagatctctgtaaaaagctcttacaagatgcagtgcatcacgaagaaaagtggaagcagatggaacccatggtctataagaaaccaagttatggtgagaatcactaaaatgttacctactagtattggcaaagtaatgtctgagggtttaaaaagtgtcaaaactcaaactctaagaaataataagataggtaaggacatgtttagatggtaaggcatgctaccaactttgcatatattcagctggtgcaagagtactttgatttttaccaccttacttacacaaaccccgattacttttgcatcaact

SEQ ID NO: 630267 - DNA, 245 bp, Homo sapiens
  misc_feature (33)..(33): n is a, c, g, or t
  misc_feature (46)..(47): n is a, c, g, or t
  misc_feature (56)..(56): n is a, c, g, or t
  misc_feature (78)..(78): n is a, c, g, or t
  misc_feature (84)..(84): n is a, c, g, or t
  misc_feature (105)..(106): n is a, c, g, or t
  misc_feature (113)..(114): n is a, c, g, or t
  misc_feature (162)..(162): n is a, c, g, or t
  misc_feature (169)..(169): n is a, c, g, or t
  misc_feature (171)..(171): n is a, c, g, or t
  misc_feature (214)..(214): n is a, c, g, or t
  misc_feature (244)..(244): n is a, c, g, or t
ggatcaagtttaaatgactgtgctggccctttnaaaataaaggacnnattgcaaangagggccgcgcctgcctttccnatctgntatctatctggctggcagggnnggaaagnncttgcatgttggtgaaggaagaagtggggtggaagaagtggggtgggnacgacantnaaatctagagtaaaaccaagctggcccaaggtgtcctgcaggntgtaatgcagtttaatcagagtgccattcnt

SEQ ID NO: 630268 - DNA, 154 bp, Homo sapiens
ctgctagaaaggaggggctgctcagaagcctctttccatacgagttttggttttgttttttaatatttttttctattaaaattactcatgcatttaccttcccgttattcaaccagtctctggttgcatccctgcacttctactacaagtgaga

SEQ ID NO: 630269 - DNA, 273 bp, Homo sapiens
tgatctcagtggtgaacggaattagggttatccatacccagcgcacatgccatgcggcttacatgcaggtttcctcagctggtgcctgctggccctaggcgggaggaggcaaagctgtggctcccaggcaagcatagcaaaaagagttcgcccatggatcgaaacacgtgacgagtatcggctatgccgatagaggaacaacatggtctgtgaaaaagagccggttgaaaagcaagctgaaagcacaagacacactgcagagagtcaatcagg

SEQ ID NO: 630270 - DNA, 673 bp, Homo sapiens
  misc_feature (579)..(579): n is a, c, g, or t
gtgtcgtccgggagccgcgaccgcatggatcgctgcagagtggacatcccgcaccgcactgcatcggagcggcgtgaggcacggcaggagtgtgcgggtcaagtggtccaagacacagctctcgctcgggggcaagacaacaagctgctggttggaagtcatcgagcctgaccccgtgcacatacacggagcactggcggcgaaggccatcgctggtccccacatagcacgggctgctggcctcgggggcggacagtgacgtgtatcgttctggaacacgctgacaggacaacatgagtgtatcgacagggctcccaatgtaatctggctggtccaagcacgccaagactggtgagcacgcacggtatcaaaacaatccttgttgaatacctcctgaccagtggcagtgacgggcatcctacggtgctgtacgcaatgtcccctgatggggaggcatcgtcactggtgctgagagaacctgagtctgacgtttacaaaccgtgaaaagatctggttggtcaactttacagatcggtaaactgcagcaggacgtgcacacatgtcagaatcgagacccantcctagttgatggattgcttccaaggttgtcccgaagaaggggtgggcggggggagctggctgaaggactggattcattaatgctgattgtgac

SEQ ID NO: 630271 - DNA, 263 bp, Homo sapiens
  misc_feature (259)..(259): n is a, c, g, or t
gtactgtatcctgggggacagggcagaggtggtcagatcgttgtgagccaaaatcccttgcctaaaaagtggatctgtggagctccatgaggggaacctcagagatgcagaatgacagtttagctaaaagggcttaaagaatgtgaatggattgtcagctctctccatatctgctgaaaaaaggttcaaaatttgtgaaaaagttcacaaagtgtttgtctaaagaagagggacaagcaggtctggacccgtgaagatngctt

SEQ ID NO: 630272 - DNA, 629 bp, Homo sapiens
cagtcagaacatatgcaacacttattaaattctctatcttatatgggtacagttcatgctcccccaaaataattacaatggtaacatcaaagattatcaatcacactgttgcgggaagtcagggaccccaaacggagggactggctggagccccagcagaggaacataaattgtgatgacttcattttaatatggacatatatcagttcccaaaattaatacttttataattttttacgcctgtctttacttcactctctgaacataaattgtgaagatttcattttaatatggacatttatcagttcccaaaattaatacttttataatttattatgcctatctttaatctcttaatcctgttatctttgtaagcaggaccactattgtgttaaactgtacaaattgattgtaaaacgtgtgtttgaacagtatgaaatcagtgcaccttgaaaaagaacagaataacaatgattttcagggaacgagggaagacaatcataaggtctgactgcctgtggcgtcgggcagaatagagccatatttttcttcttgcagagagcctataaacagatgtgcaagtagggaaagatatcgctgaattcttttcctagcaaggaatattaata

SEQ ID NO: 630273 - DNA, 158 bp, Homo sapiens
tcggaccgcgagttgtcagcagtaagcggctttgctgttatacttcctcgttctgccagattccagttcgttcaaagtctatgtgctctcgcagcatgggccaggtacgagaggttgaactggcagacgaggaagtatagacaccaaacccgcctgat

SEQ ID NO: 630274 - DNA, 1170 bp, Homo sapiens
ggaggctgcgagatccctaccgcagtagccgcctctgccgccgacggagcttcccgaacgctcattcagccgcccacggagccgcatccacggagccccggccgtagaggctgcaatcgcagccgggagcccgagaaccaggccaccgagcccgacgcacgcactatccgagggcagccccaggcacagagccaagtggtagaaggtgacgtttcaacatccgatctgggacccagaaaggagggccaacgaaggagcgagcccaaagagcggacgacggaggcgcatcatcatccgcacccgcagaaggccgatacgcggttggacctgcaagggacccagatgactgtaggtaaccaagtgggccaaagagaaacgagaccatggtgatatgggtagacagtgttgcattatgggacatagacaattaatgcatagaaggtgataaaattcataggaggagcattacttggtaacaaaatattatgagcacattcaacccagatgaaagtgtacatactgtggaataaaagatacatcaaagatgaattgtccactcctttcaaagttgaaggccctcttggcaagactggcccacaagggtgatcatctagcaggacaactgggatagaacacttctttacaacatcttttgacaggaacgaaaggacagtggcacttccatctaggtggtgacatggcccccagcagttaggccgcatagatgatccgggaccacacagttggttacaatgacctgttaaagcaggacaagctttaacaggcgtatttaagactctaaaccctggaatcagtatgtatgtgatacccatctggacgaaattcgcaatgtatatggcgcacccaaaacaacatactgggagtttacgtattacactgcacggggtggaaaaccctatatagcacttagatcctatgtgactacatgaaaaacccagcgaagaaaaccgcgacacgacaatggcagaccattgaaccaccacgaagtccaagacaagatcgaacagggcatcagaaaaaggaacaattaaaaaggacagacaagaaacacaaaagggccgcgcaaaacagaaagcaagcacaggacaacaaccgagcgcgacagcaaatgccggacaaaaaaaggaagaacaccacacaaccaaagag

SEQ ID NO: 630275 - DNA, 401 bp, Homo sapiens
ctttcactgtttggcggcggcaggagaggttgcggcgctaggtgctctaagccatccagcgccatcctcgtcgttgcagcgacacacgctcttcgcggcgccatgactgagcagcatgacccttcgtggcaccctcaagggccacaacggctgcgtaatccagatcgctactagcctgcagttctcggccatgaccctctgcgcctctcgagatcagaccaccaccatgtgccgcctcccacccctgcgcccctccgcgcctccacagcgcgctcccgcgcccccactcccactctgtaggtgccgcggcacgaccccccctctccggccccctcccccgcccccccccctcgcccccggccccgccccccccccccgcccgcccccccccccctctcccc

SEQ ID NO: 630276 - DNA, 572 bp, Homo sapiens
  misc_feature (19)..(19): n is a, c, g, or t
  misc_feature (491)..(491): n is a, c, g, or t
gtttccaaacttctggganacaggcgtgacgcaccgaacccagcacattttatctctctaaagtcgggtcccagtattaaacctattctttagtaacctcatatatactgttctaaatcgacagaaattatttattactctgtactcctagactcaaaattctttatcaaagatcgtctcaaagaggtagtacaagtcctgtataactgcactttttcacattcacagtgcttcctcgtgatatctttccttacatcattatacagggttgatatccattttactcttctttctcttctaacatttcttaaattggggtactgtccctgtaacatgtgtatcagcggggccccttttctttgaactttgtctaattagccgtgtacatttgggttctcttttaaggtagaaccagatctttttgggtttctcctttaaagtctactggtttcacaagaggtaaatgtatccatagaccacagtgccgttgnttttaccctctgccagcacaatgcagcacgggattagatgcacaaacctatttagggaaccatggcgaaacgggggatcct

SEQ ID NO: 630277 - DNA, 375 bp, Homo sapiens
aaaaaaaaaaacccaaaaaagcccccataactttcagggcccctattgctttaaaagcataaaataacttgctgcccgaacccgatgggtttaaaaaagaaaataaaacccccttctttttatagcccttaaagccaactttctgggtctaaccaatttggattttttttttgccttgccccccctctggttatttaaaaaccacacccccttgggagtaatgtttcagggcaaggaggtattaccgcttgatgtttgggggttttaattttaaaagttttttattcccgatcaaaaaaaggagttaaaaccactggaacagcctttttttaaaaaccttgttaaaaaataaaagggcccctaatttaaatcgga

SEQ ID NO: 630278 - DNA, 534 bp, Homo sapiens
  misc_feature (72)..(73): n is a, c, g, or t
  misc_feature (87)..(87): n is a, c, g, or t
  misc_feature (94)..(94): n is a, c, g, or t
  misc_feature (96)..(96): n is a, c, g, or t
  misc_feature (101)..(101): n is a, c, g, or t
  misc_feature (107)..(107): n is a, c, g, or t
  misc_feature (114)..(114): n is a, c, g, or t
  misc_feature (122)..(122): n is a, c, g, or t
  misc_feature (158)..(158): n is a, c, g, or t
  misc_feature (163)..(164): n is a, c, g, or t
  misc_feature (200)..(200): n is a, c, g, or t
  misc_feature (208)..(208): n is a, c, g, or t
  misc_feature (225)..(226): n is a, c, g, or t
  misc_feature (246)..(247): n is a, c, g, or t
  misc_feature (264)..(264): n is a, c, g, or t
  misc_feature (285)..(285): n is a, c, g, or t
  misc_feature (297)..(297): n is a, c, g, or t
  misc_feature (326)..(326): n is a, c, g, or t
  misc_feature (354)..(354): n is a, c, g, or t
  misc_feature (364)..(364): n is a, c, g, or t
  misc_feature (371)..(371): n is a, c, g, or t
  misc_feature (404)..(404): n is a, c, g, or t
  misc_feature (409)..(409): n is a, c, g, or t
  misc_feature (419)..(419): n is a, c, g, or t
  misc_feature (425)..(425): n is a, c, g, or t
  misc_feature (433)..(433): n is a, c, g, or t
  misc_feature (442)..(442): n is a, c, g, or t
  misc_feature (472)..(472): n is a, c, g, or t
  misc_feature (507)..(507): n is a, c, g, or t
cttccccgggccccgatggtttataccaattttgcgggttcttttaaaagcccgagagtccaagagcccctnnggccccccccaganagatccntncccgngtcctnaaaaagnaccccctngaaaaccttgggatcctttttaggttaacccctttnccaannccctgggccgggaccccctttttttcccggcccggnattcccanccccgggggggttaggnnggtttttcccccccggcccnnccaacccaatccaattngaagggggcgggttccggccnaaaacccttggntggttaaaaaagaaaaaaggccccttttngggttttaaaacccaaaaaaccctttgnggggaaaaanggcgccncttcccaaaaacccgcccctttaaaaaagcccnccaanaaaaaacccncttccngggggganaagcccccngccttaacttttttattttttttttccccnaagggccaatccttttgggccgctttttttttatnaaaaccctttttttccggccgggggga

SEQ ID NO: 630279 - DNA, 597 bp, Homo sapiens
  misc_feature (228)..(228): n is a, c, g, or t
agcggggaataatcacttatgtgaccctttcgataggcactgggtgcatgtccagtgttctgctggcatcaaaggagggacatgaataccctgtatagtaccctcgtctcacacacaataacaactgtttccctgtcttcttatttaaaatcaactcttagatggcgcgtctcaagtatattactacttcatatgtattgtaactcctaacctttaaaccgttgggancagatatattttggaattcagaaactttcagattttggaaagataacatggtacatatgctatgcattaccaaatcctcatcgtaaataaaatctgagaatatttctacaataacatagatttgtgtgtgtgaacagttgtactaatggagactatattttattttattttagtttttgagacggagtcactctgtcacccgggctggagtgcagtggtacaatctcggctcactgcaacctccgcctcctgggttcaagcaattctcctgtctcagcctcttgtgtagctgggactacgggcacatgccaccatgcctggataattttttatattagtagagacaggcttcaccatattggcaggctg

SEQ ID NO: 630280 - DNA, 703 bp, Homo sapiens
gtggtatcatcacccgatgaggcaaccagccagaacgcctgaagcaggcacatacttcctattctacaccctagtaggctcccttcccctatcatcgcataatttacacttcaaaaaccctaggtcatagaattctatatcatctcatggccaagaactatcaaaactcctgaggccaacaaattaaatatgactagcttaaaccaaatagctttatagtaaaagataacctctttaacggaattccactttaatgactccctaaagcccaatgtcgaagcccccatcgctgggtcaatagtacttgccgcggttactcttgaaactaggcggctatggtattaatacgcctcaaactcaattctcaacccctgaaaaaaacatagctaaccccttttcttgtattatccctatgaggcattattaataacaatgctccattgcgtagaaaaaagactaaaagtcgtcattgatatcttaataggcaatagccctcttgttacgcatctcatccaaacccgtgaagcttaccgggcaggattttataatgcccagagtaagtctcataaatttgctagaacaagagagcgccagggtaaactctcaggtaactacaatatagtttgggttaagcgtatcttaccaaaaatggattggagcgcagatcggatggcctttaagcgcgacctcccccgcaatatta

SEQ ID NO: 630281 - DNA, 504 bp, Homo sapiens
aactacgcacagatagagtagctgctgtagcagccccgctgcgctctcacgggcatacaaactagtgatgctcggtgctggatggtgtagggaagagtgccatgaccatgcaggtgcatcagccaacgatatcccagaagatcatgatcccaccatagaagatgcttataagatcaggatccgtattgatgatgagcctgccaatctgaacattaaggatacagctggacaggcagaagtttacagccatgcagaaccagtatatgagaggcaggcagaaagggtatatcatctgttactctatcacggatcgtcgaagtaaccatgaagtacgtgagttcacaacagcttattaatcgagtccgacgtactgacgatacagctgtggttcgagtgagaaacaagtcagacctcaaacagataagacaggtcaccaaggacgaaggattggccttggcccgagaatacagctgtccctttttagagacatctgatgcataccgc

SEQ ID NO: 630282 - DNA, 317 bp, Homo sapiens
ggagaaaccattgctacaggagtgatctttactgaatgggacctttataagagagccagtgaatttctagagcaagtcccaaaactaagggacagctataagtttaatggttgacttcaaaggcctacactgtgttattgtgatgtccactaaacaacttgattaaaagacggaattgtgactcgtgtctgtatcatacaagtacaaatactaattttgcccatatgtatccgtcaatgtcatttgtgattttgacttatttatttaatgccctttcttatgccgtgggtatacaagtttactcatcctatggttgt

SEQ ID NO: 630283 - DNA, 220 bp, Homo sapiens
aaataactgttcttcttagcatgatgtagtgcttagcatgtctctatggggccaactttgaaccattattaagaactggtttgtcttgttttgctataactgatattaaaaatggtttggtggggcatggtggctcaccactcttacagaggcaagaggcaggaggatagcttgagccccggatttcgagacctgcccaggcaatataacaccatttgcc

SEQ ID NO: 630284 - DNA, 1243 bp, Homo sapiens
  misc_feature (158)..(158): n is a, c, g, or t
gcccgtcccttcctcccgaagacgccgggaggagtcgtggtgttcagccctcagctctcctggggactcgagccgtggatccccctgatggtttttcgttgcctaagattatgtgacgtcacaaagtgcctcccttccactgcactggctgacttcangcgtgtggttgctgtgtgagggtgggctgtgagatttatgggaaggagggcatgtgatcgtaaaacgagtatccccttgtcaccctagacgggcgcattcagtgctgatgtcagttccgtcgatttcatatcccattatcctaggaacagatcatgaaccctcatgatcacgggggtatagcgacgtcagtggtgttgtggcccatggtcattggagggcgcacacgagagtatgattgccaaacgccagtccggggaatgcactgatcttatgctcatgtgtgtatggcctgttctacaagaatggcatagcgaatcggttgctcgagtgaggacatgagaagatggggttactataccacgcaccagatactcaggctgtctccacacggacgcacacggcaaaacaacggcgtgatcgtagcaccataagacagccggagatgacagcgggcgagatgaggagggacgcccacaagaacctactaccgagacgatggcgctggtgggccacagggcacgagaaaggacgatgtgtgcaacaacttcctcgagaaagagtccacagcgtacccagcagaacccgaagcggatgggtggtgatagcatgtgcaaacaacacggtaggacggatcggagaaaccgaacaactagagagaacgaaggaggacacccatagacccccacagccccataacgcacagccgcaaaaaggggacagggacaggcaacaggagcacgagacgcgcaacatcatctcaggagcggtagcatgggccacatctatccccgcggaggcaagcggcccaaaagaggagacctcaagatcataaacatggttcccacgataggggagaacagtgtacgcaggcacaccgggcgcagatcacgcgaactccaggccgaacacccagaaatatgaggacaacaatagatacgtacgaccgaccgagagagaacacgcctcaagataccgaatggaacaagcacgcacagaatgcagaatcacgatcaccatcgaagacataggacaatatacgacggaaactataaacacgaatacgcagaaaagacacgggaaccga

SEQ ID NO: 630285 - DNA, 775 bp, Homo sapiens
agcggtgctggcattatagacacgaaccaccgcacccggcctatatggctttctataatataccatattctaggatacagttgctgttggaagacaaatgataccaacaaattaagagaagaaagggaaagagggcatgtaaactgatataatataaatatatgcaaccgagccgtttcggggaagaatggagaatgaatgcgctttgattaataataatcagcgattagatgtgaattagaaaacaaggacagagagaacgataagcaatataataaggaaaatgtcaaggaaattaaagtcatagcgaattgacaggaggcataaaaggttggatgacagaagaggaaatctagcatagccagtaatgcagacggagggagagtaaaaggggggactagatagacagggaggttgtgaaggcgtatttaaacaaaaatatattttatatatatataaggaacgtcgagtgaaaattcgcatctagacctatacataagctgagcctagcaaatccagcgtgatgtacatatatcaggaacgtctcagttaggaagtcaagggcagtgttagggggaccttattgaatgcacaagcagaatgaagaacatggaaaaaaaaccacacagcacttcgaaaacattaagaagagggacgctgaggtggagatggcggaggtggcttagttaggggtttcaggcatggggatcgaagtgggaatgtggtgggctgctcaggggcgtgtagggaatgactttctgtattattgtttggg

SEQ ID NO: 630286 - DNA, 948 bp, Homo sapiens
  misc_feature (68)..(68): n is a, c, g, or t
  misc_feature (73)..(73): n is a, c, g, or t
  misc_feature (91)..(91): n is a, c, g, or t
  misc_feature (119)..(119): n is a, c, g, or t
  misc_feature (126)..(126): n is a, c, g, or t
  misc_feature (128)..(128): n is a, c, g, or t
  misc_feature (137)..(137): n is a, c, g, or t
  misc_feature (152)..(152): n is a, c, g, or t
  misc_feature (198)..(198): n is a, c, g, or t
  misc_feature (202)..(202): n is a, c, g, or t
  misc_feature (221)..(221): n is a, c, g, or t
  misc_feature (224)..(224): n is a, c, g, or t
  misc_feature (264)..(264): n is a, c, g, or t
  misc_feature (309)..(309): n is a, c, g, or t
  misc_feature (317)..(317): n is a, c, g, or t
  misc_feature (323)..(323): n is a, c, g, or t
  misc_feature (332)..(332): n is a, c, g, or t
  misc_feature (342)..(342): n is a, c, g, or t
  misc_feature (353)..(353): n is a, c, g, or t
  misc_feature (356)..(356): n is a, c, g, or t
  misc_feature (378)..(378): n is a, c, g, or t
  misc_feature (384)..(384): n is a, c, g, or t
  misc_feature (441)..(441): n is a, c, g, or t
  misc_feature (456)..(456): n is a, c, g, or t
  misc_feature (468)..(468): n is a, c, g, or t
  misc_feature (476)..(476): n is a, c, g, or t
  misc_feature (482)..(482): n is a, c, g, or t
  misc_feature (491)..(492): n is a, c, g, or t
  misc_feature (512)..(512): n is a, c, g, or t
  misc_feature (525)..(525): n is a, c, g, or t
  misc_feature (550)..(550): n is a, c, g, or t
  misc_feature (557)..(557): n is a, c, g, or t
  misc_feature (567)..(567): n is a, c, g, or t
  misc_feature (570)..(570): n is a, c, g, or t
  misc_feature (575)..(575): n is a, c, g, or t
  misc_feature (578)..(578): n is a, c, g, or t
  misc_feature (586)..(586): n is a, c, g, or t
  misc_feature (620)..(620): n is a, c, g, or t
  misc_feature (623)..(623): n is a, c, g, or t
  misc_feature (627)..(627): n is a, c, g, or t
  misc_feature (634)..(634): n is a, c, g, or t
  misc_feature (660)..(660): n is a, c, g, or t
  misc_feature (672)..(672): n is a, c, g, or t
  misc_feature (683)..(683): n is a, c, g, or t
  misc_feature (687)..(687): n is a, c, g, or t
  misc_feature (696)..(696): n is a, c, g, or t
  misc_feature (698)..(698): n is a, c, g, or t
  misc_feature (734)..(734): n is a, c, g, or t
  misc_feature (753)..(753): n is a, c, g, or t
  misc_feature (789)..(789): n is a, c, g, or t
  misc_feature (816)..(816): n is a, c, g, or t
  misc_feature (858)..(858): n is a, c, g, or t
  misc_feature (873)..(873): n is a, c, g, or t
tcaccagaggtcctcacagttcagtttccctacagctcagtgtcaggccccagccacacagtccagcngtgcnccgattggcaggcgggtnagacctgcaggttgacaaaaggtgcganccgccanancctgcagcngccccagggcctggngcagcggcggctccacgtcgatgtccacgccgcgcttccgcaagcngctnaggctggactccgccacanggnggcagttccgcacccgcagcgaacgcagcacggggcagtnctcggccaatgtcctgacaccgtcgcttccgacgcggaggcagcnggtgaggncaaggnggtggagtnctgggcagtnccgagccaacnctngaaccgcggcgtcccccacgtnggcgtngacggccagagagaggctgcggagaccagcgccgcgcctttgcgccagggacacganggcctcgtccttganctggcggcaggnggtgaganccagcncctccaggnncgggcagcgatcagcgaggncgcgcagccagcncgttcacccagttacagttcgcgangatatgngctgcaggtntgncagcnctnggccaaanccccaagcgcccggcgactcagttgcccgcagcngcncaangccacantccgcagctgcggattccgcgccacnccggcaccaggncctcgtctganagcnatttgtgananggcgccagttccagctcctgcagcacctcggcatcncgcagcagctgggccaatncggcccgcgggaactgcggacccacctgcgcggcancgaagcgacgcagcccggccaggtgangctgcaccagcgaccggaaggcccggctaacgcgctgcagcnggagcagctggcgcnggggacccggttcaggacgtgtgggagccgccacgtcttcccagggcaggtccaggacctgaaggctccgggctc

SEQ ID NO: 630287 - DNA, 280 bp, Homo sapiens
  misc_feature (22)..(22): n is a, c, g, or t
  misc_feature (64)..(66): n is a, c, g, or t
  misc_feature (69)..(69): n is a, c, g, or t
  misc_feature (79)..(79): n is a, c, g, or t
  misc_feature (82)..(84): n is a, c, g, or t
  misc_feature (118)..(122): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (187)..(187): n is a, c, g, or t
  misc_feature (194)..(194): n is a, c, g, or t
  misc_feature (245)..(245): n is a, c, g, or t
  misc_feature (254)..(254): n is a, c, g, or t
gaaggttattaaattaaaaganagatcatttgtaacatactctttgtatatatttattatatgnnnggngcaatatttnatnnngtacagtatgtaataaagacatgggacatatatnnnnnttattaacaaaatttcatattaantngcntcactttgtatttaaagttaaaagttactatttttnatttgcnattgtactttcattgttgtcattcaattgacattcctgtgtactgtatttnactactgtntttataacatgagagttaatgtctct

SEQ ID NO: 630288 - DNA, 120 bp, Homo sapiens
ttgaatggaatgtctgtaagtgtctattaggtccattggtctagaggtagtttagatttgctatttcttcgttaattttctgtctgaatgattgttcttagctgtagtgaggttccatcg

SEQ ID NO: 630289 - DNA, 494 bp, Homo sapiens
ccctggcagaatcacactcaaatacatatactctatagtaattgctgaaatagcagcagctcgttagaatactgttatggtagttacagtatgtctctatctggatagagagagggtaccaagtaagaaaaaactcctatgtcagagataagtcctaccatttgcagatctgatacttgttgatgttgtaaattacaggcctataagatttgtctggcacaatgagaatgcacatgtggttagtggctcaatagggtaaatgcctgtagtgctctatgggtgaattcctgcgagtcataatcagcagtaaagtgaagagctgaagtgtcagacgcctcggagctagaacgacttctctaagcctagggaggaagacagattagagcttcggccagagggaaagtcacatggcactgagtagtagatcatcgtaagtctttattctggaaataaagtagtaacctagacctctgtgaatagcctagtgtgtacat

SEQ ID NO: 630290 - DNA, 663 bp, Homo sapiens
taaagtcaatacgatggaaatcaagtaaatctgaattccgaacatgtcgtgtggaatactcttaagtgtgtttgagagtagatctgccaattatgttgacaagggaatgatcaaaagcttgtttttttttttaaaaagaaaagcagtttcaatggaaatattttcatacatcttgggttgcaaacattgggactgcatggcaatgagtgggggtagtatttattttccctttctcggtataaaatggtatgcaaaaggggggttgggttagtaagccacatatttctgtccatggatctcagatcttaattctttccctttttcatctctctcgcttccatcaattggagatttcggtataaagaacccaaagagttgtcagtcctctcatttgggtaccatcatcaacgctgccatttccggggcatccctcaccgccgatgcatgcatgatagcctgtgaacgcacggggggagaggaagagctgcacagcatggggcaaggagctctcacactgtgctgtggagtccgcttgagcagcagagtatctcccagatgactccgtgataaatgtctggcctagggacccatatccaaggagtccatcgcgagcaggaagcacgtctgcccctcaacgagctggcaaaagccccggaacgatag

SEQ ID NO: 630291 - DNA, 136 bp, Homo sapiens
gctcaaggtgactttactacataccagattaaacctgtaatcactttatttctcttcgcttcctgtactggaagacttttctggcaattagtggatgggcctttttcttttatggcatctcaggggaccgatccat

SEQ ID NO: 630292 - DNA, 432 bp, Homo sapiens
ccgagcgacttgagatagtagagagtcccagataagtttaagtataaggcagaacactctcaaggtcgcgcagactggacaagaacatcaaagagggagcatccgtgggtcgactacactgcccctatccttaatcactctgctgtttacaggacctaggcgtgctgacaaccctcagcagtcagcgatgagctcatcaagctcctatctgtaacctgtgagccctttcctgccagagtgaagataacgtagttaaggcaggggtgagtaagctacttgaaaccccagtgagtcaggccaaaaactgagatgtgtttaatgaagatttatggagtaacggacttaacatccataacatcttggagaaccttatcttactcatttcagtcccatctaaaaattgtgtcagccctttttgaatccgaagtacga

SEQ ID NO: 630293 - DNA, 534 bp, Homo sapiens
tcagtcactgtgtgccggaaccctctctccttgatatttcatccagggggccttcgtggggcctttgtgagcccctcggcgttctgacacagtgctgagattaatgccataaactggtgacaaggagaagagaacagggcctggacttcactgcaaagggccctgtgccctagcgtgtgtgtctatgtgcagggagtgcatgcatatattacaagacactgccacacccccaccctgtgttacctgtccatctggcacacaggcacaagggctgagtgaccccacagcttcctctttagctgctgcccaggtgggaagaggcccgcgccagctgggaccctgagaaggatgtggctcttctggtctagcagggcagaacctcccctctatggagccctgcttgcagcagacggacagtggcctcgtgcagcagggacagcttggccttgcacaccacgcctgtgggagtgcacacttacgggcgcttgctgctcaagtgggaaattcaagctggagggtgacgcaggtggccgc

SEQ ID NO: 630294 - DNA, 874 bp, Homo sapiens
tgtttaggttggagggggaatgcgggagatggtaaggggttgggagacatgtcatataagtaaggtagggtgagtggtaggaagttttcataggaggtgtatgatgggtcgtacggaatcgggggtatgcggtcgaatcataagaacagggcggttaaccgtagggtctgggtgacacacctatgtggtgtcgcagttcaggggagagtgcgtcactatgtggccctaggaagatggcaggggtgagggtgtcatcacactacacgtgggtatccggctatgacgactcgggcgaaggggcctggaggtatcgatgtgaagcctgaactagttcggactccccttcggacaaggtcgaagggggtcacggaggggcctcggacaacgggcggagataaccctcatacttatggccaaggggtcctgagggcagagacgaaaaccagaggggacctaccgcaccgacaaccgggcgggcacaggaacacgagagccacacataccacaatgtcagcaaccccacaagctgcccccacgcgcacacaaaagagcaattgtagaaccacagacaaaacggagcgccgaatcaccggcgactacatagtaattcagacacaaccaccccggaccacaacatcgacccccacggccacgccaaaagcggcacacccacacaaggacgccaccctagacgataccaaagggacaccacgccccacgcgcccaacacaacacaaccacaaccacaacagcgctacagaaaagccaccaagcacaccccacaaccccaacccccccaccagcaaacacccaaccaacgacccatacacacaagtacccccaaccagccccacaccccaccccgacccaccga

SEQ ID NO: 630295 - DNA, 722 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (11)..(11): n is a, c, g, or t
  misc_feature (23)..(23): n is a, c, g, or t
  misc_feature (32)..(32): n is a, c, g, or t
  misc_feature (35)..(35): n is a, c, g, or t
  misc_feature (39)..(39): n is a, c, g, or t
  misc_feature (46)..(46): n is a, c, g, or t
  misc_feature (59)..(59): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (91)..(91): n is a, c, g, or t
  misc_feature (101)..(101): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (168)..(168): n is a, c, g, or t
  misc_feature (179)..(179): n is a, c, g, or t
  misc_feature (184)..(184): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (206)..(206): n is a, c, g, or t
  misc_feature (209)..(209): n is a, c, g, or t
  misc_feature (214)..(214): n is a, c, g, or t
  misc_feature (219)..(219): n is a, c, g, or t
  misc_feature (227)..(227): n is a, c, g, or t
  misc_feature (250)..(250): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (267)..(267): n is a, c, g, or t
  misc_feature (274)..(274): n is a, c, g, or t
  misc_feature (280)..(280): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (301)..(301): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (327)..(327): n is a, c, g, or t
  misc_feature (350)..(350): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (368)..(368): n is a, c, g, or t
  misc_feature (376)..(376): n is a, c, g, or t
  misc_feature (383)..(383): n is a, c, g, or t
  misc_feature (400)..(400): n is a, c, g, or t
  misc_feature (405)..(405): n is a, c, g, or t
  misc_feature (411)..(411): n is a, c, g, or t
  misc_feature (436)..(436): n is a, c, g, or t
  misc_feature (472)..(472): n is a, c, g, or t
  misc_feature (475)..(475): n is a, c, g, or t
  misc_feature (496)..(496): n is a, c, g, or t
  misc_feature (509)..(509): n is a, c, g, or t
  misc_feature (540)..(540): n is a, c, g, or t
  misc_feature (669)..(669): n is a, c, g, or t
taanangnaangttttcttttanttaaaaaancantcanaaaaaancaaaaccaaaaanttactttctgtcaaaaancngaangtgttaantgtttggaantccantcttananttaaaaatcaactggattgcccagcagtttaaaagcatgtgttttgttctttancttaaccacantgaanaagtaantngggcaacngaaancancgggnttgantacaccanaaaaagcatgtctttctgaagtnaantgttggngttananaaaaggntcttancncanaancagaaaagctganagggggaaggaaggagananantncngtggattgctgaggccttgtaanaaaananantaggaaaancccaggangacggcnggggaccaaaaacaaancacantccgcngggggccccaggccaccccggcccngccaacacctggcgagggcccctttcccaggccccngcngccggccgcccccaaactgcnccccaaaggacanactgggacttgggtactgaaggatttttcanctgttcacacgcaggcgttcaagctcaaaagcctaacccctagcactcccacataactgctgaaccctgcacatgggaacagtccagtgtgtccccaagatgtggccgcagacctagacagctgcagtnctctactgctatctgaaggttcctgacagctctgcatagtacaatttatcaaa

SEQ ID NO: 630296 - DNA, 570 bp, Homo sapiens
  misc_feature (383)..(383): n is a, c, g, or t
ccaaattagccgggtgcgaggacacacgggtggtttcatgctactcgagaagctgaaacaggaggagcacttgaggccggaaattcaaggctgcagtgagctacaatcgtgccactgtaccccagcctggctgacagagcaagatgccatctcaaaaaaaaaatgaaaacccgggcacggtggctcacgcctgtaatcctagcacttaggaaggccgaggcaggcggatcacaaggtcaggagatcaagaccatcctggctaacacggtgaaacccggtctctactaaaaatacaaagaattggccaggccttggtggcacgcaccctgtagtcccagctactagggaggctgaggcttgcaggagaacccagaaggttgaanctgggaggcgcaggatacattgagccgagatcgcgccacctgaactccagcctggtaacagcgcgagactgccaacaaacaacaaaaaagccaggcgtggtgtcttaagcttgcaatcccagcactatggggaggctgaggcgggcagatcatgaggcacggagatcggaacagcctgacaacatgg

SEQ ID NO: 630297 - DNA, 186 bp, Homo sapiens
agagttccggcatatgctgtgaaatcacagttccctttcatcttcagaacctctgtcgtgaatgtgttcaagaggcttgggttgattcaggaagaagtgcccaagctgtgtgtccccagtctccctgtggcctggactcgcccatgaacccaagtcgggttctagacagcgtgtccctgacagtag

SEQ ID NO: 630298 - DNA, 311 bp, Homo sapiens
  misc_feature (192)..(192): n is a, c, g, or t
  misc_feature (227)..(227): n is a, c, g, or t
  misc_feature (276)..(276): n is a, c, g, or t
ttctgggtcctcaaacacctaacaaccctcaaaaatgatcacagcgcacaccttgatagtgctgtataatgtacacaacccagccattacctcaattcatcctaacagtcctatgaggtaggtgtttctttttgcagatcagaaaaccgaagttccgccttgtccccagatcacctaggattttgcccaggngaccaggggagcttgtggaagaagtcacgcaagtnaaggatgggttgtttaaagtggcgccagggagctcaggcgacgatgccnttctttcctagccccgggacctttcagaactagtt

SEQ ID NO: 630299 - DNA, 271 bp, Homo sapiens
ctgatgagtggtctggtctccagtttgcctcctgctatatccattggaagagaaaagtctgtgacttgtggcccccaagtttttgagagaactgtggctttctggctgcggtgggtgacagagtgaggctctgtgtggtgagctcttcccacatggcatgcttacccgatgcctgcatgaatgacctccatccatgcacggtggatccgtcatagatgtctgaccttgcatgtgcatgcaatgcttgtgcacttgtgcctgtctgttctta

SEQ ID NO: 630300 - DNA, 80 bp, Homo sapiens
ctcttggggaaccgcgcagccttccgatgcccgattggactgggggatacgcgactttgacagcacaactcttctttgga

SEQ ID NO: 630301 - DNA, 399 bp, Homo sapiens
  misc_feature (12)..(12): n is a, c, g, or t
  misc_feature (37)..(37): n is a, c, g, or t
  misc_feature (254)..(254): n is a, c, g, or t
  misc_feature (358)..(358): n is a, c, g, or t
  misc_feature (365)..(365): n is a, c, g, or t
taccccttaccnagctggggggcccccctggaagganaggctctgtggccctattggtgtcagcatatcaattcaatcccagcatatacttttgactcaccttatatttgttgacaaccccatacatctatggcccaggtgattttcaacaagtgtaccaaggccattcaatggggaaagaatagtctcttcaaaatatggtgccgggacacctggatgtctacatgcaaaagaatgaagttctccccttcctnacaccatacacaaatattaactcaaaatagatcaaagacctagatataagagcttaaaccatacaactcttagaaaagaacagaggggcaaatctttatgaccnttagatntttagatacgacaggcactaaaagcatacacagc

SEQ ID NO: 630302 - DNA, 154 bp, Homo sapiens
gatagtggcatgccgtcatccagtgtgcatgccctgcatacagatggttttgatttgcatttctctgatgtgcagtgatgatgagcattttttcatcgtgtctcttagcttgcataacatgtccttctttttgaagcagtgtcttgttcactat

SEQ ID NO: 630303 - DNA, 649 bp, Homo sapiens
cgtgacgcgtgggtcgacccacgcgtacgcgcctggggcctggtgctgtgcctggtgcccccggctgctccctgccgcctgccctggaccctgctgcccctgcctggggcagctggtggtgagatgcccctgacttcccctgtgactgcctgccctgcctgtgccatggtgtgttccctggcctgcggctgctgctctgctgcgctgtgcttgctggcctcctggcccctggttgcccgcgccggctactccgaggagcgctgcagctggaggggcagcggcctcacccagtgagccctggcagcgtggggcagctggccctggcctgtgctggagggcgcggttgagtggctgtaccctggctggggcgctgctgcctgaccctgggcgtgcccgatcccagagcgcggccggcatcgcctgtctgcggccggtgcggcccttcgcgggcgcccaggtcttcgcggagctgcgcagtggtggcgccctggagctgctgctggccgagggcccgggcccggcaggggtgcctgttgcgtgcgctggggtcccacgagagcagcagggccctactacctgcagggcacgccgaaaccaggacattcagacagccgagtggacagcttccgctttgagctagcgcgaggac

SEQ ID NO: 630304 - DNA, 168 bp, Homo sapiens
agaggagataaatcaggactgccgaatcattggtttccttgattcaaaccaatagccggtttcttaggcttgatatttaatagaaggaaatgagccaaatccaaagtctcatagtcacacacatacaggaatctctatctccacatgcatcactcgggtaccgagctc

SEQ ID NO: 630305 - DNA, 120 bp, Homo sapiens
  misc_feature (120)..(120): n is a, c, g, or t
gtcattttttctgctgtgaaatatgaccaggcttgtaggaagactcatcttggagaaaatgttgaagggaatcaaattgctttgagatgaggttcccttggttatgagggccaaaccacn

SEQ ID NO: 630306 - DNA, 325 bp, Homo sapiens
cctcccaggttcaagcgattctcctgccttagcttcctgagtagctgggactacaggcacgtgccaccatgcccagctgatttttgtacttttagtagaaacggggtttcactatgttggctggtcttgaactcctgacatcaagtgatccgcccacctcgggctcccagagtactgggatttacaggcatgagccaccacgccaggctggtagcagtctttcctagaatgtggatgccttgggaaacaggggctctgccttgtttcccttgaacctagaatgggatctgggacacagcagatgctacatctattgtaaatgaat

SEQ ID NO: 630307 - DNA, 131 bp, Homo sapiens
  misc_feature (8)..(8): n is a, c, g, or t
gtgctgantcgatctagaggatcccttttccggcaaagatgatggctctagtttaagcagcgttgctgtcaggccctcctggtgtgggcaaaaccaccacagcttccctggtgtgtcaggagtggggatac

SEQ ID NO: 630308 - DNA, 314 bp, Homo sapiens
  misc_feature (14)..(14): n is a, c, g, or t
  misc_feature (44)..(44): n is a, c, g, or t
  misc_feature (143)..(143): n is a, c, g, or t
  misc_feature (297)..(297): n is a, c, g, or t
aatccaaataaaanaattttaataaaattgccatataaaagatntgtacctaggctgggtgcggtggcctcagttctgtaatccctagcactttgggaggccgaggcaggtagatcacttgagtttaggagtttgagagaccngccctggtgtacgtggcgaaaccttgtctctacaaaaaaaatacaaaaattagctgggcgtgttggtgcgttcctgtagttccagctacttgggtggctgaggcagtggatcgcttgaacctgggaggtccaggctgcagtgaacatgatggtngcctctggaccctagcc

SEQ ID NO: 630309 - DNA, 247 bp, Homo sapiens
atacaggttgtggcacacagaattctacagtataattagagattatataattatagatgcacatttttatttcttgggggagccatggggtagagaattacataaccagtgtgatggtaacagaaacccatttaatgggtaagtaaccaatgagttgaaatgaatgtgagtgacttgctcaagcaatgcaaacatagatgacttcctgataaagagatgtaacagcttgggccaagcaagacttaca

SEQ ID NO: 630310 - DNA, 129 bp, Homo sapiens
aaatgtctccttccatggttcttcactcacaattatgacttgaccaaaaccaaactctgataattgtatgaatttatagccgggcacggtggctcatgcctgtaatcccagcactttgagaggccaatg

SEQ ID NO: 630311 - DNA, 830 bp, Homo sapiens
  misc_feature (830)..(830): n is a, c, g, or t
gtatcaacgcagagtggtcattacggccgggacaacattccaaacctaagggagtacagagaaaaccagtgctaacgaggaaacgcttatagcaacgaacatgccatagcttcactaaaagttgagtaaatttcaatataagagcaactttaattcagtgcatactcgatggagctagaacaaggaagaatcgaaacccaacatcaaattgagtgagaaggaaagaaatagacatcagagacagactaagttgaaggtagagactcaaaaatacagatatatgagattcacattaaatgaacagctgctatgctgtgggcaacacactcataaagaaatcacattggcaatatcacatacactactaccgaaccaagaaagagaaaatacccgaaactaaaacgcagagaagtcacaattgatgtcacaagatacgaaatgtcatccgtgtaaaccaaataataggattgtctgaactcccaccatcccaaccagtctagacatggtcttcttaccgttgtcaagggcactctaccctgaaacactggttcaggccatgacaggaagtggaggtcagacaagcctcattatacctctccagcattaacatcaacacagatcttaagtctgataagtaacatttacaatctattctctccgaatcctgctagcccaaaggctttatctgcacgctaaaccttaggactctacaacggtcttattgcaacccagaagttccctttctatggataactccttcaacgaatggctatcagaaaacgttagaatcacctataaacatggaatgtcccagtttagcagtcctgcgn

SEQ ID NO: 630312 - DNA, 126 bp, Homo sapiens
gtgactctacaggatcctggctcgtgtaagctagcgcgtcgtcgtctccttcagtcgccatcatgattatctacggtgactcatcaagcacgatgagatgttctcggaatttacagatccggggag

SEQ ID NO: 630313 - DNA, 897 bp, Homo sapiens
taatgtcgctaccatggtctccggtggagcgacctcgccgcgcgccgtgtcctgtcgcgcatgttcctcctgccgcaaatggaattcggattgtcctacacagcttctctgggacatctctatgtcgataaaagagtagcaaagattatttgccaggtttcactggcaaacagggcacctttcacagccagcaggcattggacatatggcaccaaactcgttggaggaaccactccaggaaaggaggccagacacatctgggctacctgtctttaatactgtgaaggaggccaaagaacagacaggagcaacggattctgtcacttatgtcctccgccttttgctgcgtgcgtgccattaatgaagctatagatggcagaaatacccttggtgtgtgtgtatcactgaaggaattccccagcaggacatggtacgagtcaagcacaaagtgcgcgccaggaacacgacatggctacattgggcccaatgccctggagtcatcaatcttggagagtgtaaacttgggatcatgcctggcatattcccaacaatcaggacggacttggcattgtgtcagatccggaaacccgactaatgaagtcggtgtcagcataaacgcacgtggacataggggacagcgtgcgacgagaactcgggggcgatcctcatagatgcccgaattcatgacgccgcgaagccacgaccggctgggcacgaggcccaatggagggaacggtgtccgaaagcaacctcctgggaacacacagaccacccacgtcagaagatacaaaggcccgacaaatctagcgcaagggaccaccgagcggaacaccaaaacagcaacacaagccacaagcagaaacaccgcgcgaaaacaggtcacaacatgcggcgaaa

SEQ ID NO: 630314 - DNA, 338 bp, Homo sapiens
attttaccaaataccattggttaaaggaatgaaatttctaagggcagtgtcgtgttctacttcaattgtttttaccaaaccaccactcaccaaaaggcatttttaacagtttacacttctcaccaacaatattgacaaatgtgatgagaataccttggcaacctttcccatattttctatagctttaggggcagttcagggtttcatctacttaactgaaatttaatgtcagtgttgattgttcataaactaaacaaatggcccaactgccccttaaggattttccatatcatacttaacaccactatcaggcagatttctacagacagctatgcgct

SEQ ID NO: 630315 - DNA, 451 bp, Homo sapiens
caaaaggttaaaacatgactgccatgggttttcactttttgagacccttgggatgggccagatgacatcaagcaatagatcagatttagtgctcaggccaaagagtcccacccacaacatagcctgagcaccctgtgggcccatgtagtgcatgaatgggcatatgtacttgggcaatagagattagattcctctagggctgagcggggcaaggtgggagccaggagacactgggccatgaccccagcagagttctaggctgcccatgtcacgtgagccagtgaaaatccagagagtggagggccctagagagagaccaccttgtcatccccgacggacaggaggaggagcaggaagctgccggggaagggagaaaccagcagaaactgagaggagaagatgactacaacatggatgacacaatgaagcagaatctgagcacacgacaagc

SEQ ID NO: 630316 - DNA, 754 bp, Homo sapiens
gcaccgtgggtatgcagacagtccttcaaaagcaggagcggtccatatgtgcaggcatttgactcgctgctattgctggtcctgtggccagagtacttgaacgatcagtcaccggagattggggtgagacgtgcagaacacatgcggagatggtccacacaggtttgaagtttggatcgacggctcgtgttgggttacagacttctcatgctgtcaagcagccagcagaaaagtacaggcttgtccgaatattggtatggcacccactctcagagcatgatcaaagaagatgactagccctttcgggagacagaaacgcgagtgcagacaacgttggtatgtcaatcactcgtgctcatggctgatcacgcgaagagtatctcgagggcgctgggcctggggtgagctactggtctcccagaggcctggtcgccttatggtgcaacacgaaatgagagtgatcgccgccagtggtgtatcatagcaaatcgcgagctcctcacaagagtacaacagactggttggaatagatgaagccgtgtagaacgtgggtcaaacgtcttactttaaaagtactatggacacgatgctagcaaggcttacgattaacggagttaccagtaccagccggagtggacgctggagtcgaaaccgtgggcctgtggtcaagaagaactgagcggacttgccatctggaccctcctgccgatcaaggtcctaatccacgcttggcaagggggaggaaccatcccca

SEQ ID NO: 630317 - DNA, 1117 bp, Homo sapiens
  misc_feature (419)..(419): n is a, c, g, or t
gcgcagcatgcgatccacgataggaagaccttgcgagctcccgttgagtacaggatgccctggatgggctgatgcttgaaggggagaagcatcgtgtctgcggcccggaaggaccattgtggcgacagcgacgtccgtccacggagggctcaccgctccttcgcgccaatcgctgacggtcaacagcgctcgaagcagaacggcaagaccctgagctattggaacccaggctgcctcgcagggagcgagcggcgtggagcagtcgacaagaggaagcgaagactgcctggcgctccagtcgacgatccagtgggagatcactcggaggaccgagaagcggcttgcgaagagactatcccgcatagatcgaagaagtcgaacggaattgagccctagggatcgagagggatcgatacaancgagtcgacctgaacggaacagagcgatcgcgagtatcagcggattgcgtcaaccaaagctagctggccaagtcccttcgtttcccttgcaattgctagctgtatgttgggatcggttcccaagggattgacagggcattggcgggcccgattggctgggcgcgtctccccaaggattggacccaacggcgtcgtgtgcgagcacgagcctaagacgtaaacacgtcgtgcgtggaacgggtatccaggccacaagggcagggcgttggcctatgaagccaaacacgtaacttaattcgtcggtgaaagggtgtccgtagaggggacaaaactcgtggcaaaggtatggataacttttggcgttggacggccaaacggtccaccaaagtgggtggcttaccgaagggggaacccacgaggactatcctaggcagagccggccccagatacttaatccctaggccaatcaaagcaaaccttaaccgaaattgtgaaccacttccccataccagaaggtttcccctcggggaagggaagagtcctgcggacacccgtggaattacgcacgccttaggagtcgcggctatgttagaagaccccagcaagagaagctagctttgaaggcgggcctccccttagcccagtgggatagcgagcacttgtggaatgccaacgcaacgagtctcaagggaccctag

SEQ ID NO: 630318 - DNA, 228 bp, Homo sapiens
ccgcgtccctgtctgacgaccagaactgaataacattaaataacgttctccatgtgaacttcttttctgatttatcatctataattctttgttataaaatccaggcttacaatagacattttaggaaaagtaaaaagaaactgaagacagtgaataaaaatcactctaaaatattttattcaccttttacccagttgtaaaatgatctctcgtaagacataaccgcgg

SEQ ID NO: 630319 - DNA, 291 bp, Homo sapiens
atcccttaatccccttttatatttttttttccccattttaacccttgaaaatattaaaactggatattttttccaaccaatgtcctggatgatgggccctaaaaataatgaaaaaggagtttaaaaaggatgggccgtttttccggcaaaatttgtaggttatgttttgggtaaaaagtcaagggggaaaatgggcctgttgtttagtgtttccttcctaaaaagcccttttggattggaatttatttttttttatgcttttaaccctatgtaaataaacccttagtaata

SEQ ID NO: 630320 - DNA, 190 bp, Homo sapiens
aagcaagaaggtcatggaaggattacagaccacatgtactttgttatgtttctttcttttatatttcttgagacggagtctcactctgtcgcccagagtgaagtgtaatggcgctatctcggtctcactgacaacctccgcctcccgggttcaagctattcttctgcctctgcacttcagccggggcgac

SEQ ID NO: 630321 - DNA, 144 bp, Homo sapiens
aaaacatcaacttcctgaagttagaaataagaatgttgttaaaatccacagctattatccttatgcctggatggattaatcttgtgtagcttcaacttggttagtgtgaaatagttctccacctcttgacgaccacttccaatt

SEQ ID NO: 630322 - DNA, 425 bp, Homo sapiens
gacactgaccttcagttcctcgaatgcagagccatggcgccctacaggacggccttcgctgacggctggcagatgaacgcccgcacgcggacttcagaggcagcccatcgggactcagacaagcgctcaaggtgccggccgacaccgagccgatatgcgccgctctactgcccatcccgacttcgccggaccagccctacctcccaagaccgccgtcgctccgcaccccggcaaccaagccaccaacgcaaccgcccacagggcacagaacgcacagcctccgcaagcactgtcccccccacaacggcgcgcccccgaacacttagagcccccgacggcccctacccagtcccagcgccccacacgggacccatggcccacgctccggccccaccactcgctccacacaccaccactcccccccc

SEQ ID NO: 630323 - DNA, 159 bp, Homo sapiens
tacattagtttgatgtctgctactgacaggctatgtggacatacttctggtgggcactgtgcggaaacttgaggataaatcagtgagctgcatcactttgaaaggcatagcctgtctcctcactaaagtgcaaggtccatcgaccaaagccctattctg

SEQ ID NO: 630324 - DNA, 144 bp, Homo sapiens
ggtgatctagaggatcccttctgcaggatgtacatatgggaccagcttctgcttggtttctagggaggcctcagggacatttaactcatggtggaaggtgaggtggaacaggcctgtcatatgatgtcagcaggagcaagacag

SEQ ID NO: 630325 - DNA, 1222 bp, Homo sapiens
gcttttggacgatggagactatggaaaactaggcttagcgaaattccactgcaaaatcttcacctcagaaaattgacgtcctttgtggaattggaataaaaaaggttgcttgtggaactcagttttctgttgctttgaccaaagcatggtcatgctgtatacctcttggctcaacgatcgcctgcatagcgctctgccaccaggggcgctgctccgcaatcacaatcgaccgccacaccactccctgctcctgcgctggcagctaatcactcgcaagactgtggcagcctcggacgcctgcacccacacccctctgcctctcgcgccctcacacactgcgcaccactgctgctctcgccctgcggcgcgagcacactctcagcacacgcggccacgcctcgagccttcacgcccactaccacccccatgctccgacacacccaaccccctggtaaaccagcgtctgccacaggcgcaccccactgccccgccccaccactctcgcgcctcggccgcctgcccaccacgtgcctagccatcggcacacgcacccacccatgctccccacccacccgacgcacacacgcgctgctgctccaccactcctcctgccacgcctcgcgcgccctcgccatgaccacaccctgcccccccccacgttattgcggcgcgcctgccccacaccgctccgcccctctccccccgcgctgccgcccctcgggctccgggcctgctcctaccacctctctctgaccccttcctgctcctcccctcccgccacgactgctcaaccctttcgcctccaaccaaccccgcaccccgcccattcccacttactacctgcctgcaaccctcaccgccctgctccacggaccaccctcccgccctcacgcctcccccccagcagtccacccctcccgcccaccgcgcgcgccccctccacacaccacgcccccccaccccccccggccaccccacacaaccccgcccccaaggactccacccacaaacacaacgccgccccttctggtcccatccgccgccactcgctcctcgcacgtctcaccaccagggcctcacaccctccagctactgcccgcccacgatcgcaactgacctctctcgcctcccccccccttccgtctcacgcactcgcactccctccacacaccgccgacttccctccgcccctcctcctcccccgcccggcgacgccccctgc

SEQ ID NO: 630326 - DNA, 294 bp, Homo sapiens
cccccccccccccccggtttttaaaacccagaattttttcctaagagcccttcgagcaaagggggccgaagttagttgttttttttgggggggcccttttttaggcccccaaaaaagcccaaaaaatgggatctgggggaatgttttgcaaattcaaaaaaaagttggggaattttttttccccgttgatttttaaaaaaaaccgggggccaggggtgggcctttgccccttttaaaaagggaacccccccctgaaaatggtttaacttaaaaaaaaagaaaaacctttttaga

SEQ ID NO: 630327 - DNA, 382 bp, Homo sapiens
ctcggctacctcctttatggccacgccttactttatcaagtgtatataagctgatattaatcttatctgagcaaaatggttcattcattatgacaaatttacacagtaatcgcatggtcaaatatattgctcaacattatcccccaagatgcgtaatcagacctatgtaaattggaagttaccttatgcacgcttaactatcattatcatagcatagagtgcaagagattggacagttcaaatctgaccccgatgtagatgttcgataagagaattctctggtccccagctctaagttgccagccctcctagagctacctgtggagcgacctgctcagatacatcaaacatggagacagcactcaaagtagaattataaaga

SEQ ID NO: 630328 - DNA, 110 bp, Homo sapiens
cttgaggatcccctaccccgtcgttctggctggcctccctagctggcgcgcggcggtgcgcgcggtgttccagcggattcgaggtactcgtatgccgagctgcccgaacg

SEQ ID NO: 630329 - DNA, 348 bp, Homo sapiens
  misc_feature (20)..(20): n is a, c, g, or t
  misc_feature (60)..(60): n is a, c, g, or t
tgtatatttatgatggcacncttctatggtgtgaacctttggtaggtacaagccattagntaaacagctaataatttcttttaatgcttttcttaaaagactgctgatatagctacatgttctggccacatgtaaaaaacttccatttgtggtagtggcattacatagggatcttttagctaagtaaagatttttaagtcaagttgaattgagagtatttgaaaagttttgaccccttccttttggaagtagttatcccaaagaaactatctttgagggtattcctggaagttaaaaaaataggttggagaagtgaggtttttattagtacatagtaccatttataca

SEQ ID NO: 630330 - DNA, 952 bp, Homo sapiens
  misc_feature (6)..(6): n is a, c, g, or t
  misc_feature (106)..(106): n is a, c, g, or t
  misc_feature (311)..(311): n is a, c, g, or t
  misc_feature (358)..(358): n is a, c, g, or t
  misc_feature (949)..(949): n is a, c, g, or t
gtgaanatagaaaaagtttgtaaaaaaagaaggatggtaaaggtaaggaattaaagggataggagggttaagggataagggatatgggtggaggaggatgtgagangaggaaatgaggagaagaaagagggagaagtaggggatggaaatgtaggaagagggatgaggaagaggaaagagaaagtagaattggagaatgagagatgagaagaagagggatagtaataataaggataggaagaagaggagatggaagaagaatgaagaatgaagaagaaaataagaatgaagggaaaggaggaggatgaganagatgagaaaagaagagggaatgaagagggagatgggaaggagaaanggagtgtggttgagaatgaggaagataattttatgtgttttggggttgtaaattgaaattaaatttataataaaaatatgtaatggaataaaggaaaaaatgattttattgaatttagtaagagttaaatatttaattgatttgaaaaaaaaaaaggataaaggtttgaataaaaagtgtaaataataaatgaagaaagaggaagaagtgaaaattggagtatggaaaaaagtaaatgaagtatggtggaagaaagaaaaaggaaaagaaaagatgtggtatgaggatgaattggattaaagaaaaaatataattatgtaaatgaatgggaaagaaggtaaaagaggaggagaaaaaagagtggagatttaaaaggtgatgagttaaattggttaaaatgtggtaaaatttgaataaagaggttggggtgaataagtgggaaagaaatatgagaggggaatgaaatatgaagaaataaaagtttttgaatggataaaagaaagaagtggtgaaaaaaaagtgtaaatatgggggaaatatatgggaaatggagtggagaaaaatatggtgaggagaatatgtgagagaganaag

SEQ ID NO: 630331 - DNA, 940 bp, Homo sapiens
gcatcgttaaagtctctcttcagcctggccggcatgtctaacgtcagagtctcctaaacgagcccgactcgagctgagtgaagctcttcatttggagggttgagctttgaaacaagctgatgatgcagccgtgaggagccgagtttcgatgcacatggggaacgtctcatcggcactgtgtggtaatgagagatccaaaacacctagagacgctctcaggggcctttgggtttgtcacatatgagcactgtggatggacggtggatgcatgctatgaatgcaaggccacggaagggggatggaagagtttgtggaccccgttcgagagctggcgtcctagcagagcgatccatcagaaaggaagctaggttggcctactatacatcctggtcgtacatagaacgatatatagtgggtcgcgcattaacgggcataggacacgctcggaaaaactattaccctaggcagattagtttctcgaaacaagataatgggatacaaatatgaccgttgatcgacaacttgagagacactgcactggcagggggaggaatggagcaacagtaaaagaaggggcggcatccatgggcgtatgcgatcaccccattgtgtatgagggcccatttacatcatccgtatgagaatcatgaaatctggacacggtctgatcaacacaaacaggaccagcattgacttcgggcgcgaatttggggcgcagacacttcggggacagcaagcgaccccgagcagagcaagaccccgtagcacccgaaaaagaacaaggacgcctccgaccttacagagacgactccaaagtcacaacgacagcaaacaagaagcgggcagaacacgagaggcgcgccatcggaacaacaagatagtgaggacagggtcgggacgccaccagtcgacagaacagagagaggcaaagacggacaca

SEQ ID NO: 630332 - DNA, 155 bp, Homo sapiens
agcggagccgcggctgccggaggggaccgggccaggccggggtgcggcggccgagccgcggtagcggcggcggcgggaggggcggcctgagggcggacgggcgggcgcccgggttgcgggggctcggtgccgctccgcactgcccggccggtctc

SEQ ID NO: 630333 - DNA, 179 bp, Homo sapiens
ctgacgtattaaaggtcactatctcagataagaggagtgacagatattctcagatacccaacatttcaggtatctttgatgtaaatttctgcacacactggcctggtagagaaaaaggaaggaaagtgcaaggagagaggcacgaaagtgcaggcaggtagggagagaaatttccagag

SEQ ID NO: 630334 - DNA, 200 bp, Homo sapiens
cagcccttagagccaatcctatatacctgaggttactggatcctggcttgcctgactatcccttaccatacatatgttccaacatgccactaggcttgttcacctctgtgagaccttgctgcgtgatattgggtacttgccctggctgcgacgatcttacacgcctactcacccctgtgcattttccatggtgccacgct

SEQ ID NO: 630335 - DNA, 317 bp, Homo sapiens
ttcggcacgaggaattgcatcagagatgtaaacatttaaaagcgtattaaggctgggcgcagtggctcactcccgtcatcccagcactttgggaggccgaagcgggcggatcatgaggtcaggagatcgagaccatcctggctaacacagtgaaaccccgtctctattaaaaatacagaaaaattagccggtcgtggtggcaggtgcctgtagtcccagctactcaggaggctgaggcaggagaatgcatgaacccgggaggcagagcttgcagtgagccgggatcacgccactgcactccagcctgggcaacagag

SEQ ID NO: 630336 - DNA, 1082 bp, Homo sapiens
  misc_feature (290)..(290): n is a, c, g, or t
  misc_feature (518)..(518): n is a, c, g, or t
  misc_feature (553)..(553): n is a, c, g, or t
ggagttccgaggtgctggtcactaataggtagggcttccaccgcagacatggtagaccgagcgtactggcccgatgaggtggtggtaggtacgagggctggcaagaatcgcgagaatcagtatgaggggttggcgagtgatacccggtcattgaatcagtcacagtcggcggtgatgagtctgcaccatgctgggtggcaatggccagtcgtgggggtggcagaccaggtccttactaggaaggagttccttgtgtgtatgtgcactgctcgtgttgatgcatggactcngtgcatgctcccgagtctatatgcgttgtcgtctaccagggactcgggaacagctgatgaacacgtcgtactcgtgacagcaggtgggacatggtgctcgatgctggtgcgacacaccaaacgacacgtggcgctgtatgtgctgtctggcaccgcatgaggacgcccgtgccaacatcaatggagtccgctagggtgccgcgctaaacgagcctcgcggagtcgtantcacctgtagggaggtacctatgtgtacacgagantctagcaacacggccctgcgccggcgcgcgactctcagacggtcgtatcactcgagagtacagacgcaaggaggggccgaggtctagccgatgccaaggaacatggcttcgaatggtgagggtatcgccgcaaggtgctgtacctccggacctcagggggatgctgtcgtttggggtccggagtactcccggtgatgtctgatgagatgtgagaagcgtggagcttccaaggcaggaagcgcgtgtgcactggggatacaaggggaggatggtggaaatctgctcgggacgaagggggttcaacttggggagcatttactctccctggttgcttgggtgctaaagggtgggcacacagatcgaaccggagggtcgcgcccgggtgcccttatgggtagacctgcgcggggcagacttggtcgtgcatggatcctgccagggtcaaggtacggcgaaagggttccttaccacacgggagactcacaacagttcgggggtgccccagaatggcctgggcaaatatgggggg

SEQ ID NO: 630337 - DNA, 126 bp, Homo sapiens
  misc_feature (26)..(26): n is a, c, g, or t
  misc_feature (53)..(53): n is a, c, g, or t
  misc_feature (91)..(91): n is a, c, g, or t
ctttaaacttaatgttcaagactttnattgggcctgggggaaacatgcctggntacttgagaccagaaactgcacaggggatttctttgantttcaaacgacttttggagttcaaccaaggaaagt

SEQ ID NO: 630338 - DNA, 82 bp, Homo sapiens
  misc_feature (2)..(2): n is a, c, g, or t
  misc_feature (4)..(4): n is a, c, g, or t
tntntgtccttttaaattttaataaaatagattaatttcatattacatagagagcaagtccatccattcatccgtgataaaa

SEQ ID NO: 630339 - DNA, 141 bp, Homo sapiens
aaatgtcacaccgcacacacacgtacggggaatcatccttgactactctacttttactcacacccctacccatcaactcatcaatacgccatgtacatattattatactttaatagtatcttaaacaccttacttatccat

SEQ ID NO: 630340 - DNA, 169 bp, Homo sapiens
tgttcggcgcgtcgaacacgcgggcgacgtgcgcatcgctgacgtcggctttgggccgagcgcgcggcgcgcgcggtctatcttgcgcaccagctcatcggtcggcgcgtggttgcctgaatagttaatgatgacggtaaagccgtcggcggccagacgctcggcgatg

SEQ ID NO: 630341 - DNA, 138 bp, Homo sapiens
aatagtacgcaccagctgtgctcactcataactaactaactaactgtctatagcaccagctacactatacaacagcaaagctaggagctgcagcacttatagcctgaaagcctgaaataatttacaatcaatcatcac

SEQ ID NO: 630342 - DNA, 700 bp, Homo sapiens
gcaccacactgcccgagggagcctcccaacggccccccaacccagcgaaacccggagtgaggcagcccggcaccaaccccgggaggcgggctcctgagaatatagacaaccgcgccggcgccgccgcgctcgtcgcggcgcaacgatctcccgcacacgcgacaggtcgggacactcacgcacgcccttgtatgtacaccccacgcacacggacgcgctcccgccgacgctcaccgccacgggccatatcgaataaacttcctgggtgcctctcttcggcgactatctcacgcgcggtgtgcgatgcccacaagcctcccactggcactaagggtacttcacacactgttcccagcgcctgcgcgtggttcgaactcctactcgctctctctttcggaggcagtaacaccgctcgcttcgttatatatggccctgggacgcacaggggaaaacggtcatttttgggacccgccacccaggccggccttgatacgctctagcggcacgagctaggaggcgacgcgcccccacgcccaccgcacgccacgcgcgcactgttcgctcgcaggaacacatggaacccaagggttggctacgataagaatagaaaaatagaacaacaaggaaacaaagaagaagaaaacaagaggaaaaaataagaacaaaaaaagaaaacaaataaaacaacaaaaaaaagaca

SEQ ID NO: 630343 - DNA, 81 bp, Homo sapiens
atttaccacaagggacgatttccacaccaaccccaaaaatgtcccctatgacgacgaaatgtgtatttgaaacagctctga

SEQ ID NO: 630344 - DNA, 228 bp, Homo sapiens
cacctcacacccaactggaccaagtctatcacgcctactagaagacgcgcatgttagtataagtaacatgaaaaatactcctccgcataagcacgcgtcagatatacaacactgaactgacaattaacagcccaatatctacactcaagcaacaagtcattattaccctcctctgtgctgtccacctcctctgtgctgtccagctgtccacctcctctgtgctgtcca

SEQ ID NO: 630345 - DNA, 140 bp, Homo sapiens
ggctcggtgcacgggtcatagagcgagagtccatctcagagaaagaaaacaactattttgcacataatcaaactcaccgtgttctcatgactttgggttaagggggttttcccatagtttatttttctcccagtgcttca

SEQ ID NO: 630346 - DNA, 978 bp, Homo sapiens
  misc_feature (71)..(72): n is a, c, g, or t
  misc_feature (79)..(80): n is a, c, g, or t
  misc_feature (91)..(91): n is a, c, g, or t
  misc_feature (106)..(107): n is a, c, g, or t
  misc_feature (109)..(109): n is a, c, g, or t
  misc_feature (113)..(114): n is a, c, g, or t
  misc_feature (127)..(128): n is a, c, g, or t
  misc_feature (134)..(134): n is a, c, g, or t
  misc_feature (139)..(139): n is a, c, g, or t
  misc_feature (147)..(148): n is a, c, g, or t
  misc_feature (156)..(156): n is a, c, g, or t
  misc_feature (168)..(168): n is a, c, g, or t
ggctgaagaaagcctaggtctcttagatgattacctggaggtggcaagcacttcaaacctcatgggttctnncagcgannaggctaaggcnggctcctccgaatgnntngctnntggatgggttggnnagtccntccancaacagcnnggaggatnccttcttcgggncagattggattttgggagaaattggatttaagggaggtacgacgtatgcgatagcccatgctgaggcgtatatgatagtacctaggtagagatcgcatggcgcaggagtgcaccgtatgcttgcaccaacggtatgagattcgagcactatgatggactcgtgctattgggctcggccccctaggtccgaggtgagacttctatagtacagctgtgaccccgctcgcatggaccgggatggcaatcgcgcaaaggttcgggcggcaagtccttgccctattgagacaagttcttaagcgagcatagacctctgggaggcctaagcgtctggccccttcgtttgctaagacagttacgtgttaaccaagcgctcctattcgcccgcattttaaccacgctaagggtgctgccgtagtacacgtacgcgacttgcgcaacgatgcgatgtacacttgtgtaagctgtatcagcgacgctggggggcatgtccgacacgtgggaatatcggactggaacggcggattaggggaagctcggactaactacttgctttaccgttggccagtgataccctgcagctgcagtacaagggagggaaaggacgaccccgtatcggatcagtgatacgctgggcaatcgtgtagtgaagcccgagaaggtcgcttactctgggggtcgtccctcagtcacatggacccctctagtcaggggtgctctccagattagggaggcctgccccatctccaggggtggtcctctgctggggtcttggccgctgccaagaccgtaggatcctcccttggacgagaa

SEQ ID NO: 630347 - DNA, 1030 bp, Homo sapiens
agcggacgcccacctctctcctggagcgctgggccttcgctggccgcaccggcagccatgagctcggagatggagccgctgctcctggcctggagctattttaggcgcaggaagttccagctctgcgccgatctatgcacgcagatgctggagaagtccccttatgaccaggcagcttggatcttaacaagcaacgacgcgctcaacagacacactggctatacatagatgacattgactgtcaccactcagcgacggaacttgccagcaacactgatgctggatgacaatgctatagcctcaagttccacgccctggaacgtctttgaaactccctgcgaactaatcagcacaggagggcctagccaggccgtccaggccaactcacacaagcctgcgaagacccattacagcgctcttccctccagcgccccaagcacagcacgcagctgcgcaaggcccacgcgcactcactggcaacccaggctactccacgcacaacaccccaggaaaccccgccctcacacccagccccgcccctaatcacccacgcctcccctcccgcgcacacgcactcccgccccacgcctcagccgcacaaccgagccccagtcacccaatgcccctctccaccaaaggatcccctcgccatggcgcacccgcatcttcattccaccactcttcatccttaagcgccctcggcacattcctcacaccacccaccgttcatctccccccacgcacacaaccccttcacacgcttcaggcggccgacaaccgcagccttctccgctctaccgcagcgcttacttcattccttctgcatccaactcgcaatctgcaagcaccagtcgcacttggtttctcaacggcaccctagtttcccaattcctttctgccacaggcatcttgttacaggcttccctgtaaccaatcgttttggggcaagctctatttacaccccaattccctgtaattctggcagcgtacattcatctcgaccatcccaccatttgggacaacccaccag

SEQ ID NO: 630348 - DNA, 202 bp, Homo sapiens
accctctgtgtgacactttacgcgcacacggacaaaatgcccaaactggagcccttgcaaaaacactggcttgtggcattggcatactatgcccttacaggctggagtatctatcgaacacacatactaaactgagacaatcatgtgacaacatcgtctattgaaataggtgctcatggatttacccattccattattatca

SEQ ID NO: 630349 - DNA, 411 bp, Homo sapiens
ttatgttctgaccacctccatatcttacaatatatacttaaatactatgcttgtattagtccacttttgcattgctataaagaaatgcctgagactgggcaatttataaagaaaacgggttttattgtttcacagttctgcaggctgtacaggaagcatgatgctggaatctacttggcttctgggaaggcctcatgaaacttacaatcatggtgaaagcagaagcaaaagagaacttttaaatgaccaggtctcgtgagaattcactctctatcatgaggtgagtgccaagaggactgtactaaactattcatgagaaatatgcccttatgatccaatcacttcccaccaggccccatctccatccacattgctgcaaaggccatgatctcgtcttcttttttttttttt

SEQ ID NO: 630350 - DNA, 467 bp, Homo sapiens
  misc_feature (20)..(20): n is a, c, g, or t
tcagcaccatggaggatganttctcaagggccatctggcctccaaccctggctgaagagaaaaaagatcccctacagccctatgagagagaggtcctctgtctttctgtgcttggctcatttcagttaacataatgtcccccaggcttatccacatggttgcaaatgacaggatttccttctaaaaaaggctgaatagtattccatggtgtatatatatcacattttttatccattcatctgttgatgggcaccaaggtggtttccacatctgggctatggtgagtagtgttgcagtgaacatggcagtgcagatctccttctgacatatggattttggttcctttgggtatgtacgcagcagtgagattgctgaatcatatagtagtgatgttttcagttttttggaggaatctccataccgtgttttataatagctgtactaatttacatcctccatggtgctga

SEQ ID NO: 630351 - DNA, 1468 bp, Homo sapiens
  misc_feature (208)..(208): n is a, c, g, or t
tggtctaaattttatgtttccgggttctccgaattgtgtggtaggggggggtggcatccatatagtcactccaggttatatggagggtttcttctaatctatattaaggaatcttttccgctcttccaaagccgaaaggtcttctccaatatccatgaaaatatttattaatatattaacgggcgtgttagaagaaatatgcatatgnagccctaacagaatgaataggatattgttccagtgtggggatattgccctctcggggtatagctccgagagtataagcgtctcggggccattctccggaaataggcccgaaaaaagtgtgtttggtgggaacaacaagagttatagaatttatacgcccgaagtgaacattattgaataggtgcaaagtggatttgtaggcgcggtataagagtgtggggctcataaagggtgtgttacgcctgtagaagaatatagggggagaaacatctcaaggtagatactttagacacgccctctcctatatgtagagtgtgggcacacatctaccaggctctccctatatatgtagatataagagcaacatataagggtgagcaacaagtgtgcggaggacataaaacaagacgcggtcataagcaatacgcgagatgtgctccgcggggtgatatgacaacgccgaaatgaggtctccataaggcgttgcaagtgaacgtctttggggccactaaatcctaccccagaagggccccccgaggtctccaagggggccccaacccaaattagcggcggtgggcaacacacccagaaacacgtagaaatgtgacaaatccccccatagaagggggggccctcctggaagagatccagtgtcggagcgagacaaaaaactccattttctacaacataatatggtggcatacccccggtgtgggcaagtgtgtgtggcgccaccagcatttccaagctcctaaacaactaactttttgtgagaatcacccccgggaatggggagagaaatttagagccgaaaaggacaatacacgtgggtaaaacccggggaatgggcattgaacaataagcgccccgcggggagaggacccacacggggcaaaatccccaaccggggaacaattaatgtgggggggtgacccacaacggagataaaaccccaatagaacagccaaatgagataaatcaaataggctacaaaacacgaaaccctaagggataccccacaagggcgtaccttaatatccgcgggaggaagaccagtctaccacatgtggcgacaaatcatccgaacccggtggagggataaaagcaataacaaccaacgaggggaggcgagaaaaacacaacacagggcgaggaaatacaaagggggcgccagccgcccgcggcgggacaaacaaagagtgtataagcgttagcgatcgataaaaacatgacgcgtgcacagagacgcagaaatacacgc

SEQ ID NO: 630352 - DNA, 155 bp, Homo sapiens
ccgccatacgcgctctccctgtttaggttatggcaggaggaaccggatgtggacaatgagctctggactatgaggatgatgagggtggagacagcagctggggagatgggctgagccctgcccagaggatgtcagggctcctatgtctccatcca

SEQ ID NO: 630353 - DNA, 376 bp, Homo sapiens
ggtctcacaacgtcctgggtctcaagctattcctcccacataatggcctcccaaagtactgggattacaggtgtgagagccccttgaaatataagaatattggctttatttattttggtgctctggtgttcggtgcatatatatttacagttgttttagccttttgaattgatctctttatcattatataatgattttctttgtctctttttacagttttggatatagtctattttatctaagcatagctattcttgcctggttttggttttgctttgtgtggagtatctttttccatacctacactttcagtccatatgtgtgtttacgggtgaagtgagttttttgcaggcagcatacagttggccttatcgag

SEQ ID NO: 630354 - DNA, 854 bp, Homo sapiens
ccctcgtccacagaagctgccatcaagtatttcctcacgcaagcgaccggtccataatccttctaatagctatcctcttcaacaatatactctccggacaatgaacctataaccaatactaccaatcaatactcatcattactaatcataatggtatagcagtaaaactaggaatagcccccttgcacttctgatgtccagaggttacccaaggcacccctcttgatatccggcctgcttcttctcacatgacaagagaattagcccccatctcaatcatataccaaatctcgtccctcactaaaggtaagccttctcctcactctctcaatcttatccatcatagcaggcagttgaggtggattagaccaaagccagttacgcaaaatcttagcatactcctcaattacccacataggatgactacatagcagttctaccgtacaagctttaacataaccattcttaatttacctatttatatgatcctaattattaccgtattcctatactcaattaaactgccagcaccacgaagcctactatatctcgcacctgaaaacaagctaacattgatagcaccttaattccattcaccctctctcctaggaggctgccccgtgtaccggttgtttgccaatggcgcttttcgaggattgccaaaaaaatagggtattatccaacatatagcgacattaccgtcttaccttaatttactagagaattatcactaataaatatcccatttaagtaataatgcgtggtaaaacacccatttcccaaatgcgtgaagcatacaatccttttatttttaaaaaaaaaaaagggggggcgataaaattgggcaaaaaata

SEQ ID NO: 630355 - DNA, 255 bp, Homo sapiens
aaaatgaagagcattcagacagtctaagaaagtcatgctgagtgactcacacctgtaatttcaggactttaggaggccaaggcaagaggattgcttgaggccaagagtcaagacccgcctgggcaaaacagcaagaccctgtctctacaaaaatagaaaattaaaaaaagggtggctggcaagatgaccaaataggaacagctcgggtctgcagctcccagcaagatcaacacagaaggcgggtgattttttgca

SEQ ID NO: 630356 - DNA, 696 bp, Homo sapiens
cgaggctcagtctgtcaccatttagttaggtagtgccgtggtgggcttgaggctcactgcactgcagacctccacctccctggagtcaagtgattctctcacctcagcctcacaagtagctgggactacgggcatgtgccacaatgcctggctaattttttaattttttaatattttttattttattttattttgagacagagtcttgctctgtcacccaggaccggagtgcaatggatgtgatcatcggcttcactgcaacccatctgctcaagcaatatctccactgccttagacctcctgagatagactgggattacaggcgcctgccaccacgcccggctaactattttatttttattatttagatagagacaggatttggccattgttggccaaggatggtcatcaacctcacatgaccatcaggagtgatccagcccaccttcaggacatcccaaagtgcctcggattacagaagtgtgagccaacaacagaccgcagaccatataattatatagattgtgatgaataagattttatagttataaataaatttataataatgtagaaagtggaagatataaaaatcattgataagaaccaaggcgttgaagatgaaaaatggggggcgaatcttgaggataaaatgaaaaattcaaagcccacaagggtttccgaaacaaatgtagtcca

SEQ ID NO: 630357 - DNA, 385 bp, Homo sapiens
  misc_feature (14)..(14): n is a, c, g, or t
  misc_feature (70)..(70): n is a, c, g, or t
  misc_feature (256)..(256): n is a, c, g, or t
aacttaaaaaattncccccattttaagcccatttttaaagtgcacgggttcctgtggcaattagggtaanattcgcattgtgcaggccacgggcgaccctccgccttcagaactttctcatcttccccaaaccgaagctctgtgctcattaaaggctagcccccccgttgctctcccccagccccggcaaccccatgtccactttgtgtctcgactgtaagtgtggctgctctgggaccagtgccagtgggcgcanactgggtttgcctatgtctggcttacttcactcagcagagtgtcttcggttttatcagttttgtcacaagtgtcaggatttttctcatttttaaggctgaataaaatattgtgtggataaaaacaaaaa

SEQ ID NO: 630358 - DNA, 245 bp, Homo sapiens
  misc_feature (24)..(24): n is a, c, g, or t
  misc_feature (26)..(26): n is a, c, g, or t
  misc_feature (32)..(32): n is a, c, g, or t
  misc_feature (72)..(72): n is a, c, g, or t
  misc_feature (81)..(81): n is a, c, g, or t
  misc_feature (233)..(233): n is a, c, g, or t
  misc_feature (240)..(240): n is a, c, g, or t
gcgcatcaaagtggagcgcacgcntngcgganaccggctggcggccaccaagtgccggaagcggaactggangcgcatccncatgcgaaggacaaggtgaagacgctcaaggccgagaacgcggggctgtcgagtaccgccggcctcctccgggagcaggtggccagctcaaacagaaggtcatgaccacgtcagcaacggctgtcagctgctgcttggggtcaagggacacnccttctnaaagt

SEQ ID NO: 630359 - DNA, 298 bp, Homo sapiens
cctgcctcagcctcccaagtagctgggactacaggcgtgtgccacctcgcccggctaattttttgtatttttggtagagacaggggtttcaccgtgttagccaggatggtctcgatttcctgacctcgtgatcacccgcctcggcctcccaaagtgctggattacagcaccgcgcccggcaccttacatgtctttaataatactctataaagcaatttgggattgacaaaatctgtataaaatttgaagtgatctaggcaaagtaccagatggatcatatggttggagatggcattca

SEQ ID NO: 630360 - DNA, 348 bp, Homo sapiens
agtagtggctcatgcctgtaatcccagcactttgggaggcccaggcaggcagatcacttgagctcaggggttccagaccaacctgggaaacataacaaaactccgtctctaccaaaaatacagaaaattagccaggcgtggtggcatgcatctgtagtcccaactactcagaaagctgaggtgagagaatcgcttgagcctggggggttgcagtgagctgagatcatgtcactgcactccagcctgggtgaagagtgagtccctgtctcattaccaaaatttagttaatattttataagcataaatttacatttagcttaatttgcgggggggaaggcaggtgtggtg

SEQ ID NO: 630361 - DNA, 117 bp, Homo sapiens
tgccagggcctgttatgaagcaggagaaaggagaaaggggacagacgttaacgtgttcaactaccatccttaccaccagaagctattcacaacttcgcagagtgtttcagaaataca

SEQ ID NO: 630362 - DNA, 354 bp, Homo sapiens
  misc_feature (29)..(29): n is a, c, g, or t
  misc_feature (79)..(79): n is a, c, g, or t
  misc_feature (145)..(145): n is a, c, g, or t
  misc_feature (221)..(221): n is a, c, g, or t
gatgggagtttcactcttgtctcccaggntgcagtgcaatggcgtgatctcggctccctgcaatctccacctcccaggntcaagccattctcctccatcagcctcccaagtagctgggattgcaggcatggccaccatgcctggntaaatttttttgtatttcagtagagacagggtttcgccatgttggtcaggctggtctcaaactcctgacctcaggngatccacccgcctcagcttcccaaagtgctgggattacaggcgtgacatacgttgcccggccggtgattcaggttcttactttgagcagattccatctattcaggtcactggtttataacatattaaagtatt

SEQ ID NO: 630363 - DNA, 693 bp, Homo sapiens
  misc_feature (16)..(16): n is a, c, g, or t
  misc_feature (116)..(116): n is a, c, g, or t
  misc_feature (168)..(168): n is a, c, g, or t
  misc_feature (180)..(182): n is a, c, g, or t
  misc_feature (185)..(185): n is a, c, g, or t
  misc_feature (193)..(193): n is a, c, g, or t
  misc_feature (202)..(202): n is a, c, g, or t
  misc_feature (207)..(207): n is a, c, g, or t
  misc_feature (214)..(214): n is a, c, g, or t
  misc_feature (217)..(217): n is a, c, g, or t
  misc_feature (222)..(223): n is a, c, g, or t
  misc_feature (230)..(231): n is a, c, g, or t
  misc_feature (249)..(249): n is a, c, g, or t
  misc_feature (264)..(264): n is a, c, g, or t
  misc_feature (270)..(270): n is a, c, g, or t
  misc_feature (277)..(277): n is a, c, g, or t
  misc_feature (280)..(283): n is a, c, g, or t
  misc_feature (286)..(286): n is a, c, g, or t
  misc_feature (289)..(289): n is a, c, g, or t
  misc_feature (329)..(329): n is a, c, g, or t
  misc_feature (340)..(340): n is a, c, g, or t
  misc_feature (343)..(343): n is a, c, g, or t
  misc_feature (361)..(362): n is a, c, g, or t
  misc_feature (368)..(368): n is a, c, g, or t
  misc_feature (386)..(386): n is a, c, g, or t
  misc_feature (398)..(398): n is a, c, g, or t
  misc_feature (451)..(451): n is a, c, g, or t
  misc_feature (466)..(466): n is a, c, g, or t
  misc_feature (486)..(486): n is a, c, g, or t
  misc_feature (503)..(503): n is a, c, g, or t
  misc_feature (536)..(536): n is a, c, g, or t
  misc_feature (545)..(545): n is a, c, g, or t
  misc_feature (692)..(692): n is a, c, g, or t
aacaaaacagaagaanaaacttattagaataaggccacctaggaatgttcttaacttttccattcagcttttggctgatatatgaaaatacaaataaatacatcctttccccaggngcaagggtaaaccagcagctccaagggcttggtctacagtgctcagaaaganacactgccttannngtnagggtagngggctaggnccggnggcctcngcnaatgnngccttgnnagtggtcagtggacaganacatagtatccagcnccaggncttgggnctnnnngcntcncagagtttcacaggtagggggcatgtgagggggggggtgngtacttctgtnggnggatggcggtagtacttnncagggnacagcctggacgaatgangccaaactttcngggcacagacaaatcaaccacagttgagccaaggcgacactcggggctctggncatccccaatttgtngccccatcaataaccaaggncaactgaggccagagantccttggaactcctcgacattcagagaactggnctgggagcngagggtgggactagtgagagcaagcggaccctcaaacatctgagccaagtcttgcataaaagcatgatcaggaatccgaatgcctacaagaggcgtaaaagggtttaggtccttgttgagctcctccgagcgttccatcaccagggng

SEQ ID NO: 630364 - DNA, 2129 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatcctaaaaaaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 630365 - DNA, 1949 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttcc

SEQ ID NO: 630366 - DNA, 347 bp, Homo sapiens
tcagagaacactataaacatctctacgcaaataaaccagaaaatctagaagaaatggacaaattcctggacacaaacaccctcccaaaactaaaccaggaagaagtcgaatccctgaacagaccaataacgagttccgaaattgagtcactaattaataacacaccagccaggaaagaaaaaaaaaaaaccggcccccacccggtttcactcccggttttttccaaccaaacaaacaaaagcgggtgccaacctttcttaaggaatccttaaaaaaaaaggaggggggggggttccttacttaatttattgaaccaagcatgttctttcttcaaacaaaattctggc

SEQ ID NO: 630367 - DNA, 393 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggctggacagtcaatgtggagggcagcggggagggccggcctggggcaggggcaggaggagagaagggaggccaccatggacagaagaggcccgcggccacaatggagctggagagaggggctgtaggcactggggcccaccc

SEQ ID NO: 630368 - DNA, 431 bp, Homo sapiens
cgtccgggcgctaggggttgggtggaggggactggccaagcttactggtgggttcgtaagaagaaatgaaatccagatgactcattcactccagattccaaagtccaacttggccaaggctggaaaaaaacatctcaggggcttcagcaaggggcaaataaattttaaaaaatgaagaaagcagcagttggcaatgaacccccagagaagagtcggagaactatattcattgggcagtgtttactagaactggaggaagggacaggctgagaagaggaggctgagttgcagggagtggtgggagtgatggaggctcatgtctgctagagagaaccttgcacatcccagggggaacatcctactacttgccctgagcacaacaggctcagctataaggcagcacatcaaaaccaagcagctgctcagggctc

SEQ ID NO: 630369 - DNA, 330 bp, Homo sapiens
gccgtccgccgcacggagagcccagccaccgccgcagagaccttcaaggtaaggacctttataattgaggtttggaggagattttgaccagcattcctcctccccgtcctccagcaattaccaattaagcctggaccttctcgccttatgatacctcatattgtaacccagaccttaaaatcctattctggggagaaaattctgggacctttccatacgcgcttttcctgattatcgggccacatggcagtggcaaatccattgttatggacttctatgctttgggtgttgggctatggagcacaaaattgaggtctaaacactttgagt

SEQ ID NO: 630370 - DNA, 1999 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatcctaaaaaaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 630371 - DNA, 2291 bp, Homo sapiens
ggcacgagggcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggacccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatcctaaaaaaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 630372 - DNA, 1214 bp, Homo sapiens
  misc_feature (63)..(63): n is a, c, g, or t
  misc_feature (155)..(155): n is a, c, g, or t
  misc_feature (177)..(177): n is a, c, g, or t
aggacccagagcctgaagtcgtaatcaagagcagaacttcgccccagaactgaaggcctcggncctagatttagattccgccccaggttcaaggccgggttcctagacccagagtccattcgcagagcccaaaacatcctcttcccgtgccccgncgcgcggacccttagccttgancgccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatcctaaaaaaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 630373 - DNA, 374 bp, Homo sapiens
  misc_feature (31)..(31): n is a, c, g, or t
  misc_feature (275)..(275): n is a, c, g, or t
  misc_feature (329)..(329): n is a, c, g, or t
gatcgagaccatcctggctaacacacggtgnaaaccttgtctctactaaaaaaatacaaaaacttagccgggtgtggtggcgtgtgcctctagtcccagctactgggcaggctgatgcaggagaatcacttgaatccaggaagcagaggctgcagtcaaccaagatagtgccactgcgctccagcctgggcaacagagcaagaccctgtctcaaatacaaaacaaaacaaaaaacagttggtagagagcttaggattttatttttcgtttacacnttggaatccaagaaaggagacagacaaagtgggtctcaaggatgagagcagggnaaaagctcgagataagagctgtgcagccgggtcagggaagcgatc

SEQ ID NO: 630374 - DNA, 194 bp, Homo sapiens
gcattcttggccggctcccgggctgcccgtttcccaggggcaactttttactggttgaaaatgggaagcaataattttcctttgccccgttttctcttaaagccctttccctgatgatgatgatggggccccattgttttttttttttccgtccctcctgataaataacaaatttggagaaataaaaatattta

SEQ ID NO: 630375 - DNA, 822 bp, Homo sapiens
  misc_feature (790)..(790): n is a, c, g, or t
ccaaagccccctaggttttttacccccacaggccacgttttgtcccgtgtgctgtatggcaccgggggttcccccagaccaattggagaattggggttttcccccaacgcccagcgcgttctcatcccccagagctgtcttctaactaggggggagatttaacattttctcgggggcgttctcacaacacaccggttatggaacacatccttttggtgccccccaacaccaggcgccagatgtttatacgcccacacaccccaacttggacccagagccccctaggtgggccaccccgggtgccatacccgtcgtgcaataaccaaaagcctgggatccaatagctgcgtcctgtgccaaccctcccacagatgtcccaccagacccaggaaccatattcccatagggcgcgtccataggccacatgcccacacatggcccctttgcccgtattttctggtccaagtgtttttaaaagtgttgtaagagactctctgaggaagacaccaccaggttatttgtaaagtagcgtctgtgagagcccacccatgccctcttgccctttgcctcttgggactgacccggaactgctctatgtgcgtgagagtgggagaccctttccttgcggccatggcttccgcgtgccccgtgtgctggtgcggttcccctcacgcagaccggaagggtgttgtgcgccctctgatccactggaacctctgtatcatgcggctgaattcccttttttccctttactccattaaagctacatccagactgataaacaagtaantactccgagcattagctcgggcgaaaagtata

SEQ ID NO: 630376 - DNA, 1157 bp, Homo sapiens
  misc_feature (63)..(63): n is a, c, g, or t
  misc_feature (155)..(155): n is a, c, g, or t
  misc_feature (177)..(177): n is a, c, g, or t
aggacccagagcctgaagtcgtaatcaagagcagaacttcgccccagaactgaaggcctcggncctagatttagattccgccccaggttcaaggccgggttcctagacccagagtccattcgcagagcccaaaacatcctcttcccgtgccccgncgcgcggacccttagccttgancgccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatcctaaaaaaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 630377 - DNA, 1576 bp, Homo sapiens
  misc_feature (233)..(233): n is a, c, g, or t
taaccaaatcccaaggggtgaaacccaagtcatttaatccaaataaggcccttcacaaggttatgtgtttgggggtagtgtagtatagtgtgtgtgtgtgcccctgtggggaacacagtgtgacagggtgggtgcaggaactaataaattacgtggtgacagggttagaaggaaacactctcccccaaaggctgtggcaggacacttatgtgtgcgcagccaactgtctcacnacgaacctcctcggcgaagttagaagtctaccagaggaacaggggcagggtgtggttcatcaaggctgtgcgcctgtgagacgcgcacaaggggtgtgctcccctccttatgagcctcaagaaacgccacaacaaaattgtgggtgagcaccagcgtggtgcggttgtggccacataacgagcatgtggcgcacatcaagggcaacaagacgcgagggagagaacatcctgagcagagtgcacacaaggagaggacacaagaaactcacaagggatcaccacgcgacacacactgacggaccacgtggaacagggaaaaaaacagaaaagaagactgacacaggaacaaacccacacgaaacaacatgagccaacaaaccccagcagcgcaccaagccaacatacatcagaaaccacagtgcgaactaacaaatatgtagcgcccacatctcacacaaaagagacgaccccaccaaccgacacacaaaaactatataacacacacaaaacctacgaacaaaaaatcaagagcatctacaggacaaccacgaaaggtaatcaccaacgcgaatatctaccagggggcaccacgagggagaacaaagcaaaccgtatgaaccaactgagaagacacaccacacacagagaggcgcgacgaaaaaaagaaacccacattacaaacatacatccccaccagagagagaagcaaacccacacgagaaaaaatcacacccccacatagaaaggaatcggcgagcccaccacccacacgcgcaaaggctacagagggaagatggaacaaagaaccgcgacgaaaaaagccccccaaacacaaacgagacacacacggaggataggccacaaacaatcataccgccaggaacatctccacaacacaaaactcaaaaggagtcaacaaaaaatcaccctcaacaagcatgaaaaaggaaacaaacacacacacaaaagcaggggctcaccacaacgcggtcaaacaaaacgacgaagaaccacccaacagaccgtggacgcacaaaccacacagactcgcgaacacaacaacggagaaaaacaaccagcataataagagtactcacaccaacataaatgaggacacaacccccaaacacgcgagccatcagcaacatacagaggagcgggcaccaaagcctacacgcaacgcatagcaagacagcacagcagtgccaaatcagcagcgcgccaacaagcacagaaaggacgaacgaaaaccacaacactaaaaaagctcagaccaacagaatacagcgccaaacacacagacaaaacaacagaacacggatattctccacttccacatccgt

SEQ ID NO: 630378 - DNA, 287 bp, Homo sapiens
cagtttcctaacagttccatttaggtgatagctgccagtctgtgctatcaaatcattaataatgagaagcaaagtcttaatttggagaaagaatgcttagtcaagggaataaatccgacaggaaataaagactttaaaatgaacaaagaaaatgaactagtgagaagcgggatcattaaagtgaaaattgcctgccctcagaataaatgagacaaaaattgacatgttatatcttttcctataatctattctttgttactgaaataaatccattccagctttgaaag

SEQ ID NO: 630379 - DNA, 278 bp, Homo sapiens
tagagaagaggagggatcagtttcagcttctacatatggctagccagtattcccagcaccatttattaaacagggaatcctttccccatttctgttcagattcttaattaatacttgaccttgggagtttggctatcttgaggtagtcttatgtgggttaaatctatttgatgttcagtaaccttcctgtacttgaatactgatatcgttctctagtttggggaagttctctgatattatctctttggagatttaatctgtccttccttctttctctt

SEQ ID NO: 630380 - DNA, 197 bp, Homo sapiens
  misc_feature (92)..(92): n is a, c, g, or t
  misc_feature (158)..(158): n is a, c, g, or t
gatcctaatggtgctgccctatttatacctgggtctgcattaaaagggaaagccccccctgttgtagatttcatctgcttcctccttagggnaggctgggatatgatgagagattccagcccaagcccggccccccaccgccaggccatagggcatantttgcatctcaaatctgaggaataaactgatgacctgtg

SEQ ID NO: 630381 - DNA, 360 bp, Homo sapiens
tcatggccggcattttcggtgcggcgaaagcggctgccgggtcatggcgcagcaggctgatcatgtacggctgcacgctggggcggaagatcacttgcagatccttgggcaccttgtcgtcggtcttgccggcttccaggctgctgatcagctcaaaactgcgcttgagcagggcaggcggcaggtgattgcgttgcagttgctcgcgcaacagcacgcccaccgggcgccctgtaccggcaatcgaaaccacgccggcagcaccgatttgtggggctgccaggctggcgatcattgcgccttcactgtgcccgagcacaaacaccttgccaaagcgcgggtcgcttttgagtttctcgc

SEQ ID NO: 630382 - DNA, 188 bp, Homo sapiens
gtttttttacccaggctggtcttgaactactggcttaagggatctcccacctggaactcccaaatggctggaattacaggcgtgagacaccgtaacaggcttttgtcaaaacctagactgattttctggggccaaattgtatgcataagcattctgaaatccctttttgggcctggggctctttgggt

SEQ ID NO: 630383 - DNA, 189 bp, Homo sapiens
aaggcaaccaaagtgcaggacattcaaaaacaacctgaaagagggcgatttgaacccatttgttggccgccattgaggcaaccctggttgccccccttggagcttggccaacccccgaggaacccagtttcagagttggattacaatcctgagtttgatgaacggtgcctcattttggactttccttcc

SEQ ID NO: 630384 - DNA, 496 bp, Homo sapiens
agatccctttccatcctttagaaaggcttgtctccttatttaaataaaatagtgtttgtctagtagttcagtgtgggggcaatcttggatggggattcttctactaatctttcagaaactttgtctgcgaacactctttaatggatcagatcatgatttgatcggaataacgaatgtatgtttaaggcaaggacacacaattttgattcttctataatgtgatgagcatataataattccgaggcacatggcaattgaggccctctaaattaggaataaattcacctcttatacaggtgggagattatgatcagagtaaaaggtaattttacattttattgcctgaaagttaggagtctatacattgacagtgattagagtaatactttatcacatttccactagtttgcatgttgactttaaatgtcttacaatcttagagtgataggcaatgttttacactattgaccttatttgcggatggccccggggatct

SEQ ID NO: 630385 - DNA, 176 bp, Homo sapiens
cgggccttgttaggtcgagtatgagacagttcaggtcctggagagaaggctgggaggcaggagctgagtctaaagaggccattgtaacgatagagctagtagcctgtaggagcgctgttgatagagagcagtagacctcaatctgcggagagctgccgtagacgtaaaggtatagg

SEQ ID NO: 630386 - DNA, 193 bp, Homo sapiens
cccaaaagggttttccccccccccgggcctttaaataaattgggttttccccaccaaggggccttttttttttttccccttggaaacaaaaacctccaattttaagttgggtggggccccccccaactttttcccccttttttatttttttttttttttccccccccccctttaaaaaaaatttttttttcca

SEQ ID NO: 630387 - DNA, 850 bp, Homo sapiens
  misc_feature (21)..(21): n is a, c, g, or t
  misc_feature (61)..(61): n is a, c, g, or t
  misc_feature (70)..(71): n is a, c, g, or t
  misc_feature (80)..(80): n is a, c, g, or t
  misc_feature (88)..(89): n is a, c, g, or t
  misc_feature (91)..(91): n is a, c, g, or t
  misc_feature (93)..(93): n is a, c, g, or t
  misc_feature (144)..(144): n is a, c, g, or t
  misc_feature (160)..(160): n is a, c, g, or t
  misc_feature (185)..(185): n is a, c, g, or t
  misc_feature (199)..(199): n is a, c, g, or t
  misc_feature (213)..(213): n is a, c, g, or t
  misc_feature (217)..(217): n is a, c, g, or t
  misc_feature (232)..(232): n is a, c, g, or t
  misc_feature (239)..(239): n is a, c, g, or t
  misc_feature (254)..(254): n is a, c, g, or t
  misc_feature (293)..(293): n is a, c, g, or t
  misc_feature (300)..(300): n is a, c, g, or t
  misc_feature (362)..(362): n is a, c, g, or t
  misc_feature (392)..(392): n is a, c, g, or t
  misc_feature (459)..(459): n is a, c, g, or t
  misc_feature (551)..(551): n is a, c, g, or t
  misc_feature (783)..(783): n is a, c, g, or t
ggggcaagaatcaagtcgggncggcaggggcacaggcagcaggcaagaaagaaggggggcnggggccagnncccacaganccctcagnncncngccccagggcagcatggcagagggaccagccgacgggcctgagccggaccngcgcggagggggggangcccggcctcccggccgggcaccgngggggaaggggggngggaaggcatgggnaggnccggcaataggagcngaaaganccctgggcccaaggnggaggcggggcaggggcagggctggggctcaggcgtccncaagagnccacagagaaaagacgcaagaaaaagtcagacgaggcctatagcaaacccactcggtccgcnacaaagaacatgagaggagggcggcttagnggcaaaggggctttaggcgcaggcccggggccgaggaccaggagaaggggccgccggaggaggcggnggatgcggctggggctgtctggcacggggaccttcgtggccagccacgtggccttgggacgcccgcgtccagccagggctgaggacccaggncagagcccctcccgcccagcacccgcgacgccagcctggatgctggggtcactaagtgaggtactcgttggttccctggatgggccaccctttctgccctgggaggaggctctggggtgtgcaggagggagccagctaacaggtcagtgttctgggcagaagtggggcacgaataacacaggccctgaggacacagggacacaggtgacacgggccttaaaagtggcttgtnacatgagctacccagggccctgaaaaggggtgacctgaagacagaggttcccaggtggggtgaggga

SEQ ID NO: 630388 - DNA, 500 bp, Homo sapiens
  misc_feature (30)..(30): n is a, c, g, or t
  misc_feature (68)..(68): n is a, c, g, or t
  misc_feature (165)..(165): n is a, c, g, or t
  misc_feature (188)..(188): n is a, c, g, or t
  misc_feature (190)..(190): n is a, c, g, or t
  misc_feature (199)..(199): n is a, c, g, or t
  misc_feature (221)..(221): n is a, c, g, or t
gcccaaccggctgaagcggtagcggtaccntgaagctggattggctcagttcgtgaggttgctgcttncccattcggttctgacctcgatgctgccctcaacacgagtcgtggctgcgtctaactgagttgctgagcaggacgtattctccctggctattgagancaagtggctgttatctatgcggnantaggggatntcttgataaatggagcccgcanacaagtttgagatgctttcttgtctctgtcgtcagccgcaccagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcat

SEQ ID NO: 630389 - DNA, 1651 bp, Homo sapiens
  misc_feature (721)..(721): n is a, c, g, or t
  misc_feature (942)..(942): n is a, c, g, or t
gcctgcttctctaccgtctccaagctcagtaccttcgagcctatggctatgctcacccgtgtgtatcagggccgaattgagaccttctctcgctggtactatcttctcaacacaagtagcgtcccggcacggtgcaggggtgaccaccatgacatgagcctcatgtagcaacgcaatgtgaggcctttgacaggcgagtcatgaatctccatacaaggagacatcagcccactcttgagacatacgcacaggcctagccatgcgaaatcgccattgcaaacactcttgcctaaacgagtctagcactgggcacacgaacctcttgtgaagccctgcgtacaacacaagtgcagccctacgtgtacgtgatcggtaaatcgtataccccacgcgcacgttcactcgctactaaccctctacactcggcgcgggtgcgcttcttgagcctttctagaactccttaagcgaactttgcacatgactctcttactatacgggagccctcgaacacatactttaaagattcatggagggcacaggtatttgagcatgcaaacaaatcccccttccttggagtgcgagctgccccctgcaatgccctgtaatgcatacaaacattctacccacggctgcggcgctgcgcgccctgaaaaccttcgcgttaacgccacaacaataatgacacgctatggttcatggttttgtaggggccctaccaaanaacattattttaataaccataccaccataacatgttaacacgaaatacaaaacaccacatcacgttcccgcgaagggtgcaccaattattccttaaagttgtatatacttggcggaagaagtcggactcgtgacccgtgaacaacttgaacgaagggcgttcgtcacaaactttggccacccattattgtgggaggagccaccccctaaatcgtttgggcngctaatcccaacattcaagttgttccattgtgcgtaatcaaacaacccgtgagaggaaagcaccgccaaaagaccaattttccttccttttgtggagagttattccaacacattcacggctgtgggggccctcacaagaaaacattaacttggggagccgccggcgggtttggcttgtcccccccaattttaattaaatggacgtgtgagacaggtttcgcggaaattaacccttttcacacaaatttctaatcccctagaaaattccaaggggaacccaccacaaggcgagattttcaccgggcaccatggggcgcccacatcttatactgaacctgtttcttgggggcggggcacgacaagaacagaggcgcggggcggaaaaggtttacgccggaaaaaacctattaaaggggttacctttccaaatgggggcctttttccaaaaaagccaaattttccgggaagaatttaaacctggcgccccggggcagtggggggcgctcgccccgcaatttattgcccggggccccccctttagaattatatcccttctttcccacagttaaacagcgagcgcgcgagagaaaagttttacacaccaatgccgcgagagagacgaaccgccagtcgttcaaactctttttaactttcacacttttacaaaagatgtccgaaacaccacgcgttttcctatagtcgccaaagg

SEQ ID NO: 630390 - DNA, 252 bp, Homo sapiens
ggatggcgaggaccattttcaggacactgagcttgtggggaccatttcagcaggagatagaaccttccagaagtgggcagctgtggtggtgccttctggagaggagcagagatacacatgccatgtacagcatgaggggctgccgaagcccctcaccctgagatgggagccatcttcccagtccaccgtccccatcgagggcatagttgctggcctggctgtcctagcagttgcggtcatcggagctgtgac

SEQ ID NO: 630391 - DNA, 405 bp, Homo sapiens
  misc_feature (405)..(405): n is a, c, g, or t
cgctctagaggatacaacttatgctctgacccacccatagagtgagactctgtctcaaaaaaggaaagaaaaataggctgggcacagtgactcatgcctgtaatcccaacactttgggaggccgaggcaggtggatcacgaggtcaggagttcaagaccagcctggccaagatggtaaaacctcgtctctactaaaaatacaaaaattagccaggtgtggtggcaggctcctgtaatcccagctactcaggaggctgaggcagagaattgcttgaacccaggaggcagagtttgcagtgagccaagatcacaccactgcactccagcttggacgacagagcgagactctgtctcaaaaataataggccaggcatggtggctcaaggtctgtaatcccagcacttn

SEQ ID NO: 630392 - DNA, 488 bp, Homo sapiens
  misc_feature (92)..(92): n is a, c, g, or t
  misc_feature (147)..(147): n is a, c, g, or t
taagaggtatgtgctgccaacccatgcatgtcttccccatccccataggattataaagtgttcaggtaccaaacacagttctgtgtgaggtnttatgcctacttcctcaacaccaattcagaggcaacacctgtgcatctgtcccancaaaggtgctttaatacctaccttcactatttgagaaaggacactcacagttgcctgtgggttatgaaaattggcctacgtcctgcatgaagatgttacaggaattgggcagatatataagagagtctattgccaagcctgactaacttcggaatgaaataaggacttgcccagcataggctataggagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataatagg

SEQ ID NO: 630393 - DNA, 157 bp, Homo sapiens
tctagaggatctctgtgctcgtacgggataatctatttattaactcagaagttttttcttcgcaggatttttctgagccttttaaccacctccagctagccctacccccaataagaggcactgcccccaaacaggcatcaactcgctagatttcgta

SEQ ID NO: 630394 - DNA, 536 bp, Homo sapiens
tcgagtcggaccctgatgcttggtgtgacctgatcaatgtccaggccttcagagaggctagaacccacagcggggatgaggaggttagcctctctgaagccctggacttgatcgagtcggaccctgatgcttggtgtgacctgagtaaattgactccctgagaaccatctgcggagttgacagtatcaaaacagcctatgcaatgcaagcgtcacgatcagcagcaagtcctgccacccccgtcaagacttccgcgcctgtgtgcccagtgtgaccgagtaccggctggatggcacaccaaactacagaccgtgagccggagcagccggggcgagctagatccccatactccgcccagcactgaagtcgggggctctggacattggcacaccgcacctctgtgctcaagcggcagagtgaagaggcgtgaggctctagacccactgtcactgagaatagcaccagtacgagtccttcccatgggattcctgtaaacatgactacacgccccaagagcacagctgtttaaggaccct

SEQ ID NO: 630395 - DNA, 497 bp, Homo sapiens
gcgcccgcgtttgtgtccccctgcgcagggagggcttcttttccggcccccatcgggttggcccccagtcacgggcctacccccgtttctcgtgtgctccccccgctgctgtgccactttacaagaccctggtgggggatgtgtgttctatcagtgtgtcgcctcctgcagtgcaagtctcggttttctcggcccctcacggggtcctcgcctggttggcaggcgccgacttttgtccgcgggtctccccaaagtgggcgttgtgggccgccgtctgggtgcagaagtatccttcaggcgtgcctgggctctcatagtggagctcccacaggcgtcaagtatgtccttcttgtagacttgctcctccctccgtacggcccgagcccttgtggtccacccccgtcgggcccgacgcgcttgtgagagcctgaggggggggctttcccctccaacgctggcccctctcggcccaccggggcacccccttcccaaaaaac

SEQ ID NO: 630396 - DNA, 109 bp, Homo sapiens
gggacactaagctttggttgatcttctcatggagtgtgtagtgatgtctctgtattcctgaatttgatattggcctgcttgcaaggttggggaagtctcctgccagaaa

SEQ ID NO: 630397 - DNA, 241 bp, Homo sapiens
  misc_feature (180)..(180): n is a, c, g, or t
ggaattccaaaaaaacccgatcagccacaagtgctgatgagctaaataacaacgtggaagctgtttcccagacctactctaattgatttagtacatgcatttgctgacagccttgtgccaaaagaggcagacgcaagtaaaagataatgcaaacgcagtccatgagtgctcctaagcatngagaaggtgtcgatcacacgcagatcagattgtgattcttactccaacaccaggccgcaaa

SEQ ID NO: 630398 - DNA, 99 bp, Homo sapiens
taggtggtggttcttcaggagtgcgtggcttcaagtcccctaaaggaaagaaaaaaccaggtccggacccctatttgtcagtggccttcctctggatat

SEQ ID NO: 630399 - DNA, 147 bp, Homo sapiens
cttctggttgacttagaggatccgtctagcctcgccacgtgtggtgacccatctctactaaaaatacaaaaatcagccaggcgtggtggcacacctgtagtcccagccactggcgcggctgggacacactggcgaggctaggacagc

SEQ ID NO: 630400 - DNA, 360 bp, Homo sapiens
ggccttgggcccttttggtcccgttcccccgtagggtgggcaggctataatttgcctccttttggcccctgtgaatccagatgttttgccggtttttccctttgcggccgggcttttggctgtttcccaatggaacctggagggggtttttttttgggtttttagccggtttggcggccccccggggggatgtcttccttttgctcctggttcccagggtccgcctgggtgccttgggggcttggtcccctttgtttggttttttttttttgcttgcccaaagtggctttttttcccaaggattttaaatgtttgaatcccaatccttgaaattaaatgggttaacttccaacctttcca

SEQ ID NO: 630401 - DNA, 285 bp, Homo sapiens
tagtctattagctacccctagaagaaagaatgaccccttacacacaacaacacagcatacatgtactaggtgggggaagtggaggacagatagtagttcatacaatacccgcacccaataccttaaatctaacaccaacagctgcacccctaggtatacccccatgagcagcttagggtagagccagccctgcatactcgcacacagtaggaaacccaggccagggcgcacagctgcgcctgcaaactcccagccacctaatggggcaggccgcacgccagcgcc

SEQ ID NO: 630402 - DNA, 500 bp, Homo sapiens
caggtcgacaacagaagacaggacaggaaggcgaggtgatcctgggaggctggagagcttgtcaaggacacagacccacggtgtattgccgccccctagggtccaaactctttcctggacatctgcatgcaatgtcgacacgccctccattgtctgtggcgggcaaaggatttttattcacccccagacctttcgatcctgtgctgaaagtgtccctcagcctgtttccttgaaaaacccaagggctttgagcttattactcttgctgtctcttggggcccacgcggtcaagcttcaactaccgtatccctcattgaagggcgacctcttgttcttttcttcctggcccgtggcgctcaggcggggggcttccggcccccttctttgtctagtgagaggcttatagcctccctgatgctccgcgggggtgcggttttcttctttggccgtagcgcgtaccacctctacaacagtgggggagaagagatgttcttcacata

SEQ ID NO: 630403 - DNA, 365 bp, Homo sapiens
tcgtgcccactctcatattcatatattaaaatagtaaaccccaggttgatgatataggaggtaggggacctccatgaagtgattatgacagaaggttatagccctcagctaactggattagtgcccttacagaaggagggttagcttgctccttccaccatgtaaggatcacagcagaaggcaccatccgtgaggacagcatgtccctccagacaccaaatcttgcttgtgctgccttatcttggacttagctgccttccagaacagtgagaaattaaactttctgttgtttattaatgccacccatcccaactaagacattcgggaccaggctggtaaaagagactgtgtggcaagagtataga

SEQ ID NO: 630404 - DNA, 388 bp, Homo sapiens
atcttgctaccatccctctggaactgattatccaagacatacatgtgcagatttctgttcacctaagaattaaaaatagctaatagagtatggcacttgccaaaaaaaattcagttgatcctcacaacttgctgggtaggtattagcattatgattgagtcacattgtacgtgaaaacttgttttgaaagtcaaaagaaaagggggagaacctcatccctcaaagtacccataatgacctatatctaccgagagtgtataccacccagtagaagaactcctacacacctgaaagttgcagtacactaaggtagcgtcatggaagaaacaagaagaaaatgtatatatggatgtctgagatattcaaacaattctgggtagaaattgga

SEQ ID NO: 630405 - DNA, 203 bp, Homo sapiens
ctcgacgggctgctggctcccacggacatcccaccccacggacccaacatcctcgtacctgacctgaatgttgacccctttacctagacctcgttggaccacagttatcacgtggactgagaccaataacgccgttcagaccggcacgatgctcccacacgggtgcacctcttcgtccatcacatgagcatggagaaggttcc

SEQ ID NO: 630406 - DNA, 530 bp, Homo sapiens
ccctatgtctcgatcgctactgctatactacaaaatgcttcagttctcaatccattaatagctcacttttgatttcaatttattatttgtatttcaacaatcttttttttttttggggaaggaagtttggctctggtggcccaggtggaagtgcaagggcgcaatttgggttcatggcaatttcggcctccggggtcacaagcagattctccggcctcagcctctggagtagcgggaataacgggtgcccactcccaggctcagtgggtgcagtcggaagctagagtgaaaatgccgggggcctcagtagaaagtctctggcagggcctcgggtcacacccttaggggtaacggttccagtggggtgcagacaggccctgggacagggcgctggatgggttggggatgggatcaccgatcacagggggaccacaacttatgcacagagttcccagggcagattcaccatgaccaaagacacttccagggacacggtctacagggagctgaaaggctaggatctaccggat

SEQ ID NO: 630407 - DNA, 483 bp, Homo sapiens
acctcgcgccagccactcgaggacatttgaagggaaaacggtgaaagcttcgttgtcctatttgcaagttatcactcgcccatccttttccctggtccaccaggttacattgtcttaactctgcccttgacagcctcaggtctaaacacactaaccctctagactatgttgcctaactcaactaacacttattagactagaactgatcttatcaaatgcatgttacaccattcatctagtctctcattcacttttataatttccctccctcccccaaataattctttttttttttggagaacttatttttactcttgtggcccaagcctggagttgcaatgtggcgcattctcctcagctctcaccgcaaccctcgtgcctcccgggtttcaagcgatttctcctgccttcagccctccttaattagctggaatttacgggcattccccacacacccccgggttatttttgaggtttttacag

SEQ ID NO: 630408 - DNA, 295 bp, Homo sapiens
tctcatcctcttatggggcctgtcaacggtacgcagtgtctagcgagctcagagacagaaactcccgtgagcagaggcaagtcgctgtcttgatttcagtacgatacgacgtgaagcgggctcacgatcttctgagcttttggtttagcaggagtgtcgaaaagtacacaggatactggttggtgcggcaagcggtcatacgacgtccttttgatccttcatgtcggtcttcctatatgtgaagcaaattcacaagcgttgattgttcaccactaataggaggatgagcatggta

SEQ ID NO: 630409 - DNA, 499 bp, Homo sapiens
ccggagacggtagtctcaatctatgagggattttggcaatcctgagtcagggttctttcatatgccaataagtaagggttccatagggcccggggggtgggctcacacacgtgtaatcctagcacttgggaggccaaggcaggatgacggttggagcccaggagttggagaacaagtccgggcaaaatagtgagacctggtctctacaaaaaataaccagccaggggtggtggtacatgccggtggtcccagctactcgggaggcagagggggagggatcactggaggcgggaaagctcagggttatagtgagcagagatggtaccaccatactccagcccggtgacagagcgagacacggtctcaaacaaccaaaaaagtaacggtccattagcttcagacaagattatatgttgccggccagggggcaaggtttaccccatttagctcttagctcacggccaaacccaaatgacacatgaattcatcctcggaaata

SEQ ID NO: 630410 - DNA, 518 bp, Homo sapiens
  misc_feature (355)..(355): n is a, c, g, or t
gacagtgaatctgatgacagcaaatcaaagaagaaaacgagatgctgcctgacaaactcaagaggatttggccaggaggggtctgtgaatcctgacaagaactaattgggtggccacatgacatgcagtggacgacattgactggtttctcaatgaaaactggaacagattcaagcattgggagcgtcagaaaacttgtgggtggtcctgggggcggaaataggcaagggggccaaaaattatttgaaacaggtgggttcctttcgaaaaaatttgggttaacactgtgggcgcttattttttacattgggcaaaagggcagggaaggaaacatttaaaaacactttggggggtncaattttcttttttgggtgtccccaagtggaaaaagggaattagaacaagcggccttccaaaattaaaaactttgggtttttccaaaaaaattttggggtttaccctattttttatataaatttaagtttaattaaattttttctaaaattaactttacttaa

SEQ ID NO: 630411 - DNA, 416 bp, Homo sapiens
gtcatgcataccatttagtggctagtatggtatgtacgcaaggcatgagtcaggcttctgtactaccctctgatcccaggagacagggcaggcaagaaggagagcgcaggtggaagctacctcataatgggaaaattgtgggagctggaagaggtagggggagacccagccatcctgtactgacttctagcaatttcttctgccctcagtcatgaggggctccctatcctcccatcctatggtcccaggtgcagcaatgagagaggggaagagaagagagaaaggaagacaagtgggtgccaggtgaaggcatctctgctctgcatagctatttggccctggccatgactacaagcaaaagtgggtgcagatggctgggccaagggctgtggtatggagtggatactcagtaggca

SEQ ID NO: 630412 - DNA, 413 bp, Homo sapiens
gaaaattcttaagcagtaaaaatccatgagcatgtccacccattactgaacagttctgtttctgcaggtcatctggggtctaaatcatcttctcctggatcatctgtttctctcttcctctttacaccttccccaccttcttcctcctcttaatcctcatcctcatcttcatcttcttcatcaagttccaaatttcttcttcctcctcatgtgacttcagtcgtcgtcctcatccctttctacattttcatcttcatcatcttcttcatcaaactccttctttttcaccatcctcatcgtccttcgttcttcctcatcttctcctttcttcgtccttcctcctctttatccacaccatccacctcggcattctgagtcaggtgctccctggtcctctcggtcatagccatacg

SEQ ID NO: 630413 - DNA, 83 bp, Homo sapiens
ggagggcccttgggccccccccggggttttttcctttttttggggtgttattaatcccttccccaggggccctcttgggttta

SEQ ID NO: 630414 - DNA, 140 bp, Homo sapiens
tacgaggagtttctctaagccatccagtgccatcctcgtcgctgtagcgacacatgctctcgctgccgccatgattgagcagatgacccttcgttgtatcctcaagggccataacggctgggtaacccagatcgctatta

SEQ ID NO: 630415 - DNA, 210 bp, Homo sapiens
atgatgtatgccttcagatgatcaagaagaaaaagagtgcaactaggtaactaaatatatatgacctgaataaaaacagtctactcactgacttataccataatatataagaagctggagcttcacacatgtgaccatttcaagttgaatactacaagtctgtataactgaaggctaggggtaaggagtcagggagacggaagcccttgt

SEQ ID NO: 630416 - DNA, 202 bp, Homo sapiens
  misc_feature (157)..(157): n is a, c, g, or t
gtgctggtcgtccaggttagtatggtggcatgttcgtaatagtgtaatcagactatagcagaaaatgtcggttctttatctaaggcttgaattgtaaagtgaggctaagttacaacattagtaactcttaaaatggacacaggttttaaagctattntttttccttcctaactctctgaatttttcacatggccactcaata

SEQ ID NO: 630417 - DNA, 202 bp, Homo sapiens
aataccgcgtgtccaaaccaaactcagtatctttgccataaaacctcaatcctcctcacactactttcttctcacgcttcccacgtaatttccctactgacatgtcgacttcttccttctccaacgcctcctatatttgatgacggatcaaattatgttaccttattttttaaggtatctcttaaattcccctttcttcttt

SEQ ID NO: 630418 - DNA, 209 bp, Homo sapiens
gttgttgtatttaagactcctcagcacatggaagatcaatcgcgtaaagatatggaagaggaagatgtcatattacagccagagaaaaatgattctatttcaaaatatgcagccacgatgagcccaaggttcttaatgaagtgtctaacggtaacgcatcatgttggttagatcatatagagtctttggagtattagtaaaagagattt

SEQ ID NO: 630419 - DNA, 619 bp, Homo sapiens
  misc_feature (468)..(468): n is a, c, g, or t
  misc_feature (565)..(565): n is a, c, g, or t
tggccggggaagcaattcgttaataatatatctaatctattgggagactgaggcgggtgggtcacctgagatcaggagttcgagaccagcctggccaacatggcaaaactccgtctctactaaaaatacaaaaattcgccgggcatggtggtgcattcctgtattcccaggtactcggaaggctgaggcaggagaatcacctgaactccagaggtggaggttgcagtgagtcaggatcgcagcactacactccagcctgggtgacagagtgagactccatctcaaaaaaaaaaaaaaattaaaaaattaaattaaaagcgggccgggcgcattggttcagggccgggcacggtggctcaagcctgtaatcccagcactttgggaggccgaggcaggcggatcacgaggtcaggagatcaagaccatcctggctaatgtggtgaaacccggtctctactaacaatacanttagctggatgtggtggcaggtgcctgtggtcccagctattccagaggctgaggcaggagaatcacttgaacctgcgaggcagaggtttcagtgagntcagatcatgccactgcacttcagcctgggtgacagagcgagattctatctcac

SEQ ID NO: 630420 - DNA, 212 bp, Homo sapiens
  misc_feature (38)..(38): n is a, c, g, or t
  misc_feature (50)..(50): n is a, c, g, or t
ggacgctgatgctgcggtcgtctctgaggatccccagntccacaccttgncgtatacttgtccgggccttctgcagcatctcaaatcagacacataaagtcatcttttttttttttttttttttttttttttttttttttttttttttttttttttttttttttcccaaatacccgggggggggggtttttcccccaaaggaaggggggaaa

SEQ ID NO: 630421 - DNA, 1733 bp, Homo sapiens
ccgtgtgtgtggcgtcgtgtgcgtcgtcgcgcttctctctgctttgttagcgtcgtgagttgactcttgtttctcgtggtggcgtgtggctccgtggggcgctggttgggtgcggctcattgtgcgcgccgttgtgtctaccggtagcgcgcgggttggtcgacgctcgcgcgagttgttcccgcgtgcgttttggtcttggacatcccgcgtgcgtggcacaattggccggtggtgtgactgacctccccggggatagtgggggtttggcgccgcttactatggctggtggcagacccatcagtgggcgttttttctcgggcggctctgcacctccgtgggggccgcgtctgctccacttgttgtggaagtagaacgcctgtgttttttactgggggcgggttgttgacgtatcgggcctgattcttgttggggcgcgctcttgggggggtgtatgatccgccgctagtaagggtggtgtcctcctctagtagcccgcggggggggaagcgtagtaactatccaaacgttgatgcacccacattggttgttgtgggtgtaaacccaccgtggtgtgtccaagatatgtgtgtcgttgcgtataatttcttctctcttttttggcgcctgagcaagatttggccacaacatgttctgtggggggcgcccaacattcgttcctgaaccgcccttgcgttccgtttttggggatcccccgccccattttgttggtgaaaacagtttgggaaaccccgcacttctcttggggggtaattatttctcgcagaaaggttatgctccaccttttggggcccccctcttggagaggaagagaggaaagaagccactcgggcgcttgtctgagcacacagctggggctaacaacagtgtctctttagagaggggtttcacctcgagagagattagagaggagagatcgggcgctcttcttaagagatggggcgcaaaagtttcacgccgtcgcccgcacagccgcacgcgggccaacactctgtgttgcctctgagaactcttgcgcactcgttttgtgtgggccccaactgctatggctgtggcccgctcttatagaaacgcgtgttatacgacacgcgcacacacatctgtggaggagagggccgctcttatatttgtcgtagcccacaaatggcacagcgcgcttgtgtgttttccgcgcgttgctgccctctgttctgtgtgccgcagcacatcgtgtttgggtgtagaaatatatacggcgtgtgcgctccccacatatagacccgtcgagaaacctcgtgtgtgcgcggagcactttccaccgcacacattacacgcagcattatatgctagactctctcttctcggagagagatatagagaagaagtgtcctcgtgtttctctctctcgagagagagagatataccgctgtatactctctctctcccctctgggagaatatctcgctggagatattgtagaagagatgggctctcctcggcctcttctccaccgctgggaaatcacgtgaaagtgtttatgaaaactgctgccccacgagccaacccacgagctccacgcttggggtgggtcacgtaaggaggaggcacacctttcacagaagggagaagaagccacttctccaccacgagattcgcaccccacactatactttcaggatgaaattcttctttctgcccctcttttggggataaatattttccttccctttcca

SEQ ID NO: 630422 - DNA, 815 bp, Homo sapiens
agcgagatcgcaccattgcactccagtctggcaacagagtgagattccgtctcaaaaaaaaaaggaaagggaaaaaaatatagatatacctcttccttgtctcaaccggccatgaaattctgaacatctccaaattcagtggaattaagtccaagaacaaattttataggtataaacatagtttaccttcttatagtaatagtatacttaaaaaagcctcagggtatatatcttctaaacggctacaatccagggcagtacatttaacccaattatgtctctagttggagaacaacttagggcctattttcaactggtgtgtgtaagcctcaggtggcctaacattggtgccaaaataaaatatccgtaggaattaccctggaatttgtaaaaacccattcgttttgtgttatacactttggccaaaaattctcaaagagggctctggtattatatggtaattctttggaaaattataatttaattgagattctcagtaattgacgtggctggggtgtgaactatagtaacattaagtaccttcattatttataagaaacgttcaaaataatgtgactttggatttttacaccagaaatccttcctctttttcttacacagtgcattttttttaacaaaatccattgtgggtaatctcctaaataggttaatatttaaagtggttctagaaaccaatgtttcaaatatttgtgtgcttatcggaataattggtataatatttccaaacaatttcataatttccaagacaattttgacggagattttgcagggagtgaacttcaattggggtttaa

SEQ ID NO: 630423 - DNA, 219 bp, Homo sapiens
gcctactactactaaattaacggccggtcgacggagttcaaaactgcagtgggctatgattgcaccactgtactccagcctaggtgacacagtgagaccctgtttctaaaaataataaatttattggcggggtgtggtggctcatacccataattccagccctttgggaggccaaggcaggaggatctcttgaggctgagagttcgaaaccaacctatt

SEQ ID NO: 630424 - DNA, 144 bp, Homo sapiens
ggatttgctggtgcagtacaactaggcttaatagggactcgaattcgagcctcgaattcgaggctcgaattcgaggtgcaaaacacccccttagggtgcctcctgcgcaacctcccaactttacaactcgaccaagatttaaaa

SEQ ID NO: 630425 - DNA, 396 bp, Homo sapiens
cggcagttccaagttaccagcgcaggcaagttgtcacacaaccgttcccgtgggccccgtggtggttttcccgggggccggggttttttccttgggggccaaggaaggggccgtgggttttttaaaggaggaggggccccaggttttggggggacccggttttattccaggagtggggggtcggggggttccaaagatttttataccacccggggtcaaagtggtggttccagtgcccggggttggggggggtcctacaaaaacagtttcgccggtttcgtttcccccaaggggtaaaaccccttcctgtttaagtttgtccttccaaggggtgggtgtttaaaatttttgggggttttgttgaaggtttttttgtggtaaatgcccccccttgta

SEQ ID NO: 630426 - DNA, 437 bp, Homo sapiens
  misc_feature (2)..(2): n is a, c, g, or t
  misc_feature (18)..(18): n is a, c, g, or t
  misc_feature (26)..(26): n is a, c, g, or t
  misc_feature (82)..(82): n is a, c, g, or t
  misc_feature (87)..(89): n is a, c, g, or t
  misc_feature (138)..(138): n is a, c, g, or t
  misc_feature (236)..(236): n is a, c, g, or t
  misc_feature (239)..(239): n is a, c, g, or t
  misc_feature (265)..(265): n is a, c, g, or t
  misc_feature (267)..(267): n is a, c, g, or t
  misc_feature (286)..(287): n is a, c, g, or t
  misc_feature (313)..(313): n is a, c, g, or t
  misc_feature (323)..(323): n is a, c, g, or t
  misc_feature (329)..(329): n is a, c, g, or t
  misc_feature (417)..(417): n is a, c, g, or t
gntaaaaacgcaccagcngacactgntgccggagaagctgtcacacaagctgctggaggctttccataaccagggccccgtnatcannnggaagcatgacttgcacaagatggcagagcgccaaccgtgcgcctgtgncccactcaccgctggtgcgtagagctctccaggaggagcccagggccctctgccgcaagaaacagtgtgattcactgccacgctgtaaaactacctgngcngttaaggatgtagttcctttgtaagngntgggcaggcctcgtaagannatgtagcagcatattcactatccgtnaatccttctntctttnaggctggaacttgctctctctgcccctatttccttgtaagagggagcacattgacttgggaatttcctccaggaaactcagggctgtntctcttcccttaggttgggg

SEQ ID NO: 630427 - DNA, 235 bp, Homo sapiens
ttatactgtggtgtaccgtacagcaatgcagatctgagcgcatctgcaacttacaacacagctcatagcaatgcagatccttaacccactgagcaaggccagggattgaacccacatcctcacggatacgagtccagttcattagccactgagccaggacgggaactcctgccttctcatgttttatggtattttatatattccccctttatatctaacctctactcctattccc

SEQ ID NO: 630428 - DNA, 315 bp, Homo sapiens
  misc_feature (4)..(4): n is a, c, g, or t
  misc_feature (84)..(84): n is a, c, g, or t
  misc_feature (115)..(115): n is a, c, g, or t
  misc_feature (130)..(130): n is a, c, g, or t
  misc_feature (149)..(149): n is a, c, g, or t
  misc_feature (158)..(158): n is a, c, g, or t
  misc_feature (250)..(250): n is a, c, g, or t
  misc_feature (252)..(252): n is a, c, g, or t
  misc_feature (279)..(279): n is a, c, g, or t
tttntatttaataaaaaaaaaaaaaataaaattaaaagaggagaaaaaatagaaaaatagaaagaaaaattaaagtataaaaanaggggatgaaaatataattaatttaaaaaanaaataaaaaaaatanataaagtaaaaaaatatanatatatttnaagtaaaaaaaaaaatattgaaacaaaaaaaattaaatattgaaagtaaaatatgtatgtaaaaaaagaattgaaattttaaaattaaggtntnggaaagtaaaagtaatagtaaggattnaaaaaagggggggtgaaaaaaacgaaaaaaaaaata

SEQ ID NO: 630429 - DNA, 328 bp, Homo sapiens
accttaaaaacaccttgggttagtagacttctcaagattttagaacatagcaggctaaaagaggaagcatttttgcatttattcaggataagtcatatattctgctgtaactcaactcttttaccagcctaataggggagtatattaaagcttagattgtaattattgatttaaaaaatttatttttgaatgctttgttttttactgattaacttagacattttcaagtttctggactacattcagatttgcatgcctaatagcatttgtgtatttcagtataactttcatctttaaaatatatctcatccccttctgtcgtcttctc

SEQ ID NO: 630430 - DNA, 678 bp, Homo sapiens
  misc_feature (130)..(130): n is a, c, g, or t
cgggcgggaagccccgagcaacatttttcacccgggcaccgccgagcaggccgagagggaccccaagaccgtgcaggaccccaccccccgagacgctatatttttccggcaagagatgcaagaaaaaacnggaaaccactggctgaccagatcaacgggagaaacgaagagccgagccgccgaaacgacgacccggaagagaatatcggggacctcatgacagaggcgggagaggaagaaccgggaagcgcaaacaagatacctgccacccaaaacagtaggaggccgctcataagtgacactggaaggtgagatttatccaaggcagcagaagaccgaaagggctctgagcagccaacgaccgtgaaaaaacaggccaatacaaaaaagaatgcaccctcagaacccagcaaacaaccacgggcgaagagacaggcagccccaagcaggatcaacacggtgggccacacaggaaagaacccttgccaaggggggcaatatcattaaccaaacattgaaaaggcttggcgggggggtgcccaacacaagcaaaagcgctcccaagcgcaacccacgcatcctccctgaacgcgatcaggcaccaacacggaagtttgcaacccaactctccccgcaagagcgagtctcggacccacactggcgagacggctgcgggcg

SEQ ID NO: 630431 - DNA, 247 bp, Homo sapiens
gttctcccctcccggatagggcctccttccagaaagaggatgtggtcagcctgtgccaacaggctgatgtgctgggtgatgagaagcactgagcgggagtaccgctcaagctttcgtacaggagctgctccacctgttactggctgtttgcatccagggcactggtggcatcattcaggctaagtacacacggtttccggatcaatgctcggggcaatgcgactgtctggtgatgacaccctgacag

SEQ ID NO: 630432 - DNA, 419 bp, Homo sapiens
  misc_feature (141)..(141): n is a, c, g, or t
  misc_feature (226)..(226): n is a, c, g, or t
  misc_feature (274)..(274): n is a, c, g, or t
gagtgatggctggctggctggctgtttatttatttatttatttatttgttgtttgttgtttgagatggagtctagctctgttgcccagactggagtgcagcgccgggatctcagagtcaatgtgaacactctgcctcctgngttcaagtgattctcctgcctcagcctccaaatccatgcctggctaatttttgtatttttagtagagacggggtttcaccatgtnggccgggatggtctcgatctcttgacctcatgatccacctgcctcggnctcccaaaatgctgggattacaggcatgagccactgcgcccgggcaatttttttttatgttttgtagagacggggtttcgccatgttacccagactggtcttgaactcctgacctcaagcaatctgctcgtcttagcctcccaaa

SEQ ID NO: 630433 - DNA, 111 bp, Homo sapiens
taatccttgttggcttccctggctcaggagtctagattactcttccatggatgtgccatgcccaaaacgtatcatccaccctgctgttcggaccttcccagcccggcccgg

SEQ ID NO: 630434 - DNA, 174 bp, Homo sapiens
cgatgtggtacggtagtgaatatggtaataagcgccttggcgcgcacgccgcttcaaatgccggcggagtcaggtgcagtggttgcgtcatggcggttccctatagtaaagatattcatgccgtcccagctcacttcaatgccggcggcggtcaggctttgccgctctaccgag

SEQ ID NO: 630435 - DNA, 159 bp, Homo sapiens
aagatcatgtcatcgcactccagccgggggtacagagcaagacaccgtctcaaaataagtaaataaataattaaataaataaatttttaaaaattaaacagtaaaaactcaagtaaggtcacggggaactgacaatcaaaggttgggatcagtggaaga

SEQ ID NO: 630436 - DNA, 240 bp, Homo sapiens
gggggccccccattccccccgggcccatgtgggggttggggggggcccccgtttttttccccccccaggggccccccttttttccgggggggttttttttttttggcgggggaccccaaaaggggctttttttgtttttaataagaaaattgggggggggttttcccccccccttttcccggtttcccccgggggggtttttttttttttttggggctttaaaaagccgggccttttcca

SEQ ID NO: 630437 - DNA, 657 bp, Homo sapiens
tgagcggggagttcagccagcgggccctggtgcgggaggagtgggagtgggccggggccagcgcccgtggagtggtgggccatccccgcgcgaccgcagcgccgacagcgagggggagggcgcctgcggggaggacagggtcggggagagcgcccttccgcaggctcctttcattcttccacttaggggtctccaggcaatgaacaactggccccagccaaggccagagcgcgcgaactgaaagtgcggcactgggaccaatgagaggaacgcttcgtcccctgccatggaggctttgctgtgaaaactttgtgctggggctgccgaacgtggtgtcgtgccaacactgctgcagtggcagctccagataatgcgggttccaaacacggtgtgacagagcccgtcggacccaccttcggaaggccagaggccttgcttttcacacagacaaaggctttcagcttttcaaccacacatgtgacagtgagtaaccgtacaggtcgaacgtcaccacgggggtttgacgagacaccctgaaccacagagactcattaggggcactcggggaagtactcacagattacccagttggttagccgatcctgtcacctcatcttattccctttgcttgagggcccatatgggtattagccgcaa

SEQ ID NO: 630438 - DNA, 918 bp, Homo sapiens
accttgaccttggcatttgtgtagtcattgtagcgccagttagtccctgacactaacggttaggtatcagcctggtgcgcccatgggtttacgttcggtgttcccttcacccttgcgggtatcctcggttcttatggcacgtcttccgcttattagtgtgtccacttgtactcctttggtttgtaacgcctccccatgtggcttgtttaaacaactcttcccaaccgggtggtttgtaatacttgccccacgcacaagctgtgttgtgagaacaaccttctgggtggggaagtgttcttgacacgcttaatgctcgtggggacgagtgccctcctctgcctgtgtgtcggtccacgggcctttgttcgccccggagaatctcttcctcgctgtttgtggtgacaaaaggggtagacttgctcccgggttttagaatgcgcccactgcttgtgtgtggcccgcttcgagggtgtccttgccccgcccctggaaactgctcccttgtggaccgccgtggcgcccccaactacttgatactgttcctctaaggctgcggggtttgccaaaaaatttggccggttgccccccgagttatatcaacagttgtgtccgacaccggtcggtgtgatattataagaaggggcccccccaccctgtgtgatgataacaaggtagatctctatctcccccggttgaaacaccgtaagtcataactcccttatcgtgggtcgtggacccgctgcctccctattttgtgtatcctgcgaaggtttaatagagagagaactataggttgaactcgccctacaataatgaggatccccgtgacgtcattccaaaagtttcccccccgtttttccaaaaaatttacccttttttaccaaacccaacaaaacaaaaacaaaaaaccaataaaaa

SEQ ID NO: 630439 - DNA, 1164 bp, Homo sapiens
agcggatctctgggaacatctggtgcggtacgtacaggccctattccaggactcctatggccatgtgaaacctcaccacgggagtgtggagggctggatgcatgacggacacatcaacactgtggctgtcagccctccatggtatgagcacagagatggaataacgaccacgtacattccccaacggtcttgagtgacctgaacgcgtgcttggtgcttgatcatgctgcgtgcaggaatcctgagcctcacctttggaggctatgcaatatatatagttgactgcacatctgtcgtacactacggtgtcggcgtcaggcgtatgcaacaagatcctgcgcgtaccactctttgcgttgaagccacattgaatgacactgtaagaacacaagaggccggtgggtcgcagaactatagaggacgtcgtggcacggtgccgtactatgcatgtcctttgatgacgtgttgataggcagaccacatggtgattataggcccggtccatacgagcaagaccaaccaatgagtgcttggccttttgcgtaacatggcggtaactcgctactcgcgtaacaagcaagacgattgtgtacctcacgtacacaggatggcacttacattcttccttggatcagataccatttatagcgcaagatctcagaaatggggccaaggcatacgcgtgtttcttggtctaacgtttcccgactggttaaccattcgtacatgcttttacactaaatagattgtgggaaaccgcctctggggtacacaaaggctaccgttctccaaatggtcacaatccgagttggattgcgcctcgttaactattgtgccgcacatttctcaaggcagatttttgtctacattgtccccagagagggtccttagaaggctcgcatcttaatcggtcgaccgtctagttccgtcgtgtgttagaggatcggctacgcataagttaacacttgtcgcattggtaagggaactatttgtagagagctttgacccctgattgggcaaatttgacacagatcgcattgggaatagcttacccaggcccatagggaaacggacccctttcttaacagataaatccaacatttcttttgataccgccaattgagttataaaccttggtgcaatgttacttaccccgagaaacca

SEQ ID NO: 630440 - DNA, 556 bp, Homo sapiens
  misc_feature (487)..(487): n is a, c, g, or t
  misc_feature (540)..(540): n is a, c, g, or t
cattgcataataataaagagttcaattcaatgagaagacctaactattgtaaatatatacccacccaatgtaggagtacccagatgcataaagcaagttctgaaacacctacaaaaagatgtagataaccacacaataatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattgggccacaaaacaaccctcagcaaatcaaaaaaaactgaaatcataccaaacatactcttagactacgtgcaataaacatcaacactaagttgcttacaactatgcattacttgggaattaaacaacctgctcctgatgactttgggngaaccatgaaattaagggcaaacatcaggtaattctttgaactctctagtatncccgagatccgtctct

SEQ ID NO: 630441 - DNA, 671 bp, Homo sapiens
  misc_feature (568)..(568): n is a, c, g, or t
ggaagggaaggtttgtgggtctgtaaagaaagagtgcgcggtgcttgctcactcactctgcctgtctttgttctagctctgagtccaaccctgaaccttgccttccagtgtttccagctcttcagcctctttaccccccagaccatgtgagtctcaagggctagctcattctaacctttgattattctctttcctttggcttcccatttacctcttctttccacaggtaaatcagtggcacagtatactgcctccttgtgcctctggatcctggcacttcacatctactctttcatgggcccatttcttcattttgtggaccaagccatcctgagggcatggacattgtctctgaggaaattgcggccacccttaagataccaagaaaagcttctgctcatggtcccactggaaatggactctgctgagcacagccaccaggtgaagagaacagaatccacacctgcattgaatacctgtgtcttcatgtggataggctctgagaatacccttttgccctttccacacctctaggacttcttaattcttccccaatgggaggccctanggcttaactgaggaactgaatctcttctttttctggaccttaacccttaatctgtcagggacccttaggactctgagaagactgggtttgggggtggccttgg

SEQ ID NO: 630442 - DNA, 815 bp, Homo sapiens
  misc_feature (162)..(162): n is a, c, g, or t
cttgtactggtagaaaatgtttcagtaaaatgttagagattcattgtatcattttgaactctagttcattactataatatgttttcccctgtttccccccctccacaaactccagctgctggatcaacaacaatgcagtattctacattacggtggtggganatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagaagatgttggggggtttgggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaacactaaacaacataaaaaattgggcccctgtgccga

SEQ ID NO: 630443 - DNA, 101 bp, Homo sapiens
acgcgcacggtatgtcctaggctatatacacctagcctacacggtatataccctgttgctcctaggctacaaaatacctgtacagcatgttactgtactga

SEQ ID NO: 630444 - DNA, 1259 bp, Homo sapiens
  misc_feature (606)..(606): n is a, c, g, or t
caaagacaggagatttgaatgaaaccatctgtacctgtagccatctaacaagcttcggcgttctgctggacctacctagtacatctgtgctgcctgctcaaatgatggctctgacgttcattacatatattgtttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtggganatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggtaagctttacagcatcaaatacaaactgaatgatcccagttgaatataaaaatgtagctactaaaagagtacaggcatgcctcagaagatgttggggggtttgggttctagaccactacaataaagcaaatattgcaataaagtgagtcacacaaattgttgtttcccagtgcatataaaagttgtgtttacactagactatagtctattaagtgtgcaattgcatgatgtctaaacaaatgtacatactttaacttaaaaatattttattgctaaaaactgctgatacagagacacaaggtgagtacatgctgttggaaaaatggccttgagagacttgctggacgcagggctgccacaaccttcaatttgtaaaaaacactaaacaacataaaaaattgggcccctgtgccga

SEQ ID NO: 630445 - DNA, 298 bp, Homo sapiens
  misc_feature (131)..(131): n is a, c, g, or t
  misc_feature (170)..(170): n is a, c, g, or t
  misc_feature (248)..(248): n is a, c, g, or t
cataatatatcaagcatcccctgctttgtttcaggatcttaacacagcagagggtggttttcaggaaataaagctacttctagatactttaatagatatttcaagctgtaataatattttataactaaacnggaaagttaaaaataacgcttttacaactaatcctcacntacttcaacggcacagttccaaaggttacctaattccaaagaatattcctgtgctttcgtgtaggccagaagtatccnttatctggctcctcgtgtttagctccctcgcctctttttcttttgttttt

SEQ ID NO: 630446 - DNA, 353 bp, Homo sapiens
ccggtactgcagagggtctcagggcagggaccataacgtcacccatcttcatatccgtcaagtacatgtgcggaacgtgcaggtttgtagcatggtatgcatgtgccatcgtggttagctgcacctatcaacctgtcatctaggttttaagccctgcatgactaaaacaccaaaagcaattgcaacaaaagccagaattgacgaatgggatctaatgaaactaaagagcttctgcacagcaaaagacactagcatcagagtgaacccgcaaccaacagaatgggagaaaatttttacaatctacccatctgacaaaggtctaatatccagaattgccccgaagtccagaattg

SEQ ID NO: 630447 - DNA, 190 bp, Homo sapiens
aagtaaagctgattgaatggattttttaaaaactgaatccttagggtgttttacttcaaataaaaaaatgcatattgtttaagcaaatgttttacccccttttttttccagaaatgttacttttttattgaatggcataggatgggccctggaaagcttagcatcggggatcccctcccttattccgcca

SEQ ID NO: 630448 - DNA, 366 bp, Homo sapiens
  misc_feature (346)..(346): n is a, c, g, or t
  misc_feature (348)..(348): n is a, c, g, or t
  misc_feature (366)..(366): n is a, c, g, or t
ggccgaggcaggttgatcatgaggtcaggagatcgagaccatcctggctaacatggtgaaaccctgtctctactaaaaatacaaaaaattagccgggcgtggtggcgggtgactgtagtcccagctactcgggaggctgaggcaggagaatggcgtgaacctgggaggtggagcttgcagtgagccgaggtcacaccactgcactccagcctgggagacagagcaagactccatctcaaactgactagatatgctcatgatatgtaccatgtcatatgacttttgtgttcttttctgcattttatctacttatcatacttttatctgattatttcttctggtttgnantccagttcatttttcttn

SEQ ID NO: 630449 - DNA, 182 bp, Homo sapiens
ggggaggagggggggttgggccgcaggactccaccgctgaggccgacgaggccgatgtttttattttgtaaaccacatttttctatttattgcggtgtggcggttttaacattaaaaattattctttaggaattaaagtgtgaatatgcagcattgtggctataaaatcaaaaagtgcaatg

SEQ ID NO: 630450 - DNA, 313 bp, Homo sapiens
gtcgaccctagcctttctattagctcttagtgagattacacatgcaagcatccccgttccagtgagttcaacctctaaatcaccacgatcaaaagggacaagcatcaagcacgcagcaatgcagctcagaacgcatagcctagccacacccccacggaaacagcagtgattaacctttagcattaaacgaaagtataacataggcgataagaatccccagggtttggacaatttcgagctagcaaccgggatcaaagattagcccaatggttagaagccggcgtaaagagtgttttagatcacccccgtcgac

SEQ ID NO: 630451 - DNA, 663 bp, Homo sapiens
cggacagaggcatgcggggaagtactccagaggcagcagcccaggatggtgcagtgggtgagcattagcagattccgatatagtgcccccagccagtacctgggtgttccccacctatgggcatcatgcaccacaacaaacaggccacatgagaatgcaaaggaggaagtgaggcgaatatctggaggctgctggatgcttacttgaagacgaggactttatctggtgggcgaacgagtgacattggctgacatcacagattgtctgcacccgtgtagtggctctataagcaggttctagagccttctttaccgccaggccattacccaataccaaccgatggatacctcaccatgcatataaccagaccccagtaaccgggctgtctatgggggaagatgaaactgatgtgagaagatggaccagaaatgatgctaaaaagtatgcagagacccaagactaaaaaggacacacacaacgtgaaagagacacggcgatcacagggaagacagacagcagaacgacccacaagggctgagcgggaacggcaggaacaaaaaggagggcttgcccaaatgctcactgaggcacgacacaatgggacacactggtgaacaaagagacgcagagaagaataaaccacaagtacccagagaaccaaac

SEQ ID NO: 630452 - DNA, 598 bp, Homo sapiens
tgagcaactccgtgtaccataggtttatctcctatggaatattttctttatataggcgtttgtttccttttttttgggagacagagtcttggccctgttgcccaggctggagtggcatgggcgactggagctcactgcaacctccatttcccgggttcaagtgattggtcccacctcagcctcctgaatagctgggattataggtgcatgctaccatgcctggctacttttggtatttttagcagagacagggtttcaccatgttggccaggtgtggtctcgaactcctgacctcaagtgatccgtctggctcagcctcccaaagtgctgggattacaggtgtgagccattgcacctggctatataggctgtgtttactataaacctattagctaatgtttcccaagtatcattttagcatttaggatttttcccccaaggttatttctcatatttttttccactggaaaaagtggggtaacttagcagttcacatattgaagactgaagttataaaaacctctaaacttcaaggtacttttaacaatccagttacgaaaagctcaggctttaaaaaattataaagacgagacgttcc

SEQ ID NO: 630453 - DNA, 429 bp, Homo sapiens
gcacgagcggaaggcaggaagggctacggcccggtggggccatatggagggtttgctggtagggatgccttcagaggactgggcacatgttggctagagaaagatgcgcttagagatgaatatgatgatctcttagatttgagtgcagtacacatggagagtgtacgagaatgggaaaggctgcttaaagaaaaatgtggttatgtaggcagactcctaataccaggagaagaaccatgagaatctacacgatgaagaagataccatggatcacagtgaacaggattgaactttgttatgagccaaaggcaggggccttgagaactgcagtccttacgctctttcacagactgtacggagtcttagggttttgattgacctgctgcgaagtacattcatcaaatttgagtagcagataaatttatctca

SEQ ID NO: 630454 - DNA, 336 bp, Homo sapiens
tcaagattcaaagggggactcttatttaaccggcattaacagtcctgacggacaccttggatctcagctgggttttactctataatctcagctgtcgtcccaccccacttcttccaccccacttcttccttcaccaacatgcaagttctttccttccctgccagccagatagatggacagatgggaaaggcaggcgcggccttcgttgtcgagtagctctataatgtgaaaggggcagcacagtcgtttaaacttgatccaccctctttgcatcttacaaagttgaacagctaaaagaagtaaaataagacggcaatgcttgtgtaatgtacagtg

SEQ ID NO: 630455 - DNA, 138 bp, Homo sapiens
ccgtcagtcgctctagggattcacaggtgaggtgagacatccttattctcccgggggtttaagttatggatggtgatgtagggcttgggcagcttcgggaggagattcagggttgactgacaggccaagagcgactga

SEQ ID NO: 630456 - DNA, 301 bp, Homo sapiens
ggggcccccccccagtccccttttttttctttttggcccaaagggaaaaaaaataaaaaaggactccgggggtggtttgggttgttaaaagccgaagaatacccagaaccccgaaactttatttttggggacctttgggggttgaaaattttagcccttcctttttaaggaaaaaaccgacccccaggtttttccccccccaggtttttgggacccaaaaaaaccgccagaattttttttttttataaaaattaacaaaattcccccccccctttgaaaaaaaggggggttgggggcttta

SEQ ID NO: 630457 - DNA, 108 bp, Homo sapiens
tgtttttaaacaaaaggtaagaaaggtcttcaggagatgttgatttttattttgtcttgtctggatagaggtttagatttgctctcgaatgttccagtgtggagagag

SEQ ID NO: 630458 - DNA, 165 bp, Homo sapiens
cacagcagccggcccgggaggaaattatataggtggaagcaaaagtatcttcattttctcatgtattccccatcgactgagtcaactgcagaggggagaaagctccatctcaggaaaaaagaatctactacataatagaaagtctgctagacactgcctattaga

SEQ ID NO: 630459 - DNA, 402 bp, Homo sapiens
ttctgataatcagtcttgttaatgtgggtctcttataccattgtctctcaactccctcaagactacctacgtctctgagagtcataaagctttggtctctacattaggggctacacccaatctgagatatatctcctttgagaatggccaataggctcatacctgactgtttgctttcggtatgtaggcctgcctgtattgctgcagctatagtctcgcttgctacgaagacacatggtcatgactgtcttttagctcttgcctatttactgaatcgatgattgaaaggatttgctttttctctttagtacttacgtattgggattcctgtgtcttacagctctccctctccaaataatacacagaatcctgcaactttttgcacagctggtatctgtctgg

SEQ ID NO: 630460 - DNA, 304 bp, Homo sapiens
tgtgaaagcacacctttggtgatgtcgcgacacatctaaaacggacattttcgagcggacgcagcaaggcaggcagaagtgatcccggccccttcgtccctccggttgcattgcaaatagacggtccgcatggcccacacctgttggcactgggtcgaagaaaatggcgcagccaggtcggttacccgacgctcacacatggtggcttgtcgctgttggaagttctgtcgcctttcatagaactatcgaagtaggcatatagccttcgtagagaacatgcgcgaacagtcgtgcacgcaagaaa

SEQ ID NO: 630461 - DNA, 415 bp, Homo sapiens
  misc_feature (172)..(172): n is a, c, g, or t
  misc_feature (233)..(233): n is a, c, g, or t
acacttattttatgaagcatctagttgcttttaggggaagggacatcctccgcatagtatcttaggccagctccactttcttctccttactgttgatttactctcatgccattgaatcttctgtgccaatgttggattaatgtttccgggcccgtactttcatcatgctccntctgtattatcacctgttttggtttacagcaatgatttttaaggtaaggcatggtgtgtcncatcatagtcacatgggaactttttcaagccgatattaaaaatgtcccccattcatcattctgcccctggaacagtgtgtgcagttgggaccttcatgtaaatctactttgttgaaacccactgatcagcatggtgtatttcataactctttgacttacattcaagaaattccttaacctga

SEQ ID NO: 630462 - DNA, 930 bp, Homo sapiens
  misc_feature (217)..(217): n is a, c, g, or t
cttatttatcccgcgccgcggggtattctttcagaactcctgtgcccatgctgtcctggtggtcgcccccccccgctggggggactgcccccccctgggtgtgttccacaaccgccgtcggttgtgtccgcccggcctttggatatttccgcgggaccccttctggcccagggggtttccctctgtcccccccggttggaccccgctgcgcttcccntgtgagtccgctgggttatcccccggcaataacttgcccggtcgttagaacgagaccgcccccatgttagagggatactgtcctctactgcgtcgtaaaacagtgtggccggcggtaacaactgattatgagcactccttcttgggaaatcatcataccaaacacgttacccccactggcttatcaaattgacccagaagttttcccagggtaatttgggtgtaaaaaaaaaatcctcgcacgcctcttccctatgaaatatctgttgttctataggcaccgcagtaatttgttacaccacccgtgataaataacttggtcttcttcatttgtaaccccacttgctttatgagcttttttctaaaagttcatcattttattttatgaggtataatgactccccctgtgttgacttcccacatcacagccctctctttctaaaaatcttttcgtgaacatcccacccccctcctcgacttagcctcccctcaacaagacaacacatcataacagtatgcacccaccactgtgttttctacaagaagaatatactgatttttatgatatcagagggccaattcacaaccactccactttggagccccctaaatcaatatactggaaacaacaaaagccaacttttcatgagcccaacaagattaaaaggcaaagaaataggggggaaataaacaaaaaaggcaaaccacataaca

SEQ ID NO: 630463 - DNA, 1057 bp, Homo sapiens
accagcaggtgcaagaaaaatatgcagactcaccgggagcctcatcaccagaacagcctaagaggaaaaaaaaaaaaaaaaaaaaaaaaaaaactttttgggccccccgggtttaaaattggccctggaaaatttttaaacccctggtggggggcggggcccccaagtcagggaaagtggtaacggggctaaaacaggcggttcccatagagagaactccgtggcaataagaaacgctgcttgggactttcctccccaaataaaaaaaacgccgggggcaaccacgagcgtgtgtgtgaacaaacccccaaatgggaaggttccgcgaagggccacattacggggacaactaatccaagcgggagtccaacggcgagagcccggataatcaaaattacgcccccgtacggggataaacgaaacaaagagcgaggggacgaacagagaatagaaacagcgagaagcgaagacgagataaggagaaatgcaagacacaggcaaagaaagaggtagggagaagaaaagcggagcccgacacacgaagaaagagaagaggagagaacagagaaacaaaacgaagccgaacagcgaccacaacgaaagggagcacaggagacggacctggacacagggagacgaaacaagagacccaggagcgaccaacgcgaggagaggaacgagagagaaagcaaacgacacaacacagaacaaacaacgaaacacaagaaaaagacaagcaccatgcgcaacacaaaaggacccgggcaaagcacaaagacgacccgacgagcacgacactagagccgaactcagaggacaaaggaaccgaaggacagaagctgacgaagcaccaagctgagacgaagcgaatcacaagaagagcaacgagtcgagcacacgcgaacgagagaacacaagacaactaacgagaaggaacaagacaggacgaaaagcaaagaacaagagcacaaacactctccacatacacacacaccacaccaccaaagcaacacatagcaaagtcagcagcacgacaacacacaaccacacgaccaca

SEQ ID NO: 630464 - DNA, 300 bp, Homo sapiens
  misc_feature (196)..(196): n is a, c, g, or t
  misc_feature (212)..(212): n is a, c, g, or t
  misc_feature (250)..(250): n is a, c, g, or t
caacgctgtcgaggagagaagcataggcgggtttcaacttatgaacgggaagtacatctgaaagcatatgccaagtagaaacaaatttcttcccttccttacccttcagaatatatactgtcatacagctttacaagttccatgttcttttctatattagtttcatattttgattacccattctttaggaactctngctctatgaagcatcntgttccaacaacagtataaactgctgagcgtttacacncgaatttccagaatttgtgagctcgaaatttacaacggtatattcgtctg

SEQ ID NO: 630465 - DNA, 83 bp, Homo sapiens
acatctgtatatttctgcgccagcgcccgggacagaattcccacgagcagtacttcgggccgggcaccaggctcacggtcaca

SEQ ID NO: 630466 - DNA, 330 bp, Homo sapiens
catgatacgaaccgagctagtaccgaaaatacggtccttcgtacgggaggaattgaaggtaatagataatgcgaggcggatactccggtgtgaactcggatcacatatagactttaactcagtgaacaaacgaagctcttaatagcgcgctgaccatcgggatgtcctgatccaacatcgaggtcgtaagacctattgttgatatggactctagaaaaggattgcgctgttatccctagggtaacttgttccgttggtcaagttattggatcaactgagtatagtagttcgctttgactggtgaagtcttagcatggacacgaatgttca

SEQ ID NO: 630467 - DNA, 377 bp, Homo sapiens
  misc_feature (288)..(288): n is a, c, g, or t
  misc_feature (294)..(294): n is a, c, g, or t
  misc_feature (345)..(345): n is a, c, g, or t
  misc_feature (355)..(355): n is a, c, g, or t
gatggacttttaggttgattccatgtctttgctattgtgaatagtgctgcaatgaacatatacatgtgtgtctttataacagaacaagttatattcctttgggtatctacccagtaatggggctgctgggtcagaaggtatttgtttttcggtctttgaggaagaaccacaccgttttccacaacggttgaactaatttccactttcaccaacagtgtgtaagcattcctttttctctgcaacctcgccagcatctgttttttgtttgttttttgagacggagttttncttttnttgcctgggctggagtgcaatggcacgatcttggctcatcgcagcctctgnctcccggggntcgggtgattctcctgactcag

SEQ ID NO: 630468 - DNA, 882 bp, Homo sapiens
  misc_feature (87)..(87): n is a, c, g, or t
  misc_feature (122)..(122): n is a, c, g, or t
  misc_feature (148)..(148): n is a, c, g, or t
  misc_feature (882)..(882): n is a, c, g, or t
gatataggacgttataggaggacgggtagagtgaggacgagagcgttgtcgattccggttctaacatgtgtaaggtccttatccccnaacagacacaaaatcagggatcttcctttactcgnacaacctagctcccctaccagatcanaaatttctatctggagaacctctgcggacaaaccgagtgcttcctgcatttccaagttaacgaagacacagcacagcagcacaagagagtgaacattctgccaaccccaccagtgatgaaaattaactgtgggccactcgctgcacaaatgtagatgaatatgtattctcacctctcagaggacaggatcactccagtttgtaagaacgaagaccactttaataagctgcgttctataggccctcatttttataactcgaagttctgctattccaaacagcgagactccctaagtgagcccttacaactctcgggcgtgcatattaagtctgagtatttctgcggacttccactcgccgcaattaaagaaccgattatggtttagggtccgaaaacctggagctctcggttggatcaggccgcggcacacgtgcccggttctctttgtattgagtttttggttgtatttcttgctgaatcgttctttttgatcgggcaatagaggctgcgttaggtgactgtccgctttactcgacacctgtctcatatctctatcgcctcacacacgtcgcagaattctgtctgcgacagactaagcttgaccaattaaaaccttcactaactagagaagatgtgaactgttgtggtcgagatggttagacgcaggggcgccctgtcagagccacaatgtttgacacttggccccgcgcgaccttatgatgaggatcaatctn

SEQ ID NO: 630469 - DNA, 106 bp, Homo sapiens
gagagctgttccactgtgggtcatgtctggccaggcttagcctctgaacttccaacttctctggtttaatctgatcctaacccatcttggagtctgatctctcgaa

SEQ ID NO: 630470 - DNA, 316 bp, Homo sapiens
  misc_feature (41)..(41): n is a, c, g, or t
  misc_feature (77)..(77): n is a, c, g, or t
gagaaaatggtcattcccttgactacctgatacgggtttgnctgtgtccccacccaagtcttattttgaattgtaanccccataattcccacatgttgaaggagggacttggtggtaggtgactggatcatgggggtggtatcccccatgctgttctcatgattgtgagttctcacgagatccaatggttttatacatggtagtctctcctgctgccatgtaaaacatgcctgcttccccttctgccaggattgtaagtttcctgaggcctgcccagccatgtggagctatgagtcaattaaacctctttccttta

SEQ ID NO: 630471 - DNA, 140 bp, Homo sapiens
  misc_feature (33)..(33): n is a, c, g, or t
  misc_feature (50)..(50): n is a, c, g, or t
  misc_feature (70)..(71): n is a, c, g, or t
caatggggagttgaataaaaactatatattgangaacttaaaggtaatanaagttttaaaaaattaatgnnagctaactcaagctaatacaagctaaaaattcattaaaattactttgattcatttctcaaatcaggaat

SEQ ID NO: 630472 - DNA, 320 bp, Homo sapiens
tgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcggaggattgtttgagtccaggagtttgagaccagcttggtcaacatagcgagaacgactcagtaaa

SEQ ID NO: 630473 - DNA, 497 bp, Homo sapiens
ccctaagggtatcacgagatggataaagagtagtacatggaatagtatatactacacatgtatacttagagtttaagtacatctccgtatataatacatacatttagataaaatataaaatgagtatttcaaatcatacagttaactagtgcacttctaggaatatatggcgaataaggatgagtaaatctactgatggaattaatactagccaaaatagatagctaataagataatcatgcaaactaataaataagtagtcatctgagataactgcttagaagaaaagagagatgatacttagagagcaccacaacaaagtcagccttacttagacagtagagttgcattgaatagggacacggataatgctgagcgcacagaaccagcaactcgtaatgtgagcataatgtaatatttgactaacagtctaccagagacaagcacagtaactagcaagtaacatcaaatatttatatcccctaactttatatgac

SEQ ID NO: 630474 - DNA, 110 bp, Homo sapiens
acgacagaagggaaagctcttccagctataccccaggaacttcctgcgctagctgggccggggaggggcggcctgccctcatctcatttctattaaacgcccttgccagc

SEQ ID NO: 630475 - DNA, 230 bp, Homo sapiens
cgttgcaacaaactacccctattctagccggctgcaccatccggcgatgtctgcatccaacatcgacggtcggtaaaccctattgttgatattgactctgacaatatgattgcgctgtttatccctacggtaacctgttccgtcggtctatttattggatcaattgagtttattcattcgctttgactggtgaagtcttagcatgtactgctcgcgacgttgggttctgc

SEQ ID NO: 630476 - DNA, 245 bp, Homo sapiens
gcggccgcctactactactaaattcgcggccggtcgactgcgctcccagtcgggttgcttggctatcgtgtgagtccttacagcagcgtcatgatgatgctgccctttgtcatgttttcctcggcccagataggacggagattggagaggtcgttcgcagcaactcgctcactggcgcgggaaaggtcaaatgaggcgagcgggatgatatggtcaacatgccattccgatctgttctcccaaga

SEQ ID NO: 630477 - DNA, 960 bp, Homo sapiens
  misc_feature (28)..(28): n is a, c, g, or t
  misc_feature (36)..(36): n is a, c, g, or t
  misc_feature (41)..(41): n is a, c, g, or t
  misc_feature (64)..(64): n is a, c, g, or t
  misc_feature (69)..(69): n is a, c, g, or t
  misc_feature (287)..(287): n is a, c, g, or t
  misc_feature (304)..(304): n is a, c, g, or t
  misc_feature (308)..(308): n is a, c, g, or t
  misc_feature (312)..(312): n is a, c, g, or t
  misc_feature (359)..(359): n is a, c, g, or t
  misc_feature (369)..(369): n is a, c, g, or t
  misc_feature (375)..(375): n is a, c, g, or t
ggcgccacttggcctgcctccgtcccgncgcgccanttggnctgcctccgtcccgccgcgccanttggnctgcctccgtcccgccgcgccacttcgcctgcctccgtcccgccgcgccacttggcctgcctccgtcccgcctgcgccacttggcctgcctccgtcccgccgcgccacttggcctgcctccgtcccgccgcgccacttcgcctgcctccgtcccccgacccgccgcgccatgcctgtggccggctcggagcatgccgcagccggcccttgccccccgncgcacaggagcgggacngccngagnccgcgtccgccgcacggggagctgcagtacctggggcagatccaacnacatcctccngctgcnggcgtcaggacaggacgactcgcacgggcaccggaccctgtcggtattcgtgcatgcaggcgcgctacagcctgagagatgaattccctctgctgacaaccaaacgtgtgttctggaagggtgtcttcggaggagttgctgtggtttatcaagggatccacaaatgctaacagagctgtcttccaagggacgtgaaaatctggtgatgccaatggatcccgagactttctggacagcctgggattctccaccagagaacaaccgggacttgggcccagtttatggcttccagtggaggcattttggggcagaataccagagatatggaatcacgattattcaggacaggcagtcgacaactgccaacgagtgattgacaccatcaaaaccaaccctgacgaccgaagaatcatcatgtgcgcttggaaatccacagagatcttcctctgatggcgctgcttccatgccatgtcctctgccagttcctattgtggttgaaccagtgagcttgtactgccagctgtaccagagatcgggacgacatgggccctcggtgatgctttcaacgtcgccaggctacgcccg

SEQ ID NO: 630478 - DNA, 118 bp, Homo sapiens
tcgtctgtaggaggcaagagtgtaacagcaggacttggcggctgtgaggatgtggggaatggaggaagacaggggccctaggggtccctgagctggaccagggggtgaacatgttgtg

SEQ ID NO: 630479 - DNA, 276 bp, Homo sapiens
  misc_feature (217)..(217): n is a, c, g, or t
cagggatcttttcccctcaaagaaaaagaaaaagaaaaaaagactgtcattttcttgagcagctttcttgagctcggtgttgtgtatgcctatgtctggggcatacactaggactctggcaggcccactaaactctaccacgtatttgccagatatgctgtacactgtcacctggaagtcgggatttactcttttatttttctgtttattttgcatnagtactgtatgtattaaaaagtagccccatatcgattgtccaagggtttcctagaaata

SEQ ID NO: 630480 - DNA, 124 bp, Homo sapiens
gtcacacagacgtaaacacacacacacacacacacacacacaagagggtcataaacccctctagtggcgccctatgagctactagacaagtgtctcctaaatcatgcggtagggtggattagta

SEQ ID NO: 630481 - DNA, 169 bp, Homo sapiens
ccaacgcaggggcctgggggctcccaaagcctttggcttcccggttccctcccggccctgcctggagcttcatgtgcctccccttttgcttaatgaaaacccctgtttaaaagttaagggttttttgggtgacgtttaaccataataaagggggctgcttttttaagga

SEQ ID NO: 630482 - DNA, 1086 bp, Homo sapiens
aggggttttgtctgcggctcgtcctgctacatttcttggttccctgaccaggaaacgaggtaactgatggacagccgaggcagccccttaggcggcttaggctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaaatgtcaatccagaaaagacacaagcccagttttctggtaattttgtcaaccctggtctgtctgagccaggcggaatatgaacaagggggcatgtgaattccaaattttttaagggggccagttctctatggatcctacatttaattggggggaaatgcctttttccccctaaacaagggtggggctcacaagctatggaaacaggccaaaagaatgggggaaagaagactggtaaatacccagagggcctcaggaaccatggactctg

SEQ ID NO: 630483 - DNA, 943 bp, Homo sapiens
aggggttttgtctgcggctcgtcctgctacatttcttggttccctgaccaggaaacgaggtaactgatggacagccgaggcagccccttaggcggcttaggctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttggagtccggacatctgaaacttgatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggcctgcttcctcaccgccatcaactacctgctcagcaggcacatggatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaaatgtcaatccagaaaagacacaagcccagttttctggtaattttgtcaaccctggtctgtctgagccaggcggaatatgaacaagggggcatgtgaattccaaattttttaagggggccagttctctatggatcctacatttaattggggggaaatgcctttttccccctaaacaagggtggggctcacaagctatggaaacaggccaaaagaatgggggaaagaagactggtaaatacccagagggcctcaggaaccatggactctg

SEQ ID NO: 630484 - DNA, 349 bp, Homo sapiens
cccccctgggaattgtaagaaaataaggctgggcacagtgactcacatctgcaattccagcactctgggaggcccaggtgggcgggtcacctgaggtcaggtgttcgagaccagcctgggcaacatggtgaaaccccatctcaaaaaaaaaaaaaaaaaacggtgaggaaattaaaacgccttattagtttgaagccaccccacttcaactttttgttagggcagcagagcttgacaaattctgttgacgctgggaaagtgttggcattacagggcccttgggggtctcttggccggtcaaattccagcattctttcatttgacccacagggttgagattgacttttga

SEQ ID NO: 630485 - DNA, 870 bp, Homo sapiens
  misc_feature (255)..(255): n is a, c, g, or t
agcggggggccgcaccgtaaatgggtgtcgactttcctccagtccactctgcacccaagctcagcgggcgcacttttctgatcttgcgcataccctctcaatttattaacacggttgcacgacggaaacagttacgtagttttgcggaagtgtagaatactgctcggtgccgcgccatggacggctaagtgcttaccgcgaaacatgtggaatccctgagtctcccgcatgcttggagcgcaggttggaggtagncgtagataagaatacttggtagtttgcttatatagcatttgcatcgcaaagtcacgtagccttggcatattacattcgtgggccaaagagcaaagcgggggaacataattcacgacagtttcattacttcaatatactcgaagttgtcatgaacgagaaatcgtccaatgagaatggtgatataagcaggaaatacataatggtaatacaaagagacgggaaacgtttgcaagtttattatactcaagagcatgagaaatacagtagaataacagcagggactgcaactatactttggataaacggaataagaactatgaaagaagaaagcatgatgggcatggtttcatgaacacgtaatacgaacgctctcaattccattctccgcaacagtaacgagatgtgtctgcaaagtcacatgtgcgttaaacatacaggttgttcatgaatggcatagcatgagccaaacttggtcagctccccagtcacgttccaggcatgtcaaggaacccagatcataatctactttctcagcccaaggagcatagcatgttcagaagcatcagcaggaggcaactaatgcacaaagttggcatgcagttgagacacattggg

SEQ ID NO: 630486 - DNA, 273 bp, Homo sapiens
tcctggatcacgctgcagcagctcctcatggatcaagagtgcacatcagctacaccagatggccttcccactggagctgtataccatggtgattcaaaccggcttgagtggagcacaaaagtttataatgtactagggcattggctaggacaaggtaatcctactcatgtggaacaaaatgcaagagcaagacgtagatcccaaacatcagacagcctacaggaacagctaaaactaggcaacctacctatcaggcaataactaataatccta

SEQ ID NO: 630487 - DNA, 745 bp, Homo sapiens
  misc_feature (14)..(14): n is a, c, g, or t
  misc_feature (63)..(63): n is a, c, g, or t
  misc_feature (75)..(75): n is a, c, g, or t
  misc_feature (132)..(132): n is a, c, g, or t
  misc_feature (150)..(150): n is a, c, g, or t
  misc_feature (281)..(281): n is a, c, g, or t
  misc_feature (634)..(634): n is a, c, g, or t
  misc_feature (665)..(665): n is a, c, g, or t
gcctgaaaaaggcngacgacaggaactgagaagctggcagtaggtcctgctactgctgcaggngcggcgggcgcntgggtgggccacgaggcagggacagccgaggctccgcgctcaccccacccgcaaggnccaagcgcagactcaggngagccagaggggccggaccgctgagcaagggctggggaaggatccacgcttggatacttgggagtgaagatgtgttatttcacccaccgactcgttccacacgaccaaggcctgtgcctgccctgagggcnagttggttgagccttgtacagacaactctcagagcgtgggcctgggccgaacctttccctgtgagcagcagcatcagcgtctagaacgacggccctcccggtccacggtggaaggtgcggagctcccgtggtgtgctggcagcgattcgcagaagggagatggagggccacagggcaggtgctcgcacggagtcatcgaggtccagggacaccttcctcccaggtgagctcacaaaggcaccacacattaatcctgggagacaaccattctgatgtgctaaggccatcgacagggaacatgattgtcaggaaacctcaacttttcgataaatgacagcaaaacctgaatgcangagaaatgtatctcattttaatgcctgactnctaagcatccttattcaacatattatatgtattttttgtttcatgagtaaaatgtacattgagcttcaacaaacaaaaaa

SEQ ID NO: 630488 - DNA, 258 bp, Homo sapiens
tacttttccacaggagatggaggttgcagtgagctgagatcactccagcctgggtgacagagtgagacttcatctcaaaaaaaaaaaaaaaaaaaaaaaaaggaaaaaaaaaaaaaaaattaaaagttgctgattaattattattattctaattgatctggttttcccaattctgcaaacattctgattggctatctgccactcttaccttgaaaaattcttttaagaaataacccttagctttaagatagattgcct

SEQ ID NO: 630489 - DNA, 844 bp, Homo sapiens
  misc_feature (14)..(14): n is a, c, g, or t
  misc_feature (63)..(63): n is a, c, g, or t
  misc_feature (75)..(75): n is a, c, g, or t
  misc_feature (132)..(132): n is a, c, g, or t
  misc_feature (150)..(150): n is a, c, g, or t
  misc_feature (281)..(281): n is a, c, g, or t
gcctgaaaaaggcngacgacaggaactgagaagctggcagtaggtcctgctactgctgcaggngcggcgggcgcntgggtgggccacgaggcagggacagccgaggctccgcgctcaccccacccgcaaggnccaagcgcagactcaggngagccagaggggccggaccgctgagcaagggctggggaaggatccacgcttggatacttgggagtgaagatgtgttatttcacccaccgactcgttccacacgaccaaggcctgtgcctgccctgagggcnagttggttgagccttgtacagacaactctcagagcgtgggcctgggccgaacctttccctgtgagcagcagcatcagcgtctagaacgacggccctcccggtccacggtggaaggtgcggagctcccgtggtgtgctggcagcgattcgcagaagggagatggagggccacagggcaggtgctcgcacggagtcatcgaggtccagggacaccttcctcccaggagtgtgtgtacagtgatcacttgctgccataacacagtcacagatctacgtgtgttctctgactctcagctggggctccatcggggcctgctctgggctcacctgcgtgaccactgggctcagcttcctcgtctgagaagcatcaggactggccttcccacccccgcgttcccagggcttccacactcctttctagccatgagtcagtcctcagtggatgaccagtggcctggggtggccctctgattctctcacctgtactcagggggctgaacctcactcttctctgccaaaaccaaccaatgaataaataaacaaacaagcatggaattcctaaaa

SEQ ID NO: 630490 - DNA, 128 bp, Homo sapiens
ggcaggtgggaagacacttaataccaggagtttgagacagcctgggcatggtggcgggtgctatagttccaactacaggaggctgaggtgggaggaccacctgagtctgagaggtggaggttgcagtg

SEQ ID NO: 630491 - DNA, 242 bp, Homo sapiens
tgttcttgaggtccctttttccgctcactggagtccgagactggtgactcgatgcgggccggaggctgctggcctgggcgcggatgctattgcccccaccgctccgggtgttcatggagtctcgtgaagctggagtgggagcaagacaacatgagggcagccctagatctgtgcgaggaggccctgcggggctattaggacttccccaatggctgtggacttatcaatgcgggcacgatcga

SEQ ID NO: 630492 - DNA, 723 bp, Homo sapiens
ggtagtagccatggcggacatgagtttgttgcggcgggtttcggtttactgcggtggcagctctgtctggaccggcgcccttggcactgcgcctcggacttgggggcttcctcactcgtggctttccgaaggcgtgctgcgttcctgttcgacacagctggagaccatgggaaaagactattggtcatcagaccttcgtagagttctatgacaggcgtctttagaaggttgattgatgattctacattgcatgactgggattccagtagcaatttgcataacatctggtgaatgtattcatggtcaagctgaactagcagaaagttccagaaggctatgtcgccagaagcactgggaatattataagcatcccatatcaagatggattgcccgtaattgtctatgatagtggcgtgaaaagatatatgaacagaactaggggcgtccttcagattgaaggtgaaagaggtgaattacgggtagaggagctggaagatgcgaagaattgagtgcatgtgagaggagatggaccctggtattactatgagacaatgacaggggaacttatggatcatgctccgaaagcaatcctgaaatgacgcattttgttctccaaatacaaagtatattctctttattgggaaataagtttataaatatttgctgtatcttgtctcgtgaagaacagagagcgtctgacattatgttctcaggtggtcaaat

SEQ ID NO: 630493 - DNA, 121 bp, Homo sapiens
gcagagtcctgggaactgagacagggggcttgacgagatcaggaggaagttacatggcacaaaataaggggagcaggagaggggaggcacgctgggggtcttccttgtgtaacctgtccta

SEQ ID NO: 630494 - DNA, 123 bp, Homo sapiens
caggtatattacaccagagccattaactcttgtagctctcatcaacattaactggtttgctttcatgacgctgctgagtgaatcagttctttctgcacaggttcaagtgaaatgcttttctgc

SEQ ID NO: 630495 - DNA, 458 bp, Homo sapiens
  misc_feature (6)..(6): n is a, c, g, or t
  misc_feature (72)..(73): n is a, c, g, or t
  misc_feature (75)..(76): n is a, c, g, or t
  misc_feature (80)..(80): n is a, c, g, or t
  misc_feature (94)..(94): n is a, c, g, or t
  misc_feature (96)..(97): n is a, c, g, or t
  misc_feature (101)..(101): n is a, c, g, or t
  misc_feature (103)..(103): n is a, c, g, or t
  misc_feature (114)..(115): n is a, c, g, or t
  misc_feature (117)..(117): n is a, c, g, or t
  misc_feature (125)..(125): n is a, c, g, or t
  misc_feature (136)..(136): n is a, c, g, or t
  misc_feature (138)..(138): n is a, c, g, or t
  misc_feature (148)..(149): n is a, c, g, or t
  misc_feature (155)..(155): n is a, c, g, or t
  misc_feature (160)..(160): n is a, c, g, or t
  misc_feature (165)..(165): n is a, c, g, or t
  misc_feature (175)..(175): n is a, c, g, or t
  misc_feature (179)..(179): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (192)..(192): n is a, c, g, or t
  misc_feature (200)..(200): n is a, c, g, or t
  misc_feature (203)..(203): n is a, c, g, or t
  misc_feature (205)..(205): n is a, c, g, or t
  misc_feature (210)..(210): n is a, c, g, or t
  misc_feature (219)..(219): n is a, c, g, or t
  misc_feature (221)..(221): n is a, c, g, or t
  misc_feature (225)..(225): n is a, c, g, or t
  misc_feature (227)..(227): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (240)..(242): n is a, c, g, or t
  misc_feature (246)..(251): n is a, c, g, or t
  misc_feature (254)..(255): n is a, c, g, or t
  misc_feature (257)..(257): n is a, c, g, or t
  misc_feature (260)..(261): n is a, c, g, or t
  misc_feature (266)..(268): n is a, c, g, or t
  misc_feature (272)..(274): n is a, c, g, or t
  misc_feature (276)..(278): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (297)..(297): n is a, c, g, or t
  misc_feature (305)..(310): n is a, c, g, or t
  misc_feature (313)..(315): n is a, c, g, or t
  misc_feature (318)..(320): n is a, c, g, or t
  misc_feature (324)..(328): n is a, c, g, or t
  misc_feature (337)..(337): n is a, c, g, or t
  misc_feature (341)..(341): n is a, c, g, or t
  misc_feature (346)..(346): n is a, c, g, or t
  misc_feature (350)..(352): n is a, c, g, or t
  misc_feature (367)..(367): n is a, c, g, or t
  misc_feature (382)..(382): n is a, c, g, or t
  misc_feature (454)..(454): n is a, c, g, or t
gccgcntttgcaacttcaatgccaagctcacgtctggctgcgaccgtggcaggctgtggcatccccgacagnnannggtngaggaagtatgganannggtngnaccgctcactnnanattcacanaacatggcaantncgccttactnntcatgncagtnattcntcctgtacancttnatttnanganaanattgacangananggaancgaactccntncccngnggggnganagncnnncaannnnnncgnncnggnngccgnnncccnnncnnncggcgnggagncnggattngtttattnnnnnnggnnncannngcgnnnnnagcccgcanacanaacgnaaannnccccccacccaaacncccgaatagctcgancaaaagacctaaggggaacgaaaaaccgcaaaagcaaaaagcagcccaaagcccaaggaacaaaaaagccanacgc

SEQ ID NO: 630496 - DNA, 843 bp, Homo sapiens
cggaagaagtggcgaagttacttttgagggtatttgattagctggcggtgtgtcaggggctaaataggaggacgaagaaaagcagagcaattgggaacccagggcaactgggagtagttcgctccgcgagagggcgtccactatacccccgcgcgcagacatgagccccgcccccacgcatgttgcttggacggaggggcagggactctgtgctgagaggctgcatccgatagcaactccaacctatgtctctctcgcgtaccacagagttccccgtggataccacacccttgaccgtggtaaatggtcaggaacatcaggcgctggagcaccgttccttctatcgacccaatctgtaaagtgagtgacggcgtcctggatccagtggaccggggagtccgggaacctggattgttccccaggcagtgatgaggccaggtcaggcctgcaggcaacaagactggtgtcggtctccaagatcgccgaagataaggaaccaggaagcgcgaaggcgaccatgaagtggcccagcagaccgaaaaaattgcttggggactaacgcacgctttttggcgtgctctgtggggacaacggacctccgaggtatacactaataacgcaggtgctcagcttgtgaaagggcctgacaggacgtttttgcccgtccgccagatgttgagaccgtggtgggaggccaggcgctatggcttgacgggggtggtagcacactggctcatggacgcttacatgcgggcaaaaagtaggcaggcagtgccggcatgtgcaatgatgcagggggccagatcacggacagtctctttctgaaaacgagcccgaaagaga

SEQ ID NO: 630497 - DNA, 764 bp, Homo sapiens
agcggatctacaaaaaccttactttatggtcaaacattaaaattgagtaaatatatctataaggatttattaagaattgggtttaacattaatagcatactaactgtaaaggtgaaattctggcttattctggtataaacaatcgctacagaaagcattgtcaaatatgagatggtgtccggtctcttcctttaggctactatttgtactaacatatgttattggtactgtgtcccaacaatcatgtgaaactcctatcattctgatatgtcttagctgtatgttatcagctaataactatacattgttcatgttaacattcattcgtgtgctacagaggtaacagatttccctgtcaactcgctcgctctcgtctctggtcctctcttagcaacggtgctccttgaatgcaggtccctacactacgcttgtggagattgtgacatcacgaatacgacggaaaaacattcaggtactcttgaaggaactaaacatacttcacttaatactcaacgcaggattgggaacttacactgcactgaagctgaactgataggacgattgaacgtgactcttttcgactttctcgctctaaaagtgttcctgatcctatgttcgctcttctgcagagtcaagggacgcttttcttcttgtgctattaaacacgattttaacaacttaagtaaagtatactcctatgagcagaatttggagcatataggttgctctctgccttgtccctctaagaatctggaaactcatct

SEQ ID NO: 630498 - DNA, 180 bp, Homo sapiens
tagaggatcccctcgacgcctcacggcgaggcggatgggctggatgtgctgctggccagcccttccgcgctcgatacccggtggctttccgactggtacccggacaagggcgtcacgctcgccgccacactgggctacgcgggcgggccgaaggtggccagcggtgagatgggggtaccg

SEQ ID NO: 630499 - DNA, 496 bp, Homo sapiens
aatgaatatttcaatgaagatgcgttctgctgctaatagcaggaaatcccatctagtggctttatttttctttaacccgttatctcacatagccgatagatccaaggctgggcatctccagagttgctcaactcagcaggccagtggcatcaccagcgaccctggaacttcatagctcatctctttatcacacacagtatgtcagctttcctgagatggtagggtgacccctgcagcagctttaggtttgttattttttcccaacaactcccaaaggcaggaaaaggatactcctttttcctgtgtgcctttataaggagcaactaaactgtttccagagtgttcccagtaccccctttttcacacattggaatgaccgtgggatcacatgggctcagacaagccaggattcaacctttgcaaagtgggcctgaggcacatgggaaaaaaaggagcaaaatcatgtattttaaaaaataaaaaaatggtggatgga

SEQ ID NO: 630500 - DNA, 252 bp, Homo sapiens
tcctctgtatcacggctatagctttatagtaagatactctttacggactccacccccttagtgagtcttaaagccatgtcgaagcccccatcgctgggtcaatagtacttggccggcagtactcctttaaaaaaactaaggcggctatggtataatacgcctcaactcatctatcccctgaaaaaacatagctacccttctgtatatcctatgaggataatatataagctcatctgcctacgacaaacagac

SEQ ID NO: 630501 - DNA, 152 bp, Homo sapiens
  misc_feature (31)..(32): n is a, c, g, or t
  misc_feature (71)..(72): n is a, c, g, or t
cacagtcgtcatcaacattaccacagtatannatggtagtcctaagccactgatgacctgcttgaatatannacacccagaggagagtggctgaaggcacacaagcaagtttctgacttgaagacacatcctgtggactataggctaccaca

SEQ ID NO: 630502 - DNA, 430 bp, Homo sapiens
  misc_feature (198)..(198): n is a, c, g, or t
  misc_feature (203)..(203): n is a, c, g, or t
tgggcggcgctggtctttggccctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccnccagncatgcggcctcgctcccggagcctcaggtgagggtgctctctgcccactgttccagtgcatgtggatttcagcttgtttgcataacacagaggtgggcacactatgctataaagggccaagatagtaaatatttttaggctttataggccatatatctctgtcacattcctcaactctgctgttgtagtatgaaagtatccacaaataatatataaactttatttac

SEQ ID NO: 630503 - DNA, 106 bp, Homo sapiens
tggcttccttcctgctgttctcaacctccaggtctcgttttggggtgagtcaggcttagcccatcacctgttacgctcgctctccgagaacatgcttcccgtcctg

SEQ ID NO: 630504 - DNA, 171 bp, Homo sapiens
atgtctgacccaccaaggggttggtgtacagatagtttgtcacacaggtaataagcttaatacctgctgagtagttttttgatctgcaccttcctcccaccctccaccctcaagtaggccccagtgtctgttgttcccttcttgatgcccttgggtgggtcagaacataag

SEQ ID NO: 630505 - DNA, 203 bp, Homo sapiens
tactctacacggatcccccgttatagcaccgtggtaaatatgtatgagcggacgctatagcggctgtgactagctatgttgacgtccctgttcatgctatggatcagctgatatttcgatcagtgagtaactgtggtttacctagccacagcagagcttctccacagctaggcttcaactacgtgagggggctatacggtcga

SEQ ID NO: 630506 - DNA, 545 bp, Homo sapiens
  misc_feature (30)..(30): n is a, c, g, or t
  misc_feature (191)..(191): n is a, c, g, or t
  misc_feature (214)..(214): n is a, c, g, or t
  misc_feature (223)..(223): n is a, c, g, or t
  misc_feature (278)..(278): n is a, c, g, or t
  misc_feature (290)..(290): n is a, c, g, or t
  misc_feature (292)..(292): n is a, c, g, or t
  misc_feature (302)..(302): n is a, c, g, or t
  misc_feature (317)..(317): n is a, c, g, or t
  misc_feature (336)..(336): n is a, c, g, or t
  misc_feature (375)..(375): n is a, c, g, or t
  misc_feature (383)..(383): n is a, c, g, or t
  misc_feature (395)..(395): n is a, c, g, or t
  misc_feature (406)..(406): n is a, c, g, or t
  misc_feature (417)..(417): n is a, c, g, or t
  misc_feature (460)..(460): n is a, c, g, or t
  misc_feature (475)..(475): n is a, c, g, or t
  misc_feature (484)..(484): n is a, c, g, or t
  misc_feature (505)..(505): n is a, c, g, or t
  misc_feature (530)..(530): n is a, c, g, or t
  misc_feature (535)..(535): n is a, c, g, or t
catcatcggcgcagtggggcatcggcattnccgtggtcatgatatttggcatgatctcacgtatgatcttgtggctgtgctatccgcaggaacccgaggatggtctagagtcagcttacatcctgagcaggaaagtttacccatgaagattggtgggattttttgtttgtttgttttgttttgtttggtgnttggtggttggttttttgccccnaattttagnattccttttgccttgctagataaaagctgaaggtactttatgtttgtcttttaangcttccttcaanantgacctttgnagttgagcggggggnttggtttgctttgggttanattttttcaggtggttggttttgcctgttatattaagcngaaatccngcaatgaaaggngctatatttgntagactctagncaagatattggacataaaagaatttttttgtctttaaataganacaaatgtctatccnctttaatcnagttggaacttatattgaagnccatttgatacataataaaaaattntggcnatgtcctgga

SEQ ID NO: 630507 - DNA, 83 bp, Homo sapiens
tcggaggtgaattcgtggcggatgtgcaccacggtttcggcgttcttgcgtgatgcctggatcagccgggcggcgttgtccgc

SEQ ID NO: 630508 - DNA, 273 bp, Homo sapiens
  misc_feature (145)..(145): n is a, c, g, or t
aggatccctttgggtgctttcagttatgcactacctcctgtgcattggtaacggtagaggaataaaaccctgtgtcttcttgccaatcaggtctcttactgggggcatggctcactgagccacactgacattagagctcgaaaancacttgtgagcactcattatatgaatcagtaaactcccctcctcccccagtcttatcaggggcaagcccttctttggaatttctggagtgaagcgactcttgccagtgagctggcaccaggggctgtg

SEQ ID NO: 630509 - DNA, 284 bp, Homo sapiens
gtgtcgggagggtttctaacaattttacctttgggtacactggggtggcagttgcgcaggacggggcaggtttgctcccctccagtccaagacaagtgctgactgcagaaaggatttatctgctggtatttgaaaagctttccctgatgcaacggccccagacacttcctgggagttctgctcgctgccatggcgaaaagctgaagtgaggaagtgactgatcccatctctggcatcatggtcctaagaaattgctggaaatgctttcctcattaacagcgact

SEQ ID NO: 630510 - DNA, 326 bp, Homo sapiens
  misc_feature (39)..(39): n is a, c, g, or t
  misc_feature (73)..(73): n is a, c, g, or t
  misc_feature (113)..(113): n is a, c, g, or t
  misc_feature (133)..(133): n is a, c, g, or t
  misc_feature (152)..(152): n is a, c, g, or t
  misc_feature (210)..(210): n is a, c, g, or t
  misc_feature (229)..(229): n is a, c, g, or t
ccaataaatagttccggcgccggtgttgagagcggtgtncgtaggtgttgtagccgccctggtgaagttcgcnttgccgcggccccggctagagacctggcctgttccctgcntccgtgacccggagagcttncggggtgcgtcaagccccncgcctgaggcaggcggtgacccgtaactggtttgtggcctgtttgattcctgtcagangtttgctgacccaagacantatcgaaaatgcatattaagtcaattattctagagggattcaagtcctatgctcagaggaccgaagtcaatggttttgaccccctcttcaatgctat

SEQ ID NO: 630511 - DNA, 205 bp, Homo sapiens
  misc_feature (204)..(204): n is a, c, g, or t
tacacatggcggaaactggattctggcaaccaggagaccccgacgctggtttgaaagtaccttttctgggagggggcctttcagcatgtgggcaaaaccttcaatcagggcaagattttcaagtggacattttttgccctaacctaattgcctgcccctgcccttcagggaaatgggggtccttaaaagaaactggccctttgna

SEQ ID NO: 630512 - DNA, 374 bp, Homo sapiens
tttccttctctccttcttcttaagatatcatgacatcttacccctgacaggttcaggattcgctaccccaaaatatggtgacctgttgtattaatattttgggcttttattttgttttgttctgttttgagacagtgtctcaccctgtcacccatgctagagtacagttttgttttgttttgagacaggttctcactctgtcacccatgctagagtacagtggccttgatagcagctcactgcagccttgaacttctgggctcaagtggtcctcctccctcagccttctgagtagttgggagtataggcaggtgtcaccatgctcagctaattttttttttttaaagtagatgtggggtctccctatgttgcca

SEQ ID NO: 630513 - DNA, 269 bp, Homo sapiens
gcaggtttgtccacgtgaggagccttgtgtgctggccggtgatgaaagcgaagcagaggggacctgcctctcagccggtttatgactggctctggaccaaccaaggtaggagggtcgaagcacgagatgtaaaaccacccaggcccagtggttcatgcctgtaatctcagcacttagggagactgaagtgggagaatcgcttaagcccaggagtatgagactagccttggcaacatagctgagacccccacgtgcacgcccagccgtgg

SEQ ID NO: 630514 - DNA, 1118 bp, Homo sapiens
  misc_feature (369)..(369): n is a, c, g, or t
  misc_feature (864)..(864): n is a, c, g, or t
caaactcacagccctctccaatattggctggggctgtgggatactcccccggacctcgtcaggaatggcattgagacagtgagacgggacctctacttagggagaccagtgtgggcctgggccttgggggggctggatgtggcccgaaggctgagtcccgaccatggggtctggggctcgagcctttagagcccctctgaaggtagccgtgcactaagctattccaccaactgggggttatgctctacatagagcacaaggacggaacaaggcgcctgacaatttcttcgtgacgcatactgagaaggactagagggttactagagcaaggaattgggcttgcctaagcatgaatcagaggaacgttcnccttggtgcgcactacgaaggtcaccgaagaaatgacgacaagtatgcgcttagacatgacgaggactatgaatagagagagatccttggagaagcgtcatcccgtcatcgcatatcataagccattgctctaacagaatcaactgagttgtcacgagaggcacccgagttgcaaacttagaggctttggcaatccgaagcgaatgattgggaggcgcacaattgtgcctaaccagtgtgggtgggccagaacccctaagtccaggtcagggggcaaaaggcgcctaaactgtgaacgggttgtgaacacatctaaccggctggctggtcaactaatccacaatttatatgtacatcaaagtcccttccaaatgtaataaaattgaaaacgccaaaacccgattaggattacaattgatggcgcacagccccccgtatatgagaggaactggccgggtgggaacaactttgaagagaaggaatggcgttaaagangcgaatacatgagaagggcaattccatataggccgataccattttaatgttgtggcaatcgcacctcggcgatttttgttgacgacacattaccgttaaggcaaagacatattccattaccaattatgataaaaccgggggtaaaggcaatggtggagcccctgtaatctaggggaggttgacaattcgggaggagaggtatagcggataaagcgaaaggaacttaacggtgtaggatttagaacttttcggga

SEQ ID NO: 630515 - DNA, 164 bp, Homo sapiens
ccccccgggaaaaaaaaaaatgggggggggggggggggttttttttgggggttaattttaaaaaatttgggggttttggattttcccaaaaaggtttttggttggggggtttttttggggccccttttttgggtttttgttaaaaaagggcgggtttcccccca

SEQ ID NO: 630516 - DNA, 194 bp, Homo sapiens
tcaaaaaatatagatgatcctgctcacatataaatttatcatataggtaccacacagctatgtatctgactctcatacacatattcctacagctagcatattttagcatacatatcctatatcttatatagccaattatatactatgcattaatcatactatacacctactgctctcgaataatagcatagtat

SEQ ID NO: 630517 - DNA, 567 bp, Homo sapiens
ggggcgcggggtctgagggctgcccccagccagcccggcctgcgctcggcctccaccctggaggtgtgtctgccccgatggctctgtcttccccgcgggcgacgccagcccctgcgcccggggggcacctatcgcctgcggcgcggttttggcagctcggcgctgtggtggacgaggagctgccgagcccgagcattgccatgttggcccggaagcgactctgcccagtctcccacgccggcgtcccatcgtggccaagcacccgacctgcgacccgcccgagctcacgcccgggttgccccaagccagggaccagcgagacgtaagcccccaatgtcggagcccgttctccgcgaggataatcgcacgcaccgcgacagcccagccggacagaatattacacatggatggcaaaccacacccagcgacaataaagcagagcactacgcgcgaccaacgcaggaacacggagcaacagggataacacacggagagcaacaggaacaccgccgagacacacaatcccgataccagatcatcaacaaaacacgcgaaacatctcggagc

SEQ ID NO: 630518 - DNA, 448 bp, Homo sapiens
attaacttattactgaagaaacctcacagcatatatttttaaaataaatttagtggccaggcatagtgctcatgcctgtaatctcagtactttgggaggctcaggtgggctgatcacttgaagccaggagttcaagatcagcctggccaacatggctaaaccggtctttactaaaaatacaaaaaaaattagctgagcatggtggtgcgtgtctgtgattccagctactcgggagactgagacatgcgaattgcttgaacctgggaggcggaggttgcagtgagccgagatcatgccactgcactccagcctggttaacagagtgagactctgtctcaacataaataaataaatgtagtgtagcctaagggtacagtgtttctaaagtctatagtcgtgtacagtcataccctacgccttcacattcactcaccactcactcactgac

SEQ ID NO: 630519 - DNA, 150 bp, Homo sapiens
gagcgagctggcagcagcaacctctaggaacgacacaattacacgtatcgcacagccatgcattggatatcttctcatagtataccatcataatcgaggctttgcactgactagtccctaataatcgggcccgaatgcgtttccccataa

SEQ ID NO: 630520 - DNA, 588 bp, Homo sapiens
ctgcatctgcgccaggcgaacggggtactgcgcctcctgcagtcccacctctccaccgccgcgtgcgcctgcagacgctccgctcgttgccttctctcctggcaggcgctgccttttctccccgttacaagggcacttggggctgaaggatcgcttgtgacgatctggaggaagccgcagcagctattgtagggacctgaagcttgtgtttcttcgtttatcctttgggttcagtgagaacgggcaggtatcggactcccttggtctttcagacatggattatttggctcatgatgtttctctctgctagtcttgtggcttggccgaaggaggctccaggaaacaggcagatcttaggcgctagagtctcagcgcggtgggtgaaaacggcggggagaaacatcatatcccagtgcatcctgggagggtcctgccggtttccgaagcgcttgctcctggtcgtcccttgactgaataaatgagtgtgtcgtaccttcgtgtccaccttggtacattcattgtgggtcaagcaggtcccgatgctacggtgtgtgtcctgtgatggacattgcgaagctccatagggtc

SEQ ID NO: 630521 - DNA, 318 bp, Homo sapiens
ggtcagagagctgtacctgcctggacagcctgcccctgtacctcatctacaatgtcagctggaaccacaatggcagcctgtttatgctcagcatgcaaggacaaaaagcgtgctgcatcatcgaccccacgtagaggcacccgtggtggccagagcagtgatagaagtgctcatgagtgggtccctggcaccatgcggacccatcattcctggccgcatggcaagggtgtacaccacatggcttcagccggactgacacgagctggcagattgagcacgctctggcgcaacccatgaactccctcgtaggaacccatt

SEQ ID NO: 630522 - DNA, 913 bp, Homo sapiens
gggtttgaagacgcgtcgtagaggttatggatggccgtgaaacagccgtttgagtttgtgctgtcgggttggagaacgtattgtcagggtgcccggacctaggaatggatgtccgacatgattacagatggcttgtccaatgatgtttcaactcggaaaccgcagatgatcggcttctacagtcatccggtgtctgacggctgtgtgccatgttccgacaaccggtgacgattcatcctggaggacctggtactatggtagatataagcctatttgatggcaacttttgctgactgtggaagtgacatcatccgcaaaactaccatgctcatggcatgtacaaactatatcatgtatgatagtcagtcgtgtaatttacgtattcagactgagagaatggttgataagatggcatgatgtctacattatttaggacagtactcctgttcttattgtggtataattcagttacaatgcatgggtggattggatggcaatttcttatcaatgtgggttggactgattccattctatcatgttaccgacttgttattgacttcgttcctcaggttgcctggttgctgaattagttcgtctcacctatgttgccaatgaatcaaagaatactctggatcaagatagcgctgattttccctacaaagatgacctccttggcctttggactccaaggctgactgcctggtcagagtacttggtgttctttgccttattcatccatttgtaagggttatctaaataactggtgtttggaacctggtatcaaatacattcgaacaagcgaaatgtgccgggagattgctggtgtgccctggccttttgaaagcacttcctcgctacgtatggacaactattgaatggcggtgcacatccctggaaagaaccacaaatacta

SEQ ID NO: 630523 - DNA, 754 bp, Homo sapiens
agcgggctgacctagcgcgtccaggtgggaggtaagtgtggaaccgggcgtctcgctcctcagacggatgtggcagccccgagccagtggctctcgcccgtgccgagatcgtttattgtggcgctagaggctacaagtccaagtatgcttcatcctcaatgaagaagttatgagagatggagttccccggtcagcctggacgatctgcggcgagggaactccgccaggccagccgggttcttggaaggtgatggtagccgggagagttgagttcaccttctaagtaagaaaagggtcgatggctacgtggacacagaaagcaagtttgctgaagttatggtggccgacatcaaagaccgacttggactcatggcataaatgcgccctgaaggcagagtccagggaccttgaatccagccgctctcagtcaagactgcttcatgagtaggacacggactgaagagttgctggtggacaacctggatctgttccctgatgtgctcgtggctgtgattgggggcagagattgatgcccccgggtctttgcctctgagcggggagagtctgtgtgtatgtgtcttccccggaatgcataccggcccgtacgctctcgtcctgtcccgtgcgtgttccttcatatctctttgcatatgcccatgtctgtccccagtatgtgccctggcacgttggggggactgtcccgctcaggccatccctgctcatggggacagccaagagaggcgtctgctgggtg

SEQ ID NO: 630524 - DNA, 312 bp, Homo sapiens
  misc_feature (51)..(51): n is a, c, g, or t
  misc_feature (53)..(53): n is a, c, g, or t
  misc_feature (55)..(55): n is a, c, g, or t
  misc_feature (89)..(89): n is a, c, g, or t
  misc_feature (180)..(180): n is a, c, g, or t
  misc_feature (192)..(192): n is a, c, g, or t
  misc_feature (263)..(263): n is a, c, g, or t
  misc_feature (271)..(271): n is a, c, g, or t
  misc_feature (297)..(297): n is a, c, g, or t
gatgtaggcattttcatactgaatgagagagtaaataatggcatccatttntntncttctattcacaataagttgaaatgctgtctatntcccatattctaggacctaactcctattgctttgaatttctcctaagacagtaatcatagttatgagcaaatgtatagctatatgcatatntccttaaggctnttctgtatttccaaaacacattaacctaagacttgagcgttatggactattccaatcaaaagacaaatgancatagatncctactccccgcataacacaaaactntatccaaagtggatt

SEQ ID NO: 630525 - DNA, 144 bp, Homo sapiens
tgatctatggaatgttctgtacaaagctgtataagggtactggggggctagatactttttttttgtaatctggacttagccaagtatatttcgccatggtaaaatgcagtatctttgttattaaaaattaaattgcataattta

SEQ ID NO: 630526 - DNA, 551 bp, Homo sapiens
atgtagaacgcagccttctgctcagaataaataaaggtccggggtcctctaatggtgcggtacagataggactgtgctaccgttggcactatttgtagtcatgtcagcaacatgatcaagggtgttactctgggcgaccgttacaagatgaggtctgtgtatgctcacttccccatcaacgatgttatccagtagaatgggtctcttgttgaaatcaggaatttctggggtgaataatacatcggcagggttgggataagaccaggtgttgcttgttcagtatgtcaagcccagggagatgaattaatccttgaaggaaatgacatggagcttgtttcaaattcagcggatttgattcagcaagccgcatcagttaaaagcaaggatatcaggaaatttttggatggtatctatgtctgtgaaaaaggaactgttcagcaggctgatgaataagatataagagttacctggttacagaaagaagatgccagatgacacttaagaccaacttgtgattcccccaactccccatcctttttttttagaaaagg

SEQ ID NO: 630527 - DNA, 375 bp, Homo sapiens
ttaatccgaggtaattatagctcaacagacaattagaaaaaagtccacacttgaagcctaaatttgtgctttttaagaatatttttacactatttctttttataggggctttgctgaattctatcattaaatcacagcccaaaatttgatggactaattattattttaaaatagatgaagacaataattctacttgttgggttaacatggagatacactcctatcatcttttattcaaggaagatctaactataatacagctcaggctaatgggttcttctagactgtaaagttatgtttttaaagacgtatcttgacacccgaaatgtgaaaaaacttaaaaaataatatggtgtatttttccaaatgataaat

SEQ ID NO: 630528 - DNA, 191 bp, Homo sapiens
ccactacacaccgacagacgttgcttgcagaccaaatcgttccactgcactccatcctgcgtggcagagcgagactccatctctctcaaaaaaattgataatccatacatggctgtctgctagatctatatatacttgctatatacttccttaagatcactcacaaacactctctatagagaggtagctga

SEQ ID NO: 630529 - DNA, 180 bp, Homo sapiens
tggctgagagagggtacgtgtaggccagggacacatccacgggccaggacagcatccacaggccaaggactgctgccagggcgcctgccaggctgaacccctggctcagccaaacgaggtgcccagacggtacccgagcatggtaggacctgcaggccggcgagggacaccaatgggacg

SEQ ID NO: 630530 - DNA, 226 bp, Homo sapiens
gaatttatccaaagggaatatgtcaatatgcactctaaaggctctttcatcaagtatatttcttgggcggagtagtatttcacggtatgaatgcactacagtttattttcctatgggcatagaattttaaaaaaatagagtgcacaggtctttctcttgggagggtagcattaatatggacatggtggtatggagatcccgtctccacagggaaccgagctcgaat

SEQ ID NO: 630531 - DNA, 131 bp, Homo sapiens
acgaagtacgggaaggagaagaaaagaatagagaagatagggaaattagaagataaaaacataactttagaagaaaaagataattcaaacatccaagtaggagaagcaggaaaaagacaagctaggaacac

SEQ ID NO: 630532 - DNA, 627 bp, Homo sapiens
agcggactctgatcgatagccggagcgcagagcggactgcagataccactgtgcagacccaccgacggcgtctggttgattaccatcaagtccggctggagccgcagatgaccggcctgggccctggtcgctcatcgcctatatgagcctggaggaacatgaccctagcagtccggtgtacgacaacaaacgtacgtgtgacctaggaaaggctgctaaggatgtcttcaacaaaggatatggaatttctacttctggtcatgcttacacttgatacaggcaaagcatcaggcaaacctagaaaccaaatataaggtctgtaactatggacttaccttcacccagaaatggacccacagacaatactctagggacagaaatctctttgggagaataagttggctgaagggttgaaactgactctgtgataccatatttgtacccgaacacaggaaagaagagtgggaaaattgaaggctcctataaagggattgtaaaggtgtggcagtaatgtgaaatagatttttctggaccaacaatctatggctgggcgtgtgttggcttcgaaagggtggttgttggtatcaagatgagtttgaaacagcaaatccaaatgtcacagaataa

SEQ ID NO: 630533 - DNA, 207 bp, Homo sapiens
tggacacattttccattgtttttataaggttgtttttcctctcaatacgtgtaactgccacatatagcaaccgagggatgataagagaattttcatggcacccaaggtgagaagctgaggattgtcagagaaaggtggaagtgtttatttttctttcttttctctttgattcactgtagttctgtaccgatatcatctttgtcctag

SEQ ID NO: 630534 - DNA, 459 bp, Homo sapiens
tgggttgacggccaaataaaagcggcacattgaatagagaaattgaaggtttataaacaggaagaaggctttgcgccaacgaagcagacaatctgaacattcagcgtgagatctccatgttccctctgtgaacgtaccggaagggtgaaaagctaaagggcatgcatacgtgttgtgagcagaatgggatgtgatttacaaaactagtggactaaatgccaaatgacttgaaacatacctctggcgtgtacaccattgggcacagctagtgcctgaccgcgcataacagtttgggggatatactgtcgggctcagcatggggacacaccagttaacgttgtcataggatgatatgtgctattagtgctcacactgtagacaaagcggttaccgtaacgccacttcttcactgtaagttcaatcaggttactcttcacgttttccaatggataggtcatc

SEQ ID NO: 630535 - DNA, 694 bp, Homo sapiens
tacaaagctacttttattcctggggggtgacccccaagaggattaaagagtagctctgggaagaaaaaaacagaaaaaaaaacaaaaaaaaaaaaaaagacaagaaaaaaaaacaaacaaaagcacagaagaacaaaacaaacaaccacacaacaaaaaaacacaaaaaagccacaacacaagaccgacccacacgatcccagccgaagggcgacccccgcacgcgcgactacacataagagcgccccgcgccccaaccaacccaaacaaccaaaccaccacccaacaacacacaccaccaaaccaacgacaaacaaacacaagacacacacacccccaccacaacacccagacgacggggcacacaacgacccccctcacaccaccaccacagcaggaacacgacacacaccgccacagacaaccaacgaaccgacgagaagcagcccacaaaagcagcacaaaacaaacaaacgccccccctacgcacgaacgccgcacaaccacactcagaacaacacaccacacacacctcacgacaaccccacacactaaatcctctcgaacaccatacaacagcgacaaccaatcccctccccacacaacaaacaccacacacacctcaacaaacacaacacccacctgcacacccacccacaaccccaatacccacccaatacaacaaacgacccaa

SEQ ID NO: 630536 - DNA, 130 bp, Homo sapiens
gaactacaagtcttataaatattatgacacagtaggtgtcaaagtatgtttaacatatgatgtcttcagagatccctccccgtttttgaattccaaagtggaggaactgaaaggtggcgctcgataggag

SEQ ID NO: 630537 - DNA, 125 bp, Homo sapiens
cttgcagcgccactgtgctctggacatgctgatcacctatcacacttttaaacttctagatgaagaatactatgaattatgtactaaacgaatgctgggttttttttggttttggtttttttgag

SEQ ID NO: 630538 - DNA, 320 bp, Homo sapiens
gctcaaaaggctaagccctagatcctccccatcatacagggccttcctgtcttcttggttcactaggccttgtcagctgtcccttcgtgcattccacaatagtgcgataggggtagctagacagggtattacaaggatgacaactggatagccccttaaatgctgcctgaagagctgtggccttgtccacattcaggggtcacctagtagtgataatgctttggaacccattttccaggtggcctgggctgtggtggggactaatggctgggaggcaagcgatgagaaagaagtcttgagcttcttcacggctgcaggtc

SEQ ID NO: 630539 - DNA, 370 bp, Homo sapiens
  misc_feature (12)..(12): n is a, c, g, or t
ggttcccctgtnaatttaaaagtggggggggggggggaaaaaaaaaaacctttggggttaggggatatagaaaaatataaggccctttgttccaaataacgcaggttttaaaaacaaaaaaatcccccccccacccaccccaaattttaatggtcagaattggcggcccaaaaaaaaccccctttcctgacttgttttggggcagtttggacgcccccaaaaaattgggcccaagggtttagaaaaataaaaatccaataaaagtaaacccaaaccccccaaacagccaacttcggggaatttttttggattgccaacaggataaattaaatgttccaccaatttgataaaaaacccctttgggaattga

SEQ ID NO: 630540 - DNA, 1272 bp, Homo sapiens
gtggcggctgagactgccgcctgcctggcacctagtgagcgcagctgtgagccccgacacctgtcgcctgcctgcatggagtcctgagacctgaaccctgagccctgtcactgctcctgtgtgaatgatgccccaaccatgcgccacctgctgacttcggatgcttgatgtggctgactgctggcttggatgtgtaggtgccacactcaatggccgcaacctgatgcctgctgtctagcccgcgatgctgtcctgactgtccacgatgagaccatgatgtgttacatttacttcattgtgtgaatgctagtatgtatggatcaccaattgtctcatgggcacgttgcctttcccaaaatggcagtgcaacacaactggacatcgtccttggcgatcttgggttgttgcaagtggtgaagaggtcctttcacaaacatgccacgcaccatcaccggcccaaggttggcttgagatccaccaggaaggggaggccctgcgtcggatttcgtaacattcggggtggcacacggtactccatcgaagggaattccttccacaggttgacttggcctctcaagtgcaacccgcgtgacacgtcatctctctgcgaaaccctttatcgtacccccctgcggcatggggaaacatagcattctcagataggcccagtgcacgccctgccccaggacaagtgacagttcccagaggggcaccttgagtggtcccatggggtataagtccactggttttagcgacacgccatatctctagttggcatatcatgcctatcggctagggataccaatcacacgagtctcctcgccccggacgatggcccttccagtttcacatattcttccacccacccacctagactagccaccaaaatcgcagccctccattggtctcccaacaaccaccatgatctaaccaccaaagacatccactagttacatccccttgacaacacttagtctaccagacaccctacttttcacacccccactccttccacacgataaaagaccaggcattcccacatacaagcggaggagacctgagaactgggggtcagacccggcaccacatcccgcccggggccacgacacgaccggagtgtgccatctgtttgccacagaccgcctacccaagcacatcatcgccggcactggagcaaccaaccacgcgcgccgcgacgcaaagccaactcccccgacccgcgctcaggagccgcaccaacgacccgcacagatgacagaccacaacatgcga

SEQ ID NO: 630541 - DNA, 289 bp, Homo sapiens
  misc_feature (130)..(130): n is a, c, g, or t
  misc_feature (262)..(262): n is a, c, g, or t
gagtacaagcaactcttcctgtcttcttatccagagtcacaagaggatgggagaggagcagtctgcaagcagccgtaggagcaagaccttgagacgtgtccatcaatgctacacagagtctcgctctgtngccaggctggaatgtaatggcacaatctcggctcacttcaacctctgcctcccgaattcaagcaattctcctgcctcagcttccctgagtatctgagactacagatgcccaccaccatgcctggctaatttngtatttttagaagagacagggtttcat

SEQ ID NO: 630542 - DNA, 122 bp, Homo sapiens
cgtttaattaaggaggtgtttctagccaaatccccctctgccagaaacacccaagaactgatcaactaaaaaaaaaaaatctcagcccaaaatttgaccaggtttcatcacataaattaaat

SEQ ID NO: 630543 - DNA, 440 bp, Homo sapiens
ttttttttttgagatggagtctcgctccgtcccccaggctggagtgcagtggcgtgatctcagctcactgccacctccgcctcccgggttcaagcagttctcctgcctcagcctcctaagtagctgggattacaggcgcgtgcctccgcgcacggctaattcttgtatccttagtggagacggggtttcaccatgttgttcaggctggtctcaaactcctgacctcgtgatctgcccacctcggcctcccaaagtgctgggattataggcgttacgaccatacccggacatttttgatttcttttttttggtcttaagcagttctttgctacttaattgggggctagtagcagataccatttttaaaacagacttgtttagctgtttcttaagctaaaaacttcagtaaaaatagttttagatatttcacaaaaagctat

SEQ ID NO: 630544 - DNA, 175 bp, Homo sapiens
tctagtagaaatgcaaaattagccgggcatggtggtgcacgcctcataaatctcatatactatatagatatagacatatatatctactatatatactagtatatagtagattactattaatactatgagtgccccggtgctgttctggtcggtcaagagtcctttgttcagtcgt

SEQ ID NO: 630545 - DNA, 320 bp, Homo sapiens
aagggcccaaaagcccccccgataaatgagctggtgggctgggtagaaaaaattgtcccaatgttgcccaatattggctttgtaaaggggaaatccagctgctgtttataaatttgaatgttttaaaagccttcttgcctgccctctctgttataaatggggttttagcccgtcctgggttttcccatgaaccccattttaaaatatgggttttttgtatgcccaacgggggtcttgtcccttggatatgggggaatgttggttttatggctcccggaaaaacccctttgctatgattaaagttcataaaatggtttcca

SEQ ID NO: 630546 - DNA, 660 bp, Homo sapiens
ggagcaccccggtaatatctcgctgaaaggcgtcttcaaggctatgaagggcctggggactcgggacaacaccctgatccggatcatggttctcccgataatgaggtggacgtgctcgcacatgcgtggggatcttccggagcaagtatgacaagtccctctacagcatgatcaaggaatgacacctctggctgattgatacaacgaagactctgctgaagcttgtcttggggtggagatgatgactgctgctgcgtcaggtacttcccggaggcggcgcaggtggcctatcacgatgtgggaacgtatagatgcatgtgggccgagttagagctgagagggaactgtgcgcccagcctatgacttcgatcctgacgcagatgcgcaagcgctgcggaaagccatgaaggggacatcgggagttgacgacatgacgacaagtcatcgagtatcatcaggcaccggcagcaatgtccagacggtcagcagaatcgcggcagacgcattactaggtctcactgttggccgggacttgaagtgactgagctgaagtctgaggatctctgtgaggacctgtgcaagggctgagttcatgggtgctcatgaatgccaacctggggcgattacgatgccgaaagcagcctgagagaaggaccatgg

SEQ ID NO: 630547 - DNA, 389 bp, Homo sapiens
gatcccgattaactcatcgaatacaatcgccgcacatatcatttatattgttgagtaggcagagaagcgtcgtatacagcactatcctcaagtgcaatcatgaatgaacagaaatcctccagatgctggcagcaagggtgcctccttgtgaccgaacgtcagattctacaagacaagacttggcagaggacatggggtagaagggcccggtctgccagggaatccttgctgatccagaatgccacacctaggtcttctccattcttggagaaggaaagttctacttcttcagtctcaaaattagcaaagcagccaataacatcattctccccaaaagtctggccaaattcctcaaattgtccattttctgccttgagtcctcgtccatc

SEQ ID NO: 630548 - DNA, 162 bp, Homo sapiens
gaagactggtcccagcggctcttcagtccaatcagtttgtcttagcattattagcattgcttttcagcttgcaagggaaaagagacgaccaccggataattctttttatgttcgacatgtacaaggagttccaaggaaacaaaattggtggtattcattgat

SEQ ID NO: 630549 - DNA, 178 bp, Homo sapiens
gtgctggtgtgtgcgatctatacgtgctggtgtgtggatggatacgtgctggtgtgtgtctggatgacgtgctggtgtgtggattgcatgacgtgctgttgtgtgcgattcctgaggtgctggtgtgtggatggataatatgctgttgtgtggatagagctgctactgttgttatggt

SEQ ID NO: 630550 - DNA, 763 bp, Homo sapiens
tcacttctaggaatactaatatatagctcacacatcatatcctccctactatgcctagcaagagaataatgactatacgcgtagtagcgattgataggactactctcataaccctcaattatccactccctcttagccaatatagtgacctattagcgcaggtactatgtcttggccggcctgcgcaagcaacggctggggcctgagcccatacgtagtctcaatcgtccaagcacatatggtcgctaggacgtacggttagcatagaaccatagatagcgcatacgtccgataatgctaaaaacttgaatcgtcgccaacaaatatatcataactacacatctgacatgactgttccaatcatacacaacgaatagattttctcgtagattccagagcgaggcaacattccagcacaagtcggctgagattctcatttaggcaatccatgcctctacttagctagtgttatatgtaagcgcgagacagtgcaatgatacagatccgtaattgtaggcttgatttccctcaattgcctcttattcgctccgcgacgcccgctaatcaggctcgtccgcatcacataacttacctaaatcttaacgctgtactcctaaaccacctacaacaaaatacatgggcgacaggccagagccaacaattattccaagttgacaggcgacctatcagcgaacggacaagactctcaacctccttcttatgactaaatacttgcgctaccaaattctcctttccattacta

SEQ ID NO: 630551 - DNA, 928 bp, Homo sapiens
  misc_feature (928)..(928): n is a, c, g, or t
tcattggttattttctttcatagcagaattacagaagaaaagaaaagaaaacctcgtggtttccagtgtttctcccgggaaaatattagcatgtgatacccatttatatcctccaacttagtgggggagagggaaagtaaaaggtgaccttaagaaagaacttctttaacgaggcaacaaagtgaagccttttctttagagggaactttgtggcatctcagttcacagctcataagaaaatacttttttctccgagggtataattataggcccaatatagcctctcaccgtgaaacaagtgacgagcttattcacatgtgtgccattatattctataatctctttataatattgtggagaatgtgtgcaagtgtcgtgtataaaactgtctcttttataaaagcaaagtggtacccatattataagagaaacaaatttaacacaatttgaaatgtgtgtgtgaagaagaaactttctacaagaacaacacaaaacaaaagagagagcggggcgaggcgcgcctcctcatagagaagagtatatctccctcgcgagaggggcgccacgacagagtatatagagcggggataatcaccccgagatttttacggctggtctacccaggagaggtgggcccgcctaatatataagagagaaccgtcgccagaataacatacacaaacaccgcgactaatggggcggcgaccctggtggagacgccggacccggagatatacacaccacaccgccgctagccggcagacacgtggtggggagaacaacaaccggtgtgagccatacgaccctgtggggaggaacacacccctgtaggggagacacaagagaagaacccgcccatttcaacacaactccaccagcgggggggcggcgcggtacgcaccccactctacctctttgggggggcaan

SEQ ID NO: 630552 - DNA, 264 bp, Homo sapiens
gtacaaagaatctggtccatgatgtttaggaatgataactatcactactgctggatgaatgacttcacgaatttaaaaaaaaaaaaaatccgtaaacggaccttactcggtgttgtaaaacttttctttttctggtaaaggattttaaattgcctatttacaattgatgaggattaaaaaatttctttacaaaagagaccttacgattttgaaccattatctctacgaggatttaagtgaaattagagctcttctcagatttgg

SEQ ID NO: 630553 - DNA, 125 bp, Homo sapiens
taacttgggacccccaagttgtaaagatttattttttacctgacagttataccccaggtaaactgtcattgaaaaaagtgaatcaataacttgtatttgtttaaaaattaaattaatcccttgat

SEQ ID NO: 630554 - DNA, 136 bp, Homo sapiens
gcgggcgactagaggacccacactgggtcgagtactggcttaagtgatctgctgccttggctctcaaagtgctgggatataggcgtgagcaccgcgcccagcacagttgctccatttttaattgaacttctgttgc

SEQ ID NO: 630555 - DNA, 399 bp, Homo sapiens
  misc_feature (209)..(209): n is a, c, g, or t
tcgaatccgctcggaccccacacgcacttggcgggtgtggtggcgcgtgcctgtaatcccagctacttgggaggctgaggcaggagaatcacttgaacctgggaggcagacgttgcagtgagccgagatcgcgccactgcactgcagcctgggcgacagagtgagactccacgtcaaaaaaaaaaaaaaaaaaaaaaaaaaaaaaaaangggttttttgggggggctggaaaatttggccatttttccccccaaaaaatttcgggcccatttttttttaaaagggaaaaaaccttttcccttttaaaaaaaatttaatttttttttaaaaaggttcccaaaaaaaagggggggggggggggccctttaaaagggccccggggggaaaaaaaattttgaa

SEQ ID NO: 630556 - DNA, 116 bp, Homo sapiens
aagtggtaagggacagggaaggaaaggacagaaaacacaaaacagaacaaaacaaaacaaaacaaaacaaaacaaaatgattacaaaactcatctgcagatgaacacaattaacct

SEQ ID NO: 630557 - DNA, 417 bp, Homo sapiens
acgattggagtaagcactgtcaggctaaaggtctctaaagtactctgtgtgaaacctaagtgaaggaagacaacttggtgtagttgctcttcaacacttccattcccaacattcattttcccaagctcacttccccatggatagaacctgactggcccttaacagcttttggcaaggccagaaggacctatcaaactatataattcactatgggaggattcaaaccgggatatttgcatttttgaaatccatcttgaacaaaaactggtgaaccagcctatgttttactttcctgtgtgagaaatgatgagggtcacattctttataccaaagtgaagacatgagatccaactctgagctcaccctgttgctaaatggataatgccagtactctcttgtggaaagtattaccagaac

SEQ ID NO: 630558 - DNA, 546 bp, Homo sapiens
tgctctgcacatcatcttgctccatgccctccctaagtaccagtgaagaagatggcacgtcggcatacatcaggtcaagcttgtaggtccaggcgagcccaggcgtcagcaatgtgctgtaggtgtggctcagcgatgtacacagttctctgtaccttggtcaggtctccaccaggcaccacagtgtgaggctggtagttgatgccaaccttgaagtctgtggggcaccaatccacaaactggatggtacgcttggtcttgatggtggcaagtggcagcattggcatctttgggaaacaggtcaacacggtacaacaggcagcaagccatgtatttaccatggcgagggtcacatttcaccatctggttggctggctcaaagcaagcattggtgatctctgctacagaaagctgttcatggtaggctttctcagcagagatgacaggggcctatgtggccagagggaagtggctgcggggatagggcaccaggttggtctggaattctgtcaggtcaacattcagggctccatccaatctccagga

SEQ ID NO: 630559 - DNA, 293 bp, Homo sapiens
ccattctgatagccggtattgttcgccgccagtaccgtcagtgggttactcatcacccagcaggtcgcactggacgttaaaatctgccccgacgataggcttaatccctgcgccatgtcccgctccgtagaacttcaccagaccacaaaggttggtgaaatcggtgatcgccagtgctggcatacccaacgccgccgccttttttaccaacggtgcggttttggccaggccatcgatcatcgagtagtcgctgtgcacccgcaggtgtacgaaacgtggttcagacatcttca

SEQ ID NO: 630560 - DNA, 814 bp, Homo sapiens
aaacaaaaaattcggctaggtacgaggccgcgggtttaatcaggcagaggccctgagacgtacctcagaacccacaggtgagaggggagggctcctggggcagagaagttccttaggttaactttcggaatgaaatatcctcccttccccccatctctgagatggagtgaagcccaccaatctcgccctttgcagtgtgcagggtggaacggtaagaggttcggtgtggagctatgagaggctgcccatagtggctcatgcagaccatgacatggaggctaagcgcgtggagtgaaggcatctagtcacataccaggcgcatatgtctaaccccactctctagtctcggggctacacagcaactacgggtggccacgaagatgtccaccctagataggagtatgtactacacaatcgagtgagtgacattctatcacacataatgcaccctaccacacccctacaactttcatcgatataacgactacaccttgaacaggacaaatgcatcagaagggtcccccagagggtctttgaccaaaacattcggacacgcaccaaagacacttcaagacgccaaattgggaggacagagtggaaaaaggaactggatcgcattaataactcccaacagaattccactaggaatccatacgttggcttcaatagtgagtttgtgcattgctagaccacaacctcacatgtggccccttccacatgtacgagttacaatacctcatagcagtaaatacatatagccacacaacatactagtgtgatgttacacacaattaccccaatacgtaacaattcg

SEQ ID NO: 630561 - DNA, 172 bp, Homo sapiens
cgcagtgggaggcgaactttacttttctcatccttaccaaccagtattgaagcaatgatttggcaagccttggactcgatcaaagaaagtgtccttgagagtgaggagataggcacctgttagaaaatcctgaatagcagcaatcagcggttccccactccccgggatacag

SEQ ID NO: 630562 - DNA, 907 bp, Homo sapiens
ctaaccggaaagttaaaatgatgttgatgtcgatgtcctgaggacctattggccgtgccgatgtgcaaagctcagcaaaaagaagctaggtgaacccttcgttctacgccagtacctgttcatcttataatcacatccatatcggtagtgagatgacctatatgacggccatgctatatacaatctgtggagagaaggcggggacaatcttgcttggagctttccaatcggctagaattgggccttgcaggaatcgccgcgaatgctcactctgtcaggcagtcgaatagcgtcgtcgtcgcgtggcctggattggcgtggctgatgaaaacgaaccaaatggaattggtggccacccgggatcgattggcctgtagtggccgcctctcgagaagacaaagcgacaccctcgagggcgtcctagggcactagatagcgggtcgttcctacagttacttcgtgccggtgcgggaccttggtttggcgtgttcagtcgatttcaaacgaaaagggttggtgcagccattccatgaggaaaaatgcaagggaattccaatagttccgactttgcgacgccaaagtttacacgagtttggcacaaaggggtcgttctgtcacgctgcttgacatagcgctggtcgagtcccgtcctcgcactagctggtagacgttcccaccttggtcgaggccatgtcccccacgcacatgaacgtggtgttgcttgctagtgcactagtttaatacgtaagtcgttccatgacatttgttaagggactttttacagggtcatacattcctactatttgggttcatcacaaaaagtgggttaagctaatttaaaaattctcgggtaagcctggggatgtcaggttgattcacttcgaacgggacctagcaaaaaacaggg

SEQ ID NO: 630563 - DNA, 193 bp, Homo sapiens
gttcgtgattggtgaagatcctgagtcgactacttaacacactggaatcaacatgaaccattatatataggtcaggtatatcacgtacagcgagtcatagctaaccattttgtgacgatctccatagaagtgatccgcggatattgtgagttacataaatgcacatcatgcactttgccgagatgtgcagaac

SEQ ID NO: 630564 - DNA, 2963 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
  misc_feature (2815)..(2823): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630565 - DNA, 552 bp, Homo sapiens
  misc_feature (7)..(7): n is a, c, g, or t
aggtttngtttaaacttcagaaactgaagctttatttcagcctgtcctgccatgaggtctccagtgagaggtctccagtgaaaggtctcatgtaattgtttctcttttatctcccaaatttaatgtgggcaataaaattctcctttcgtaattcactgttttattacaaatacgatattactgaaacatcttattagcagataagtatagaccaggagcctaactgtgttagatattttcagtgcacatttcacagttgtttttcattttaggattattttgagaagaaaaaatgttttgtaattgaaatagttttaatttcctttaaaccataatttggtttttctatctatattatattcagttcagttttcccatataacttttgtgaagattggctagtaccacaaaataactatggcttcacaatactagtgttagattatgtcaagaagaaagtgttttagttacaacatacgccacccactgaggaccttgtagtgggataaacaaaaattaaaatgcaacaatccaaataaattataatgtaac

SEQ ID NO: 630566 - DNA, 694 bp, Homo sapiens
  misc_feature (286)..(286): n is a, c, g, or t
  misc_feature (364)..(364): n is a, c, g, or t
ggaatcaatacttggcagttcaatttcaaatttaaccttacagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcatagtggctatgattttggctatatggtaaagttgcttacagattctcgtttgccagaagaggaacatgaattctttcatattctgnaaaccttttcttcccatccatttatgatgtgaaatacctgatgaagagctgcaaaaatcttaagggaggtcttcaggngggaaaaaacgggtttttgggctttgattcagttggatttgcagaggattggaaggcagcaccaggcaggctcagactcacttggctgaaccaaggggaaaatggctttctttaggatgaaagagtgtttttgaggacagcatttgatgaatgccaaagtactggtgggccggggtttcctttaaaatttttgttggcgcggggggggggggggggccttttttttaagggcacaggagtggccagaagcagaatgaggatgtggactctgccaggagaagatgagcatctggcgattatcaacaaatgcagcagtgatggcgcaggctc

SEQ ID NO: 630567 - DNA, 2718 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
  misc_feature (2570)..(2578): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630568 - DNA, 2797 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcaga

SEQ ID NO: 630569 - DNA, 151 bp, Homo sapiens
aggggggggggtggcccgggggggggggggggtttccttttttttccccggggggcccccccccccgggccccccccggggggggtccccccgcccccccccgtgggggggcccccctttttttttttttttttttggggccccgggggga

SEQ ID NO: 630570 - DNA, 2511 bp, Homo sapiens
  misc_feature (2363)..(2371): n is a, c, g, or t
gactgatactgaatcaggaagacagaacagtgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630571 - DNA, 593 bp, Homo sapiens
gcacgaggatgatatgatattattcagcaaagacttaaatgcaaataagaaaatcataacaacactcaagaaacaatacgatacaaagataataaatctgggtgaaggtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcac

SEQ ID NO: 630572 - DNA, 153 bp, Homo sapiens
gggggggttgggtttttttttttccccgggggccccccccctttttttcccttttaaaaaagggggaggttggggggggggccccgccccccccctttttttttccccgggggccccctaaaccctttttcccttttggggggttccccccca

SEQ ID NO: 630573 - DNA, 489 bp, Homo sapiens
actctataggatccccgtcactgcgtcagcctgagcaaatgcttcgcgcaattctatgagggtttctgggccgaagagggagcacagcagtaggccgccgggccgtagtgcttggcggaagccggcgaatactgttggtagatcttcgatccactgtaggcataggttgctgaagatgacatcgacactcgcgtctgccactggcagggtgcgtgcatcgccacatatctgggctaatggtttccaccagtgactgcgtttccgtgcttcttgcaacattggcattgcttgatcgaatgcgatcacttgtgctttaggccagcgttttttcattgcgatgctggcacgtccggtgccggctcctacatcgagtattacacgcggtatgcggtcgccgagatagtccagagattcgagtagacgttgttcaacttcgtgttggagtatggcgttggtgtcgtaactgcgggccgcgcgggaaaaggcgcg

SEQ ID NO: 630574 - DNA, 2457 bp, Homo sapiens
  misc_feature (2309)..(2317): n is a, c, g, or t
gactgatactgaatcaggaagacagaacagtgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggaggtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630575 - DNA, 450 bp, Homo sapiens
  misc_feature (356)..(356): n is a, c, g, or t
tttgaaaagataaatagattaaatgaacttcatcaagggtaaaagagggtaaaaacatgtaagtttaaaaataaaaaaggaggtacaaccatgttacagaaggaattaaaagtcataaatcgatacaaagtgaaaacaaaaaagtatgatcttttaaacaatatacaaaatatcaaaattaatcagaaaagaactgggaaattttttaaaaaacattaattgccatagagaatatggaaaaggtgacttgaaaactaacattgatacagacagtaataccagatggtgtcatagctgagttttaacttttacaaacagatagttaaaatgctacttaaatattctaggccataganaatttttttaaagttctgtaattcagtagtaaaagaaaaaaacagcagattaattaaatataactgcaaaaataaaaaatcagccaatcagtca

SEQ ID NO: 630576 - DNA, 2457 bp, Homo sapiens
  misc_feature (2309)..(2317): n is a, c, g, or t
gactgatactgaatcaggaagacagaacagtgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630577 - DNA, 1461 bp, Homo sapiens
  misc_feature (1313)..(1321): n is a, c, g, or t
aacctaggctaggtagaggcccggggtaatcggccgaggggcccgccacccgattagaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630578 - DNA, 1524 bp, Homo sapiens
  misc_feature (1376)..(1384): n is a, c, g, or t
gaggaccccaaaagtcactcttctatatctaccaccgatttgaggtgaggatccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630579 - DNA, 195 bp, Homo sapiens
  misc_feature (65)..(65): n is a, c, g, or t
tcagaatctggtggtgatgctttggctatctgcttcagatacagcgtcatgatgattacctggtnatgcttaaggcaattcggattttgttcaggagcgcctgacacaggatgcagttgctaaggcaaatcaaacaaaagagggcttacctgttgctttagacaaacattattcttggtttttgacacagggaga

SEQ ID NO: 630580 - DNA, 2462 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtccaacaaaaaacacataaacaacaataaaaaaactttttggggccgccccgggcccccctgaaagaaaggcttttttcaacgagcacacaactcttctcgagatcgaggaggaccgcagacagacggtgtagcgcccccacccaagagaaagagagtggacaacctagagacacactaggttgggcacaataatacagctgggagttcaccattaggagaaagaccacctccaggggaggcaacaagagaacgtcggggcgcagtgggagtcacctgacacgccatattataagagaaaaaccccgcctcggagggagaaaaaccgaggaggcagatcggaggacaagacgcccaaatgaggtagtaccaggaggggaaatacagaggcggactattcacacgacgaggggtacaag

SEQ ID NO: 630581 - DNA, 800 bp, Homo sapiens
  misc_feature (559)..(559): n is a, c, g, or t
ggctgggactcgcgtcggtgggcgactcccggacgtatgtagtttgttggcgcctgggttctgagagccttgacttctctttacttttccactcttaggtcccacgattgccgcacggttaccatacctgggagtgagattcacgtccgtcggctgaccgtaaaaactctttaccgtcggctgacctctatgaaaggcaacgtgtggttctcaaatataggcattctgatgggaacttgtgtgttcacatagtaactagtatgcattgtagtttgtttggtgtgataaacacgagacctaaagctctaagatgtacacagtaaggatttgcagcaacatatgtccacagtcagctaactgcgacttattggtatgcccataggcaatgcccgccaactgttaccatgagaaactgagtcgaatggtttgaaatcgagagactttgtcagtgctactctaggacagtaccatgatcttttgcaatcagagaaagtgtagggacagacagtactttatcgtaactgaggtgggcctcgttcagacagcttcgaggtcattnttctcgtcaggttgtgctgatttaatttactttgtgcagaagctagggattgcgggattgttttcaggttcagaaagcctttatttactatttttgtgaaattgatcgagaaatgcagttctgtcttaggaaacctgggaagattattttgatgtttagggtaaacacgatgtaattggttgcctctggcaaggtttgtaatcgagttaactttgatagaatgagatattagggaaaaatc

SEQ ID NO: 630582 - DNA, 1507 bp, Homo sapiens
  misc_feature (6)..(6): n is a, c, g, or t
  misc_feature (1359)..(1367): n is a, c, g, or t
gacccntctggtccatgttaaagggggaacctagtttttccctgggaaagtaaagcccacaaatgggtaggtttaatgttcccattgcccacctttatcccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgagctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 630583 - DNA, 384 bp, Homo sapiens
  misc_feature (35)..(35): n is a, c, g, or t
  misc_feature (38)..(38): n is a, c, g, or t
gcgtcgactgcccgccgtggaccgcgactattacntgnaccggccgctgtcgttcgactccagtgcggtgaagctggagttccagaacatcgagcgcgacattacccgacgtctcggccagttcagcccggtggggcagatcatgcgtcgcatgtgccgcgaataccgcatggtggtgcgtatgctggaagcccgtggcaccgaggacttcggcctgatctcccaggaactctacggcgccgctccgatgctttccacgccggcgacccgaccctggcggacctgggcttgatgctctccgactacctcaacaacatcgacggccgtggcgacctcaaggacgaagccaagaccctcaccgccaaggatgccgtggcgctgttg

SEQ ID NO: 630584 - DNA, 176 bp, Homo sapiens
tgggcggggcacacattaggggggggacccgggctggaattcgaaatcggggggagggctgttccctggggggaaaacaacccccggggtaattttctttgtgggtccgggggttcctgggggggaagcggccctctaattaagcttttggggaggccctgggaattgccaacaca

SEQ ID NO: 630585 - DNA, 188 bp, Homo sapiens
ccgagctgataccctcgataagggcaacctagagtgagtggcacaatctcagctcactgtggtcttgacctcccaggttcaagcaatcctcccaccgcagcctcctggagtagctgggaccacaggagtatgtcactaaaccctgataattctttctttctttcttttctttttttggccttatcgag

SEQ ID NO: 630586 - DNA, 1060 bp, Homo sapiens
  misc_feature (414)..(414): n is a, c, g, or t
gcccacgtccaccttactaccagacaaccggttaggccaagaccatttaccgcaatataaagtataggcgatagaaatcgtaaacctggcgcaagtagatatagtaccgcaagggaaacgatgaaaaagttataaccaagcataatatagcaaggactaacgccctatacgcattctgcataatgaagttgaactagaaataacgttgcgaatggagagccgagaatgctaaggacccccgaaaccagagcgagctacctaagaacagctataaatgagctagcacccgtctatgtaagcacaaatagtgggaagagttaataggctagaggacgagcgatgggccgtaccgatggcctgggtggactagtcctggattgctccggaagtactagaagtcgtccagttgtcaancgttctcatgaagttagacctcacaggaaaccgtctaacaaatccctcatgtctaaaatttaaactgtattagtgtgccaacaggagcgaaacagcatcctgtcggacatacttaggacagagaagccgtgtgtaggacgaagaacgtcatacaacattttagagcaaccgcaagtacagttaggagctctaaaaagcattgtccacgcaaatttaaagacgaacgcgttacaaaagctcaaaaatccaactatctaaagaagagtcccaaagcactttttagaacgtggaaggtcctcagggacaccaaattgtgggaccgaaatcctacttcgatcctctttaattagacagaagctaaattgtgaaacgtcagttaacgttcaaccattgtgggaagggacattttcttgcacgtgcgacggtcgcctcacatggccctgggaccgtcccacggaatttcaaagaaccaactgggagagcgggacccgagttttaacacatgcctccaactagatcttacaaattccaagtcaaaacaagggttccattaattggaccccattcacgtagttaaaacccccaaaacacaaaggcacattggtacattaaaggaaacgggtgcaggaaaacgtccaaacaggga

SEQ ID NO: 630587 - DNA, 395 bp, Homo sapiens
gggaaactccaacagtgctatgaccagaggacccagaaaatagcctcaaaagtaagtaaaggtctcccatagcgagaagtggggcagagtttaatggctcccgtctgagattgagtgcaaagagacttaaaggagggtgcaggggatgccgagctgcaaggctgtcagatatacgtaatgaaacatccaggagggtgcaggggaggccaaggctgcaaaactctcagatatacgtaacacaccttccttccagaggacagcgcccccactaaggacaaacagggaaagcatcacattgactggcaggacagcgagggaaaggtctgggaacgcgtcagagtcgtgaggtcacacgcactcagagcagctccacagagctcagttctatacccgtg

SEQ ID NO: 630588 - DNA, 201 bp, Homo sapiens
ctgtcttggatagggtgaggataggatttagcatatcacagaagtataagggggaagggaaggtagaacagatggtagataaggccaaagggtcagaaaaacatcagttatattaacgtggaaaaagtaaaaagaaatgcaaatctaaatctgaattcatgggacatggactctgatttctctctaagttctatagaacaa

SEQ ID NO: 630589 - DNA, 216 bp, Homo sapiens
gattatgaaaggtgaagttgagtgaaaggagtttaggaacgtggaagacagtgagctctccccctaaccctgtaaaaagcatggtttccatagacccataattcccccttttatacatctgtaaataaatggaatgtttttaagaaaataattatgtccgatttagcctttttttttatatattaaaaaaaaatatctttccctttctgctttcga

SEQ ID NO: 630590 - DNA, 245 bp, Homo sapiens
cttagtgctccctggtttcgaggcgtacaccggcgcgcgcctcgacgcgcagctcgacgaccaggcgcgcgcgttcctgctcaagtcgccggagaagaaccgggtcgacgtggccacccggacggtgtacctgggccccatcttcgtcgagttccgcgactacatcaacgatttcggcggcagcgaggcggccgtgggcaagtacgtcgcgcggggagcactaacgaggtccagggagcactaag

SEQ ID NO: 630591 - DNA, 392 bp, Homo sapiens
gtttgttaatgtaaaattagtgttctgtctgaagccacgtaaggatgattctggtataaatatggtaactgcaggccagccgtggtggctcacacctgtaatcccagcactttgggaggccgaggcgggcagatcacgaggtcaggagatagagaccatcctggctaacaaggtgaaaccccgtctctactaaaaatacagaaaattaaccaggcatggtggtgcgtgcctgtagtcccagctactcgggaggctgaggcaggagaattgcttgaacccgggaggtggaggttgcagtgagccgagatcacaccactgcactccagcctgggcgacagagcaagactctgtcaaaacaaaacaaacaaaaagtaagtttggtaactacctgg

SEQ ID NO: 630592 - DNA, 481 bp, Homo sapiens
aataatgtcatttctctagacatacaacgcatataatcttccatgtgtggaacccttcagtatctccgggcatccaatagtttccatactttgtatttattatgctcaccatcattaaaccatgggctaatgcatgcgccccatatacatggatatatcttgctactccagagatacttgtgaaaatgctccgcacatatcattgtggcatcacctattattcatcagcttcgacacttttgatttcagatgtgtataccatctttgattcggctagttagcgcatgtataacatgttctttccctccatgccttgccgataccctataggaagttttacatatctgccctgatatgtagacgagtatgaacatcgttgctgtgcttgtgatactgaaatacctgtgacttttgctgatgatcctctgtgtttatactgataccctgtgccgtatttgtacactgccagacttctgagctg

SEQ ID NO: 630593 - DNA, 111 bp, Homo sapiens
accggtatggctagtcgtcagtgtctggttgctggggtcttacaacagcaaggatgtgcaggaaggtggtacaggctactcctagtttcagggccttgggaagtggtagtg

SEQ ID NO: 630594 - DNA, 221 bp, Homo sapiens
acatttgcaggtgttggtggtcgaaggcaaacttgaagcggtgcgcagcgccgaaggcagcaacgtcaccgagcgtgaactggccatggcgtttcccggcaaggtcggtgaggcgctgaacctgcgcgaggtcgagcaactggtggaccagctcaaccgtttgccgtccaaacaggcgcaaatggaactgacccccggcaagcaagtgggcggcagcgacg

SEQ ID NO: 630595 - DNA, 744 bp, Homo sapiens
  misc_feature (1)..(1): n is a, c, g, or t
  misc_feature (73)..(73): n is a, c, g, or t
  misc_feature (84)..(84): n is a, c, g, or t
  misc_feature (89)..(89): n is a, c, g, or t
  misc_feature (122)..(122): n is a, c, g, or t
  misc_feature (143)..(143): n is a, c, g, or t
  misc_feature (163)..(163): n is a, c, g, or t
  misc_feature (192)..(192): n is a, c, g, or t
  misc_feature (194)..(194): n is a, c, g, or t
  misc_feature (207)..(207): n is a, c, g, or t
  misc_feature (216)..(216): n is a, c, g, or t
  misc_feature (228)..(228): n is a, c, g, or t
  misc_feature (234)..(234): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (274)..(275): n is a, c, g, or t
  misc_feature (282)..(283): n is a, c, g, or t
  misc_feature (285)..(285): n is a, c, g, or t
  misc_feature (296)..(296): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (319)..(319): n is a, c, g, or t
  misc_feature (323)..(323): n is a, c, g, or t
  misc_feature (362)..(362): n is a, c, g, or t
  misc_feature (374)..(374): n is a, c, g, or t
  misc_feature (410)..(410): n is a, c, g, or t
  misc_feature (420)..(420): n is a, c, g, or t
  misc_feature (440)..(440): n is a, c, g, or t
  misc_feature (479)..(479): n is a, c, g, or t
  misc_feature (533)..(533): n is a, c, g, or t
  misc_feature (554)..(554): n is a, c, g, or t
  misc_feature (592)..(592): n is a, c, g, or t
  misc_feature (606)..(606): n is a, c, g, or t
  misc_feature (629)..(629): n is a, c, g, or t
  misc_feature (636)..(636): n is a, c, g, or t
  misc_feature (651)..(651): n is a, c, g, or t
  misc_feature (655)..(655): n is a, c, g, or t
  misc_feature (680)..(680): n is a, c, g, or t
  misc_feature (694)..(694): n is a, c, g, or t
  misc_feature (725)..(725): n is a, c, g, or t
ntattcgaatccaggtacagactggccaacctgcctctacagcgtccacagcgaacacagggctagataaggnaggagtatctnaaaangttttaatcggttctttccgcgtcacaagccancgggtaaggcaacggaatgtncgtcgcggccccctgtcgcnccgcggtcacaatactcaccctggcatcncngtcagcaaaacanacatttgtntcaccataaaanaccgcnccgccgcccctcgggtctcacaacacgcatcananancannaatattnncncccttgtcacncncntccccngaaaggggacccnaggngaccccccgggacacgccgcggggccggtagacagaccncaaagacaggcncccccccctcccgggtcccaccctcacacgcaggcnaaacacacanatcagactctggtccaaaanttgaaggaagaaaaaaccctgaagtctgacacccagtcntctaggcgactcccggccaaggcgtcgcgtaaggcaaccggagcgatgccagangcggcgacacgcccgcccctnccctgaagctcaggggctctaagaaaggaccggggctncctgtgcctaaacnactgggcggccccgcctgcactntggaaantgggtcctgcctgtnactnaattacaaggaataaaataaaagtnacagcatacaaggnaataccacaaggaagtttagattacactcanaccattgtatcaacttgct

SEQ ID NO: 630596 - DNA, 763 bp, Homo sapiens
  misc_feature (677)..(677): n is a, c, g, or t
  misc_feature (680)..(680): n is a, c, g, or t
  misc_feature (742)..(742): n is a, c, g, or t
taaaactaattctggcaggaatcagggtggcaataggactagcagcaccctggggtggcttcgcctaccatgagttaacgctaaagaacttggctcaaatcctagaatccttagccaccaacggagatcaggcattaaagagaattcaagagttccccagactctggaaaatgtagttgttgataacagactagcattggattatttactagctgaacaaggtggggtcttgtgcagttattaataaaacctgctgcacatatattaactctggacaggttgaggttaacattcaaaagatctatgagcaagctacctagttacatagatataaccagggcactgcccccaactatatctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttaccgaaaacagatctncgnccttctgcagcccccttaagattaaggaggagtatctaatctctgaaaggggaatgaagtangaagtgggactcactctggaa

SEQ ID NO: 630597 - DNA, 163 bp, Homo sapiens
gacccagggagcgtaagtgtcagctcgagggaggctgaacctgagcacgttagccatgcaggaacaatggcggagcctctagcccgatcaggagttggcgatgggcacctcgctggatcagaaggtcagtggacacccgtgctggatcccggacgaggtggga

SEQ ID NO: 630598 - DNA, 235 bp, Homo sapiens
tgcaggtagtcagtggggtttatttgacttcctttctgctgggcacaggaagctttcacagggctagggtttaagctggcttccacagagggcattcacgtgcacgtgggcctgatgccaaccccaggtcaggtcccgatccccggtcctaaggggcttccactcaggcttgaggcaagaatctgacggcagcagttcccgaaagcccttgccgatgcctggcttcatccagagc

SEQ ID NO: 630599 - DNA, 846 bp, Homo sapiens
  misc_feature (210)..(210): n is a, c, g, or t
  misc_feature (261)..(261): n is a, c, g, or t
tctggctccgtatgcatgcacaatgaaatgaccaccctggactacaatgtaccatgcccatgtgctgtgctgtgaatgaactgtggaatgtgcctgcccatgtggctgatggctgtgatgttgcccctgtgtgtgtgtgatgtgcctgatgcaatgtgctgtgtgacctgcctgcctatccatgtgcccatctacaatgatgctgcccancttgtgactcacctgtgcacccagtgatgatgtgtgctccgcccagtgtcnagagtggtgaagcccctgatgctacaccctcatgtgcctagatgcctatgtgccctatcccagccccttcacaatcctagcccgctgatatgtacgatgtatgcttggcatgttactgttgtgcatatgtgacatgaccgctgaaagtctggagaactgtgtgcagcctccgagttgtgtgtgatgagtgtgctggtggagagctctcgactatctgtactttctggctaagcggttgtgacattttggttgatgagtcgaggccactgaggtgtacattgttccaatcagtgtgacgacccttatgactagttgtgcttgaggattgtggacctagtaactcttgctctgccctaatttggtggcatcctctagtgcgcattgttgatcgcagctatcttcatgcagcgcgtgctatgtgtgctggggcagtttgcccttggcctgatggccagggtggatcacatcgcgccgtggactctccaaatgccgaccaggcggtggcgtcatgcgccacgggtctcaccaaccttggtgttggattccaaagcgccaggtgaaggaccggagaccgctggggccctg

SEQ ID NO: 630600 - DNA, 191 bp, Homo sapiens
  misc_feature (126)..(127): n is a, c, g, or t
ctaggcttgcctgaacttgggcatggaagaaagactggaaactaggttggaaacaacatacttatggaaaagaaagtcagcctttttatggctggttaacgagatggtcgagagtggattctcacnncaaagttgctatggttggtaaggcaggcccaactggtaagatgtactaatttgtgcttcccctg

SEQ ID NO: 630601 - DNA, 236 bp, Homo sapiens
cagtggggatgcccccccccccccaaaggcatctacccctgtgtataaggaaaaaccttttcctttgctggacttgcttgagcagttttattgtctggacatgtgagctgtgtgaaataaatgtgaaaagttcaaatgaatgccttttcctgccccctgtatacagattgtcatctgtacaaggaactgtatgtatgaaaacaaatgtacttttttataaatggctaacccttgga

SEQ ID NO: 630602 - DNA, 146 bp, Homo sapiens
gacttctagagtatccccttccaggcttgattagcaggccactctactcatgcatctaatttcgaagcgccaccctagcaattatcaatccatttaacctttccctcttacactgtatcatctttcacaatttctaatttctactg

SEQ ID NO: 630603 - DNA, 914 bp, Homo sapiens
ctgctgtgagagtaagttagtcaggtatatcggggccgagctgcgtcggactcgggatgcatcatgctcatgcatactcattggggactcagtgcatggtctccgtgttaactcgcgtcctgtcaggaggatggggaacgtttaaaacgactgagcggagggctgttgactgtcacgaacgtttatcggtaaacgaggtagagtgaagataaaggtagacgagggtcaccatgaacgtctggcatgaccatcgtactgcgtgtgaccaatgagcttcatggtacggtgaacgtgatgtcttccgagaatgagcgggtgtacgggaatcactgacaaagtggtaccgaacgtgtgagtgagggatgaaagcgagccatgatgactatctggcacactctccttgatactggtacctacacccacggtgatgttgaaaacaattggaaggattgaagatagcactgtatgtggtgggaaatcgataggaagtctctctaactggacagcgtgggatacacaccctgaaaaagagtggcctttgagaatgagtagagaaggaaatgactggggaggatggagaaggttttgtttgagaaatgaccgttgtgggagaaggtgttatagcagagcattgcaggttttatgccttactggccatgattagagagatgtttgcagaaaagaaagatgaggaagaaaaacagtgtcggaacgaaatcaattcggtgataaagacaacgctgtgggtaagctactctggccacatgacaggggtgcttagggaaggtgacagggattcatgtgattcccctgccaagggaatagtgggggccaccccacgatggaacctaatggggattatcagaagcattttagcctgcaaccattgaggggcagcaatagcgccacttatt

SEQ ID NO: 630604 - DNA, 310 bp, Homo sapiens
  misc_feature (13)..(13): n is a, c, g, or t
  misc_feature (306)..(306): n is a, c, g, or t
tcttgtcccccangctggagtgcaatggcgcgatctcggctcactgcaacctccgcctcccgggtttaagcaattctcccgtctcagcctcctgagtagctgggattacaggctcccgccaccacactcagctgatttttgtatttttagtagagaccgggtttcgccacgttggccaggctggtctggaactcctgacctcaggtgatccacccgcttcggcctcccaaagtgcctgggattacaggcgtgacacccgacggcccagctgcaactttgattcttagtaaggaagccagaatttgnatcc

SEQ ID NO: 630605 - DNA, 924 bp, Homo sapiens
gctttctttggcaagatggcggagtccgacttgactactcgcatcgcgcacacttttggatcggcatctagtcttaccgcttcttgaattgctctctgtacagggagatatataatgaacaggaattattacacggtaaaactttggaccttcttagtgataccaacatggtagacttgtgctatggatgtattacaaaaaccttttattcggatgatatcctcatgcttgtgagagagaaaagaaccacagttgtttggccaccaacttgaaaccagctttcagcgccagaaaacatgaacccaattgtgaacgattgtttgaagatcccagaaacctacaaatggcaactgtgggtcaacccagggatggttccgcaatgctctttgtgactacctggtggacaagcctttgtttcacgcgcccggacttattcagcatccactctacagatatgcaaaattccagtacgaatgtggggactttactcaggagacacgcagaatatctttatcgcttaagagtgcttgtttcccaagccacagattagaacatgcttacgttcacctctggggaaagctggcctctgcattcttcattgcagcatggttgccgccattgaagaccttacctggttaaagacgaccatagataagtaattctgggagttctcaacttcagcttctcagcagagaacatgctcatcactggtctggctggttcttaataccccaagtcgggatatatattgcctttctttacagcagaatttagcatcgcacgtgcacattcgattggtcccgggtacaacggttcaacgcgcgtacaatcgtagttaagggttattagccaaggcgtatacctggcgacggggcaggatctggtggacagcctatcatattacccttctctcgacatcttccc

SEQ ID NO: 630606 - DNA, 870 bp, Homo sapiens
agtatatcgctcacacctcatatcctccctactatgcctagaaggaataatactatcgctgttcattatagctactctcataaccctcaacaccgcactccctacttagccaatattgtgcctatgccatactagtcttgccgcctgcgaagcagtgggtgggcctagcccttagtagtctcaagctccaaccacatatgggctagactacgtacataacctaaagctactccaatgctacggctaagtcgtcccaacaattatattactagcactgagatgactttccaaataaacaacgtaatttgaatcaacagaaggcacccacagcctaagttatgagcatcatgccccctactatttattaaccaaagtcaacaacaaacctatttagctgttccccaacgctttaccttccgagcccctaacaagcccccctccataatactaactagctgactcctacccctcagaatacatggacagccgagcgccacttatccagtgaaccagctatcacgaagaaaaattctacctctctatacatagtctccctacaaatctccttaattataacattcacaggcacagaaactaatcataatttatatcttcttcgaaaccataactttatcccatcgtgggtaacgatcacccgatgagggcaacagacaagaaccgctgacacggacggcacatttcttctatactacaccctagtaggtccctttcccttaatcattggcctaatttgaattcaaaacccaagggtacgaacatttagtatgcacttgtggccagacttaagtctggccacaactatagggggttacaacacgttggaaaaaccttcggcaatattctcaaccg

SEQ ID NO: 630607 - DNA, 145 bp, Homo sapiens
gaagatcacccagtacatcgactttgatcatgtgttctctcgagagactgaagaaatcatcccagggactgtatggctgatctgctataacgagctgcgcagaagattgaggggtgtgagtacgctgactgtggggttgcccacg

SEQ ID NO: 630608 - DNA, 143 bp, Homo sapiens
gtacaggatattgatttcacggaggatggtggtcacgggacccctatcttgagtttgggtcatccatgtgggacgacgaacgggactttgcctgtaactgttgctactgtacggtaaactggctttactgtactactgtacct

SEQ ID NO: 630609 - DNA, 1217 bp, Homo sapiens
cgggtgcggcgtgtgtggagctggcggctgcagaagcagcagcagcagaaacatgcggcgggtactcatgatgccccgcgtccggaggcagacgactgcgccaccccaccctcgcacggccagggcgggaccgcgccaccagcccggacctccgtcgtcccgcggcgaccaaaagccccgctggccccaccgctgtgacatactctggactcgcccgcagagtttgcccgccggggagggtggccgattggcggagcgcactcctgctgttttccccaccatctcgtggatgtcgtccctcgggtggtgagagaactttgcagtgggctggagcgccctttgcggagaagcacactgacaggtgaaggcacaggacacagcacaagacgaccgaggccgcaggagctcggcagaagggtccggagcggacggtccggcacgtgcagggacgagtgcgcccgaggacgcgggccctgatgctcccgggctcgaggagcattgggcacttgcagggactgctctcggtggagtagccccgtcggggcccggagggattggtgcaacctgcggaaaaacacgagtgctggtcagcacggggcgtgccgagacacgctcccggagcgaccatcacgaatattcaccgactcgataatccgtagatccccgagcaggaagcatccgatgacgtcttcaacctcgctccccctttggcgtccgggacagctgacaggcaaccgtgccgaaggagcagcagaatcttgcggaggagatgccacgaaagcagtgcgagatgagatggaggaaagcaggggagctgacgagccacatgaacgctcgaccggccaggccagcatcgggaaaaacgccagaaaaaggcgagggaccaggacaacgggccaaaaaagccggccgggctgaatgttggggccaggccatgtgaccgtgaagaaggaaagaaaaggatagatttgatgagaatacgggtcaccagatatgaacggtatcaatatagggctcatcaaaagatcgaacatgaagtagaaacgagttatcatatatcataataaaatgtgtaggtgtcatcgagtagagaggacaccaaggaagaagataacaggagagatgaacgaggagagagaagtaaagatgaacgttctagccgacctatcagagaatcgaaatctagagatcctcgattgcatacgaaatagatgaaa

SEQ ID NO: 630610 - DNA, 798 bp, Homo sapiens
  misc_feature (482)..(482): n is a, c, g, or t
gcccgtttgcagacgcacgccgagaaaaccgtgtactattagccatggtcaaccccaccgtgttcttcgacatgccgtcgagggagcccttgggcgggtctccttggagctgttgtgcagacaaggtcccaaagacagcagaaaatttcgtgctctgagcactgagagaaaggatggttataaggggttccttgctttcacagaattatccagggtttatgtgtcagggtggtgacttcacacgccataatgcactggtggcaagtccatctatggggagaaatttgaaagatgagaattcaccctaaagcatagcgggtcctgcatctgtgtcccatggcaaatgctggacccaacacaattggttcccagtttttcatctgcatgcaaggactgagtgtgggatggcaagcatgtggtgttgcaaagtgaccagagggctgaatatggtggaggcatggagcgcttggggtccaggaatngcaagaccagcaagaaagatcaccatgtgctgactgtggacaactcgaaataagttttgcctgtgtgttttatctttaacaccagaatcattccctttctgtagctcaggagagcacccctttccaaccaattgtgtccgcagtatcctaaaaatcttgtgtgcctctccgctgaaagttccttttggttcccatgttttccttgtgcccttccatgctactggattgcagggtaagttatggtttggcataaaacttattacactgtttccacacacaaacacaaaaaaattgtgggcccgccccgaaatttaaa

SEQ ID NO: 630611 - DNA, 396 bp, Homo sapiens
  misc_feature (4)..(4): n is a, c, g, or t
  misc_feature (35)..(35): n is a, c, g, or t
  misc_feature (278)..(278): n is a, c, g, or t
cccnaaaaaaggcggccctgtgtaacctttttaanaaaaagaattgctgttccctaatacctaccccagtccaggacctagttacaagatgcctgctggaccgaataaatgaaaaaagcttctggcccgggtgccaaggttgtcacgccctgtaatccccagatctttgggaggctgaggcgggcggatcacgaggtcaggagatcgagacccatcttggctaacacggtgaaaccccgtctctactaaaaatagaaaaaattagccgggcgtggtgncggcggctgtactcccagctactcaggaggctgaggcaggagaatggcgtgtggggtgaacccgggaggcggagcttgcagtgagcagagatgatgccactgcactccagcctgggcg

SEQ ID NO: 630612 - DNA, 224 bp, Homo sapiens
tgcgcggctcagtatgtgtccaagcaagctgcagacatgattcgtctggatgacaagttagcctcaatagtgactggagtatgaggaaggtcgtctgatctttgataacttgaagaaatccatggcttataccttaaccagtaacattcccgagatcacccctgttcatgatatttattattgcaaacataccactaccactggggactgacatcatcctctgt

SEQ ID NO: 630613 - DNA, 207 bp, Homo sapiens
tccccccccccccccccggggagaaattgcctttttcaatggggccccccccccggggagttggggcccccccgccccgggggacccccttttcctgcgggcccgggacaaaccccaggtttgtttgccccccctgttttttgtggggtatgggatgggggccttcccttttttttttccccataaaaaaaaaaaaaaggtttgtta

SEQ ID NO: 630614 - DNA, 215 bp, Homo sapiens
ccccccccttccccctttaataaacgtgctccctgttgggtgtcttttttgaagactgcccggcctaggctttttgtaaagggttttcaagttcccggggtggtagccctgtttcctggtgaaggggtttttttccccctggaatgtgcctgtgtgggtttgtttgggtttttttatttatattttttttttttaccaagttttttgccccctta

SEQ ID NO: 630615 - DNA, 204 bp, Homo sapiens
cagaaacagaaggctatctcaatcatgaaaattattaatattaactgctgttagagaaatgaatgagcctacagatgataggatgttacatgtggtgtctgcatcggggtagtccagagtaacgtcggggacataccggactaggccgagaaagtgtagtgggaagacagttaacactttacgccgatgaatactgataatgaa

SEQ ID NO: 630616 - DNA, 186 bp, Homo sapiens
cctaatagttcaccgccctgtaggacatggacagttttgcagaaacatggtaaggcaactagaagcatactttctgctgaaaagagtctctgggggtcttgtctacgaaacatacattctttgtcccttacaaactcatacttcaaaaatgaataaaagcattggaaatggcattaaagttttaca

SEQ ID NO: 630617 - DNA, 130 bp, Homo sapiens
cctctctcccctggttactcacattaccagaccagcaatacttctcagcctcccctgattctcctcccagcacccccaacccatgctcctgagccttcaagccctgctcggatcccagttccatttcagc

SEQ ID NO: 630618 - DNA, 492 bp, Homo sapiens
  misc_feature (54)..(54): n is a, c, g, or t
  misc_feature (237)..(237): n is a, c, g, or t
accttctgtggcacacgtcaaaaaccaatcaggtcaactcgggcggtgttcctnctaaggttgcaggtgggcgagaaggtgtggctggctgtcaataactactacaacatggtgggcatccagggctttgacagggttttttccggcttcctgctcttccccgactagggcgggcaaatgcgctcaagccccacgggccttccacctccctaagcttcctggatggacccaccttantggccagtttgcatccttgcctagaccattttcccccccaaatggatttttcctccagggaggccaccctgacccacccccaatgcaccccctccccatgggttttctccttcctttgaacttctttaggagtccctgcttgtgtggttcctgggacacttaaccaaagccttttgggaccgccattctttttttttttttttttcaagaattggaaggggtggggagatatataaataaatcatgaaatccata

SEQ ID NO: 630619 - DNA, 347 bp, Homo sapiens
agcatgtcctttcaaagcagatgttgtcttctctctagttatgaaagtcctagacggcaccttcttccaatggaaggctgtttcctctacactgacaatctgtttagtcacctgcatcaatgatcttagctagatcttctgggtaacttgcagcagcttctacatcagcacttgctgcttcattctgcactcatggtcttctgcagcttcatcacctctcttaggcttcacagaattgaaacgagggccttgctctggattaggctttagcctaaggaaatgttgtggttgctttgatcttctattcagaccattcaaactttctccctagcagcaataaagctgtt

SEQ ID NO: 630620 - DNA, 225 bp, Homo sapiens
ggaggagcacttgacccccaaaatttgagactagcctgggcaacagggttagaaaccatttctacaaaagaaaaacaattagcctggtgtggtggtgcatacccttggccccagctacttgagaggccaaggtggaaggattgcttgagcctaggtggctgcatgcggctgtgatcacacaactgcactccagcctgggcaacagagccagatcctataaatgag

SEQ ID NO: 630621 - DNA, 135 bp, Homo sapiens
tggaagccccataagtaaatccccaaataattaaatttgcctaatggagcaatttgcagattaaaaaatagaacaattttcaaatctttggttttttttgtattaaataccaatccctataactggcaactccca

SEQ ID NO: 630622 - DNA, 296 bp, Homo sapiens
aatgaaggtcagggaaattaaatgattgagctgcagatacacggccagtaaatgagagaggccaaatattttgacaccttgccatgtgtggtttttattactctgagtagcctctagagggtaaatgtaggttttacaaaatgagtagccgtgattcctttcttcactaggaattttcaacatgctcaaatgattttggtgggggatagacataagtagtaaaaagcaggtttcataaaagcttaacttttgactggagtttgtaataactgcatcagttaagattaggttcacta

SEQ ID NO: 630623 - DNA, 558 bp, Homo sapiens
cttagaggattcctccataatgtgtgccaaacagtcttcgcacttcctgctttaccttcccaagaagctggaaatacaggtgtacaccatcacactcatcgaaactgcaattttgatccaacaagtgaaattacttatgagacccatgagggccaggaaataatcctaaaaaaggtactgacagtctgattaaaacaaacatcaacactgctaaattttacctcctcaatcctctatggaaaaagtcaaggttcttttggcacacatgaattcaccagcagagatacagtattgggtttttccaggcgcggtggctcaagcctgtaatcccaggactttgggaggccaaggcaggcagatcacctgaggtcaggggttccagaacagtctggccaacatggcgaaaccccgtctatactaaaaatataaaaagtagtcgggagtggtggcaagcacctgtaatccaagctactccaggggctgaggcaagagaatctcttgaacctgggaggtggacattgcagtgagttgagatcacactgggcacacattatggag

SEQ ID NO: 630624 - DNA, 491 bp, Homo sapiens
agtcaaataacccctactatttattcagatatgataaggtctgaagatggatggacgctatcattaattatcagccaacagcacctgacatgctgcgtgctgtgtgtcttgtaccgtagatgcagattccgtgatcaatgatcatctctcacgtgcacaaccatcactcacttgtgtccactttcttgctgcaaacatgtataagatgaaggtcaaccggtctccctgttctcatgcctacagaataagggaacatggctgggacaaaaccaacaagcatgaggcatggtcatgtcatttatattcatgaccacatatatcaatctggccctcactttcacacatgaatttatttagtatgtttgcatttatattttccgagttgaataatttacaccacctcctctccaaatgtttgttatttcggttggaataaatggtgtcagaaatgaaacctgaaaaagaacactattgaaatggtcgccaatccg

SEQ ID NO: 630625 - DNA, 675 bp, Homo sapiens
  misc_feature (46)..(46): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (100)..(100): n is a, c, g, or t
  misc_feature (583)..(583): n is a, c, g, or t
ggcgagcgccatggccagtccgggctgcctgctgtgcgtgctgggnctctactctgcggggcggcgagcctcgagctgtctanancccacngcgacaccnccaagaagcccatcatcggaatattaatgcaaaactgccgtagtaaagtcatgacaaactatggaagatactatattgctgcgtcctatgtaaagtactgcggagtctgcaggtgcgagagttgcaccaggaaggctggatcttacagagaaagactatgaaatactttacacatctatcaatggaatcctttaccctggaggaagtgttgacctcagacgctcagattatgctaaagtggccatattgtataacttgtccatacagaggtccgatgatggagactattctcctgtgtggggcacatgccttggatatgaatagctttcactgctgattaacggacagtgcttattatctgccacagatactgatgacgtggcaatgccgctgaacttcactggatgtcaatcgcacaacagaatgttccttttgctactgagttgatgctcgcattagcacttgaacctctgactgccaatntccataaggggagcctctccgcgaagaatctaccatgaatgtgtatggtaacatggaagggcataagtctccctgttggggtcagcagcttc

SEQ ID NO: 630626 - DNA, 948 bp, Homo sapiens
ggatggcaagctgattccaccacaagaatggttctgcccagaaagccagttgcagggccctggatgtctcggctttaacaagttgtattcccttatcagagcctgctccagttcccccaatacccaatgaacagcagtttgagccagactgacggattatgtggcttgcctgtgaaaacgtggatttagtcactctgagttcaagattcatctttcagaatcctgtatacgtgaccaacgtagaaatgtacaagttcgtattttcaactttattgggttggttaaagcacctcagtattaccgttactatgtgataaaatacgatatagaatataagatatactatatacattttgtccatagcacgttcatgctgaaatagtgcgttgacaacacgttctcacttttgtagctagtttaactaagtctggaatggagcctgtctaggtattcacggtaaagttttctgaggtgactcactaacacataagatttgcctgtttcatgtacgcaaaagtgtttgtgcaacctgtgcttgtctctgtgcccagcacgatgccgtgactcttatatgtaccatggggtgaccatgatactggttcattttggccttgaagaacatgtgctcaggccagtatctgaatcactggggattaatgatcagctcttggggaagatgttttttagcccgactctgaaagggtatgttgattcggaactgcttggaaaagtgaccattgcctactaacaagttgtaacttgaattcatgtgtggtatcaagaggcgggaggggcacaaaagggattagaatttgaagagataagggggcgggccaggaacaatgggggattgggcacaaaagattgatagcgaaggataataagggatgacaaaatgatataaggttagtctgtttttgtgtccgctggtgtttatatctttcgggt

SEQ ID NO: 630627 - DNA, 206 bp, Homo sapiens
  misc_feature (93)..(94): n is a, c, g, or t
  misc_feature (133)..(133): n is a, c, g, or t
tcttcatgcagttttccataatggctgtactaatctacgttcctaccaacagtgtgtgaattcccttttctccacatccttgccagcatttgnnattttttgtctctttggataacccctttcggaaatgggngggaaaatgatagctttctttgtgaagcggaatatccagaacacagctctcggagctaggagcagatgatttt

SEQ ID NO: 630628 - DNA, 1063 bp, Homo sapiens
cgcaggatcgagggctaagatctgatgccttggagctcacgtcaaggggcgcttctctttaccatgagtctttcgccagaatgtaaatccttgggcgttcctctgccaaagagttcctgcgtccggggactatcccggcgatggggaggaagccctgcaccttgcgaaccgcgcgttggagccgcaatttttatcgagaacaccaattcgtcttcatccgagcgtgtaatcattaggaaccctaatccgctgttcgtcggtccgggcagttccctttcgtgcggagttgtgcgttccggaaggcggtgtagtcacatagggggttcctctctaatgggccccgtttggaagggcgacaggaatctttgttcgaaggctcactaggtatcgccaacccggaggctctcacatgtcatcgttgctatgggcatggatgcttaatgtccacgtcctgggggaaaggctaagccaccgcctcctgatgatgatggatgcgtggctccacggacggcggtggttaattccagttggtgtccattttcctctcccaccaacgtatttccataggtccgtttggtcccctgagcccttccttgtggaccgtcctgggatcccgattctggagggggtttgccttcttggatccaaaggccctgttgtttccgtttttgcttttcttttttttttttctttgtttttttttgatgagcagagtttcactacttgttagctcaggctggagtgacaatgacgcgatctcgggctcgcagcaacctctgcctccttgggttgcaagcgatgctgtcgcctcagatatcgcaagtggctgcgattacaggtgcccaccaccacgcccagctgattgttttttttgtatttttagtacagatggggtttcaccatattcaccaggctggtctcgaacttctgacctcgcgtgatccacctgcctcggcctcccaaagtgttgcgattatcaggtgtgagccatcagcgccggcccaattgtcatatttaactactccatgtgtcgtacatattaacttcacactactacatatcc

SEQ ID NO: 630629 - DNA, 291 bp, Homo sapiens
cggcgcccagagactggagagacaggcagccacattggcttttggcttaggaagggaagggcctggttatgaggtgtggtatcctgctaacagcagccaaccctctgctcacaaggaagaaagtttggtgttgaggggggtgacagatggctgtaagaatgtgatcatacatatagctgagcctggtctgttgcactgttctctcccatattcttagggtccaaaggatttgccgcttagctttgaaaagctattgcttgccttggtcacatagaaactgatatgctctgc

SEQ ID NO: 630630 - DNA, 359 bp, Homo sapiens
gcgtcgaccccatgtgttttgctccctctcttcccctgaattccactaaaatgtcagtagtaaagaagtacaagaggctgggcacggtggatcacacctgtaatgcagcactttgggagacccaggtgggtggattgcttgagaccagtctgcacaagatggtgaaacctcatctttaccaagaatacaaaagattagccgagcatggtggcatgcacctgtggtcccagctactcccagatacttgggaggctgacgtgggagaatcactttaacctagaaggcagaggttgcagtgagctgagatcgagccactgcactccatcctgggtgacagggtgactccatctcaaaaaaaa

SEQ ID NO: 630631 - DNA, 277 bp, Homo sapiens
cctgcccgttttttttccatggagccccaagcccctttggggccagggacaccaacaaggcttttttttgaccctcctgttgcacccagccctggttttagcagggaccacccctggctccactttttgagctttttatgtcctttaaatctcccactacacccgggcgggtggaaggtggagttttcaggtcttggcgccttgcaagggcagaacactaacctgaccgtggcggggctttcggtatccgcccccaataaaagcaattccaacctta

SEQ ID NO: 630632 - DNA, 121 bp, Homo sapiens
ggctgggagacggatctggtttaccatctttaaacaaaaggcaaatgtcttctcttccttcagaccgagccattaacactaaaattcttgtctgggacttcttccctcctgggtgctctgg

SEQ ID NO: 630633 - DNA, 85 bp, Homo sapiens
gcggccgcctactactactactgctcgaattcaagcttctaacgatgtacggggacatgcaataaatgttctggttttaaaaagt

SEQ ID NO: 630634 - DNA, 1632 bp, Homo sapiens
cgtgacgcgttgggtcgatcacacgcgttcgggttgttcgtggcttccttcgcttatcggagaccaggtctacatccgagaaaccatgtccaaggggatctgctagatgggctattggatcctgggaaccaacctacgtcttgtggtgggtgttctcccacgccataggtaacaagtcgcagataaattgccaatggatctaggggcacaccagaacctagttccaaagctatgtcgccgtttgacaggagcactgcaacaggatatgatctggtggcatgccggcaggcagacacatcgcaagcttagctgaatgcaacaccactacacttagacacaggtatctcggagtgcgccaatgcggtccgtagaagttggggacagctcggtatcactcgcattgcatgcctgataaggtccacagatcatgccagtcatggcaacaccattttggccccatttagaaatggggtggctgcacatgcatgccgtggccagggcatcgaaaggcgtcgcacagctcacgcaatcaccaaggggcagcagcaacccaacaacagcctgtctcatcccagagaggaagcgtgattccattcttagtgggatttccttgatcgcagagccttgaacagggcaaaacttggcaccgaaggccttacccaattgggggaaagcaacatgatatacaccaagtggggtgggtgggtacacagggatggccaagtcggttacactattaaaagtagaacatcgttcaagaccggtccaagggagaatagcgcaggaaaaggaactgggccttggggacacccctactgtggcatggggatcctacacaacgaggtacacattgacgcaccactactcactgtaacgctgacacgcgccacccgtggcttgcgccgtgcccttcaatgtaggccataacaagggcgatatcaccaccgacgaacacacgagggttcgcgaacagcaacccacacagacacaaccagttaggcactacaccacgaatctagacccccatgcgcacatgctgaggcacaccacgtatatcgcgccatgatgtctgtcagaccatcactaccacacattaactgagaagaagagacctaggaacaacctcattgaccagacgacacacaggttctccacccgaactaggagagcgagacacccaccaaacaattaggggcggaggcacaacaaaagccgtgagcagagacccggacaaatgagcgaccaaccagagtagaatacagacacgacgtagtactaagagcacacaacgagacgacaaacacgccactcacgtgtgaatcaagagcaagaccaaagaaaaacacacaaccaaacagatcgaaaaccaagcgaccaggacgacgaacatccaagcaaaccagcccaagagtcaagacaagcgaaagcgaaaggaaagagaacagcagcagagaggagacaagcaacgaagggagagacgaagcagagagagcgcacaaccacgagcgagcagccgaaaaaaagaagctagacaacagagacaacacaaaaacaatcataggaggacgaaacgagcagaaacagacacgagaacaaacgactcccgacgtgcagcaagaaacgagatacaca

SEQ ID NO: 630635 - DNA, 760 bp, Homo sapiens
taaagaccagataatggggagaggatgaagagtcatatcacaagtgacgacgtcgagacacttggattccagtcaatgtccaccagtagagtgcagctggtctatgtgtgcagtgggatcaaccaagtgaatcatcgaggcataggatatcgaggttaggtgagatgggagagggctccttcaaggtaatgacctgaggtctgtggaatgaaggtgttacagctgggtcgtgaacgttggtagtgctacgcaagtaggagtataactactcttgtgggaaatatggaaaaacctacgcatattagctatgtgaactatgatgggagtgcgccacgagggaaagtagaaagtatgatcgaaacaaggtgataacaggggtagaatcggtgcatgggctggacgtgtgcatggtcctgattgttgttgatagtgtaggtgaatgagaagactggtatgtccaggagatgggcacgatcccgatcacgcagtggccttcgggtctttacacaccgggggggatcgaataacagcgtaagttagtaagcgtgattaacgcatcagtggagttccgacgtaatacgcatcgctgacaggacgtgagaatctagtatggatttgcaagttgtccgtggaacgtcgcaacgactgagcttaagcaaaagtctggtgccacacccgacaagtcgtacgtgtctgtgcccagttctttgggttgcacctcgtctgatcacgatgcttggcaagcaaaggtggtaacagt

SEQ ID NO: 630636 - DNA, 443 bp, Homo sapiens
tgatgattacaagcatgagccaccgtgcccggccagtaattttcaatagaaagaaattctaatacactaacaggaaaacctagagtgaatgaagtgtactacaataggactttacaactctgaaacaaaagagctattaatggacccatttctcccactctaatccctcctcattttctttttcttttctttttttttttttttttttttttgagacagggtcttggtctgtcacccaagctggagtgcagtagcaccatcatagctcactgcagcctccaagtcccaggctcaggcaatcttcccacctcagcctcccaagtagctgggacaacaggcacatgtcaccacaactagctaatttttttattttttcatagagacagggtctagttatgttgcccaagctggtcttgaactcctgagctcaagtgatcctccca

SEQ ID NO: 630637 - DNA, 926 bp, Homo sapiens
tgtggtggctcatgcctgttatctcagtactagaagaggccgaggtagacagattacctgaggtcaggaattcaagaccagcctggccaacatggcaaaactccatctctacaaaaaatacaaaaatagccaggtgtggtggcaggcgcctgtaatcccagatactctggaggctgaggcaggggaagtgcttgaacccgggaggtagaggttgcggtgagccgagatcacaccactgcactccagcctgggtaacagaagaaagactccatcgcaaaaaacacaaataaccggaaacaaaacaacataaggcaaaataacactgtggcacgattcaagatggacttggcagaattcactgctagcaaaacttgacacgactgatacacacaatactccatgtaattcaggccgggcgccgctggctcacgcctataatcccagcacttcgggaggccacaggcagcgcagatcacgaggtcaggagatcgagaaccatccgtggctaaccacggtgaaacccggtctccaactacaaaaatagcaaacacaaatttgaccgggttgtagtggtgggccgcctggttgtccccagctaccttccggagggctgtagtgcaggcagaactgggcgttgaaccctgggcgaaggtgggagcttgccatgtgccgccggagactggcgccattggcacctcacaagccgggtccgacatgagccgagactccgctccaacaccaagacccgacaaaccaagagaacacaccctcacaacataggcatggagccgcctataaaccaaacagtcagcccatgggcttcctcatacagtgatgagaagctgactataagttgaactcagacgcatctcgcacactggggacctcactcgtagagatctgatgatcctacacagaattcaagc

SEQ ID NO: 630638 - DNA, 774 bp, Homo sapiens
tcacgcttaattcactttatttttctggtataaaaaccctatgttggtacccacagcgggagccggagtccgctgcagggaaactcgggggggggtctggacgagggggtcagggaactccgtggatggggagactgggtgaattacaggctcctccttctccagaggttcgggggctcaggtagctgtaggtcttagaatgtggcttcaaggggtggcctgggcgaagtttgcccagggtgtggcagtgcagccccgggctgaggtgtagcagctcactcgataccagccatcatgagcagcttcttgaggcacgaaggtgcggagacgatgccagtgccccgtgggttgcgagggatgaggcgtaccagcacagagccgcaggcggcctgtcacctgtgcaggggacagtggggggcttgccgatctggtccccccagtagcctcgtgcgcagcggggacgatggagacgctggtgccatggtatgtatggcccccagggttgggggggggccacctcctgggaggccttaacacccagaaccgatgtggccatgtgtgagtccccgaatagccaacaattgcgcttgaacctggtgccgctggccggacaggggcactggcgctagcagggcataaccttcaaaactccttccttgtgaaaagaggcccccggaagaaatccagactctgatacctaagggcggggaaagaaaaaccccccaggaatggatcaaggctgaccacggccatgggagggtcccctaacggtgc

SEQ ID NO: 630639 - DNA, 914 bp, Homo sapiens
tgttggccactcctcgggcgccactttcagtgccgtgtgtggtcccccgatccttttgggggcccatgcattggggcccctccgcccatctccaaggggcctgtgcgctggtgaccacccgttcggagagtgcttctgagtccaaggggctggtcacaccacagttggaggaagtccatctgcatggccatttggccccccagggcccagctgtgctgacgacattagaaggtggccacataggtctctggggtgagaagaccagcacagaaaactgccttactgaagggaatggggccctggtcaagaagggggccaggcatctggaatcaggggagtgcatcatcctcaggagctggcccacgcccggctacaccccgggcaccccgcctttccaatcacgctgggcgcccacctttcctccttaagacaccccttttggccctcacgtctgtgtccccttttcacggtatgagattggggctgctatatggggactggccctcgtatgggttgaggccccacggcacgcttttcacgccccgtatgcacgtggagcacggccctgtcctgccctcccacgccatataccaccctccctggaggccacgctgagatgccctggctaacttggcaccccgggaacttcctgacacccaccacgtccattaattcctcacggggcctgtggctggagaaaaggtgcccagcccccacccactcctcagctgccccccacacctcttctatggcacgagaggcacgggagtggccctgtaacactagactgctggggagttgggtttgatttgttttgttttttttaattcccttttgataatttttttcctgcttctgggtggtggtggcacatggatgaatgagtatttaataaaagttcccaatttccacca

SEQ ID NO: 630640 - DNA, 87 bp, Homo sapiens
attcattacgaacgaggaagccgcggcggagcccgaaccccgcagcctgagccacctccgtcatctgggcccggggcctcaccgcgc

SEQ ID NO: 630641 - DNA, 450 bp, Homo sapiens
  misc_feature (101)..(101): n is a, c, g, or t
  misc_feature (236)..(236): n is a, c, g, or t
  misc_feature (284)..(284): n is a, c, g, or t
tcacttcctgaggttgacatttgagaagaccaattggtggtggctgctatagatgacagtggggcggtcagaacaagcaaagacgtgggtgtgtagaaagnagaacgaaagagtcctcaattacgggtgggctggggtgcccaagagtcacctttcttagcggtcgctcaacagaccgtgtctcaattgttggatgcccaaagtagaaaatgcgctccattctcccaagtgcacgnaaggaggtaatgggctactcctcaagaggtggtcattcaggatggagncgaggaattgatctctccacccatgcatctcctttgtgcatgtagttcaacaagagggcaacttcaagatacgagccgagatgtccgtccagaggccaagggcacaaagaggggacagtccatggcggtctcctaatggggtgatgtccaagcaagccacttcatg

SEQ ID NO: 630642 - DNA, 718 bp, Homo sapiens
  misc_feature (44)..(44): n is a, c, g, or t
ttagccaaaccatttacccaaataaagtataggcgatagaaatngaagcctggcgcaatagatatagtaccgcaagggacagatgaaaaattatagccaagcataatatagcacaacggactaacccctataccttctgcataatgaattaactagaactcacttatgcaaggagagccacagctaagacccccgaaaccagacgagctacctaagaacagctaacaagagcacacccgtctatagtagcaacaatagctgggaagatttataggctacgaggcagacaaaaccataccgcagcctggctgatacggcatggttgtacacgcatagaatctatagatacaacctccacaactacagcccacccgaaccctctaacacatccccattgctacaactacacacactgagaaagacacacaaaggcaggaaccaagctaccacacgagacaactaggcgaagaaaaacaaccaggacagacgcagcagtaacacaactctaacaaccgcataaacacagccacaaaagcaagccacccaaggacgaaaagcgtacaaagcagtcaaaaaacccaaataacctaataaaatccccaacacatctaactgaacacagtaaaggccaataggtaccaatcttatcaccctatagacgaactcatggcagtccaagtaacctgacacacataccctccggatacagctggtagga

SEQ ID NO: 630643 - DNA, 264 bp, Homo sapiens
ggatcaccgtgcttgccacaaaaggattggccttactaaattactggtatcaaaattttatcgaaaaagggacaaaatagcttaacatatttaataccgtatttcaggggagatacaaaacatatttgaggtatgtactcttagttgactgtacaatgtattgtaatatttaaagcccatatatattacatatagtctagcacagactagaaatagattatcagtagtacatattaaatacaacaatattaaacaaataagtaa

SEQ ID NO: 630644 - DNA, 125 bp, Homo sapiens
  misc_feature (19)..(19): n is a, c, g, or t
gactctagcaggatcttanctatacacctaccacaaattatgcagtcgagttccacatttggggaaatcgcagggtcagcacatcccggagtgcaatggataagcctcgccctggtaggtatcag

SEQ ID NO: 630645 - DNA, 142 bp, Homo sapiens
gataatcaggaagcgggcggtggaggagcagcagagggagagctcggggatggaggggaaacagcggaatatctaagataatcgggagggcagcagaggaagagaacgaggacaggagccttggcagtctactaccagggaa

SEQ ID NO: 630646 - DNA, 108 bp, Homo sapiens
accctgtctccagactctattctcctgcctcatttggacccctacaatctaattgtgaatgtaacaggtaaaaaaagttgcaaataattacgtagaaggatagcttca

SEQ ID NO: 630647 - DNA, 102 bp, Homo sapiens
cactctccttttgcatatgtgcagtatatctagtacctaacttcgcaaccaatggaactgctcggtccaaatggtatgtgcatctataactttgacagacaa

SEQ ID NO: 630648 - DNA, 253 bp, Homo sapiens
cgctacaatatataatcaactacaaataaaaactaaacttaagctgatatagtcacctatcataataaatctaaaagcatagcccttctattggtattaatacggggctctgtagtcctttctctcacattatcttttaaatacattttatcctccatgaagcagcttcatctcaccctccgtcatgtcttagaacccttttatcttttccttcctcatgctcctcttctcagtcttcatattttcatgtgag

SEQ ID NO: 630649 - DNA, 279 bp, Homo sapiens
gcacaatgcgagctcatttacaacatggaatcggtgcacaatctggtctacgcccacgctgcagttcaccctatacaccgtcgcgcggttgacatcaaccgggcgctcggcgcacaactcgcagaagcctcgcgtgtcgtggatcaactggcgcaccctaagagcgtcttcaatggaactcagtcgagatcaacccgctctgccagttcttctctggccatttatcagacaacacctgattgccgtcgcagtttcatcgggttgattgtctatggcacc

SEQ ID NO: 630650 - DNA, 901 bp, Homo sapiens
  misc_feature (386)..(386): n is a, c, g, or t
ctcgggcgcgtctgctggtacctgcgtccgaccggcggacaggctgctttggttatgtgacctcgcagggcaggacggccatcctctccagaagtgagagatcttcgttgccaggtgctgctgggctgccccttcgtgggtgtggagcgagccagctcgctgatgtgcgttctcctgacttgaagccagaagagcaatcgtgtacgtgcgctgaagccgaccatcgtgctccgtaccaggacaactactgcgtgactgtgtctgctagttgccggcattgggaatcatcgtgacactttggaccacaggcctgagcagagaccatgttccccgtgcctggccaccatcccagaacggcgatcaactgcttggctgtggcgttccantggagcgtcaagctggcctgtccacgaggctttctgtggcagacttatcgatgctggcggcgcgcatgagcgaggctgctggggcgaagccgtcgagccactggcgtggagtagccggggctagctcgctgaggcgctgctgccgggtcccttgctgacggctctcggggcgccctgtggatcgcggcgctcaagaaacccgcttgttctcgcacttcggagtgccgcggccagaagtacgagggcacacgggacatacggctctcaagtggcgcatgtgtcttcggggaatcaccccaacggagggtggtaactaggtggggaaggacgcgccccgttggaagcatcccccataccaccaggttggcctcgtagaagtcggtagattggcccccatttcgcggttcgcccgaggggattcgatgggctcccaggctcgtccgggtgggcaccacggcatacacccacccgtgggcaacacaatcagtgtgcaaatggcgaccctacaaagcaaa

SEQ ID NO: 630651 - DNA, 677 bp, Homo sapiens
ctaggcctaggcgctgattcggcactacctgtgcacgactaagaaggagcacatctcaactgataacatgtctttagaaactctgagaaacagcagccgacaatacgctatttgatgagagttaacagactcaaaaaatactgaggtgatcactaaactatgtcactctatctcatttctctgaactgaaagaggagaatgtccagtgagcagccgctattaccgtgtcttacaatgtaattccatacaccgcgcattgaaaccattgtgcacaatggactacacatgtctacaaagatacgagtttgacgatgacattggcacattatgctaaactatccatgcagcatgcctataagtacatatatcggacgacactgtttagtgctcaggacacatatctcatattcattcacacatatcatatgagatagctgtccaacatcctgactgggaagattatgaaagcaggacaaacagaacatcattttaaaatgtcgtcagctgttcttgaatagacgtattccaacatattctgaacattgatgctggaacatgacaattggtgtgatgatgtagaaatataagcttagtttggccatcagcattgtgaagatctggtcatagaattttcgaatccttgcataaaaaaaagccgccctcctaggctcagaggg

SEQ ID NO: 630652 - DNA, 453 bp, Homo sapiens
ggctcgcgagcatatacggaagggattactgacagacgcaggacgtgagtactgagtaaatgggtcaggagtctaactaccttgaactgatctcgaggtgactctgtttgtacgcggcaagaaaaggtgatataagctttgactttggctacacaggtctcagcctacaatggggttcggagcatctgagtcatgattcgtaaacgattgttataaccatgggttcaaacagggaacaagtaagaggtctggtggcaagcggacaagagatgagtccgtcaacccccacaactgagacttgagagggatgagtgggtcctgagaactcaggcaaagctgagtaggtggccccactatcaattaaaaaagagatcggcttacctgctactagtagagttaccctgggctccgatgcagtgatggcagtgggggccgggagccggggcccagggg

SEQ ID NO: 630653 - DNA, 590 bp, Homo sapiens
  misc_feature (282)..(282): n is a, c, g, or t
  misc_feature (299)..(299): n is a, c, g, or t
ttctacaggatcgccaaggtgaaactagaggtgtggccagatcggggaaatattttgtttctgctctaaattgtccttcctgttgcctcatactggaatgatcttcagtgctttagggttagtttcatacttggctcatgctggaaaggaaaggtttcctgaagccttttcatagtttatctgaagtgatttctgtcagtgaaaataggtatcttagaaattctaaagtaaaacaaaaatgataaatgctttatattatctagacttttaggtagttatacnaaggtcacaggaattangtatggactcagattctaactttagcatgatatattaaatgtctgacagacttgaaaatagacctgtctttgaataacttaaagccatatcaagagtaaattccttgaagtgggtaaacgtgaagttttctatgtataattgaccctacatcgtgataatgtcaaatatatttatacttgatctcttcttaaatggcctaagtggggaagggaaacctttcattttagtgtaaagtttattgattaatctgtggtgtaacagttcaagttcaaggtattgagacagataga

SEQ ID NO: 630654 - DNA, 152 bp, Homo sapiens
tcgtaggtttagatgaatgacttggccaggtaaccatgtagtaccacgccacatagccacgtaccacaggctaccccaggcatacgtcaccctaccatagggaaaatactaggtacctaccaggacgaccgatatacccacggacaccctac

SEQ ID NO: 630655 - DNA, 265 bp, Homo sapiens
  misc_feature (265)..(265): n is a, c, g, or t
agccgactcggaccgatcggaagctgcagcacgagcggcttcgcgcccaggcgcttcacgatggtgtgacggtgaagtagaagtccgcgccgagcttgtccatcttgttgacgaagcagatgcgggggacgtcgtacttgtcggcctggcgccacacggtctcggactggggctccacgccctccttgccgtcgaagacggcgacggcgccgtcgagcacgcgaaaggtgcgctcgacctcgaccgtgaaggccacgtgaccggn

SEQ ID NO: 630656 - DNA, 1035 bp, Homo sapiens
cagtggcgacaacgatatgaaactactagtagcaagtccgtaatctctactggggtgcaaatacagtctgttctgggctgagctatatagggtgtcaactaacacatatcttataaccaattgcaaaacatactggagtagtaaccaagatcggaagagattgatcttttttctactatgagtacttaaacaagaaactaaactggttcgccgattaacatagatacacacaggggtgagctatctttatccatataatacctcgtgtcactggtaactctaataatccctccgtctatccatgttatatactcgtttattagattccctgtactcagcggcgttatttcggactattatctcacgccatgcagtgttccctagagaacaggctgatactgtgattacggtcacaatacccatagcatatactaaggaactactagttcaggggttcgaatgatgatagtgacaaggtctatggaataggctctcgtggtgacctcaaagcataatggctatgcatccgtagttgagaacgtccttctgctcgcatatcaggcgtaactttgaggtcgtgttataacgtagttaacatatcaaagtaatccagtggagtgacgtcgatcagtgtcgtagtcattagtctacctcggtgtaatataaatacgtaacaatagtcgttcggccaaccttgacatatacgtctaggttggcaaagggtcattgacaaccggggagcaagataacccctcgttcaaagtaaggaatattccttctgatattcaataccctgtaaacagattgacgctctgtttttatcaaggactgtcattagcccatactctctcagaaagtgacttatcgtacataagtcatgcccgcatctttcaattaacgcggacacaacgattggttttgaggaaagaggggcatagttcgtattatccaccatccctctgataaggttgtctcaatgaggatagctcgtttctcgaaccactgagagggaacggggtgttgttgacccccttc

SEQ ID NO: 630657 - DNA, 228 bp, Homo sapiens
ccgggggggggggggaacctttttttttttgcccggttttaggggtttggaaacccatttttggtttttttggggcccatgggcccccctttcccggggtttgggctttcccttcccttccctttttaaacccggcccccccaccgcccccggttacccccggttggggaattggtttggttccccttttggcctttcccatgtttttttaagcccctttttttttta

SEQ ID NO: 630658 - DNA, 877 bp, Homo sapiens
  misc_feature (722)..(722): n is a, c, g, or t
  misc_feature (877)..(877): n is a, c, g, or t
agcggatggtggctcctcgtcctgcttgactggaagccctgaaacactggtgaaatggagccctgtgcgccactcccgcggtctgaggaccacgcctttcacaggccagtagtgccctgtagccctccctgataagcttcggaggagcttccactcacctcaagtagtcgccagagtgctctgtaccgctgtcctactccctagttggcgaatcactctgtcgtaccgaggtgtagttgccctaggatcgtcgagaatggagaagaaagtaggatcgccgcgctggtcattgacaatggtctcctgcgcatgtgcgaaagctggtttttgctggggacgacgctccccgagaccggtgttttccattccactcgttcgtgcgcgtcgcgccgatacaatcctatggtcgtcaatgcgatggggcatgggcccagaaggaatctcctacgtggagcgactgaaggccacagtagctcgcgtgttatcttgaccctgaaaatacgccaattgagcatggcatcgatccaccaacgtggtaacgaacatgtgagtaagatgcggggtcagcccagaacccttactaacaaccgatgctttgtgctgtaagtggtccccagagaaggaaagcaaccgcagttgtcttgctggacgcagaaggatgaccttgaaatcgcgaatggcaagcacgaggatgaaagatagacttgcagaagttattggtnggttgaacgcaccttcataactagcactcccggtcatatgtagcaagtgggtcctatcacagtgcccgtagcattgtcccctctactgctcgtctagggcggcaccgacatgggcattttgttctgttgggaactcttaggatgaacgtgcgggn

SEQ ID NO: 630659 - DNA, 268 bp, Homo sapiens
tttcttgcccctgcttccagctttgggccaatcagagaaagccaaatgtgctcctcacaccaatcgcgtaagaagccctgcttctagtatagccctcctccaacttcccgatgccaacatcctccaatcagagccaacctgaagtttctcccttttttcagtatatgtaaagcttttccactcccctgcctgcctatgagtctgttaaatcaagtgatgggtcgcggctaactcttcccagctctgagtaaatagcaaattctcatta

SEQ ID NO: 630660 - DNA, 362 bp, Homo sapiens
  misc_feature (73)..(73): n is a, c, g, or t
  misc_feature (80)..(80): n is a, c, g, or t
  misc_feature (161)..(161): n is a, c, g, or t
  misc_feature (198)..(198): n is a, c, g, or t
  misc_feature (248)..(248): n is a, c, g, or t
  misc_feature (279)..(279): n is a, c, g, or t
  misc_feature (352)..(352): n is a, c, g, or t
gagagcggcgcctcactactgactatgctgcgaaaacactacataaggggggggcggggtggcgccacccctngattgcngtgccacggactgctcctgctgggcggagaggacacattttgcaaagcggaggctgcgacgggtcctgcagggggacattnaggaaagggccgcctcatctccgctcctgggggaccncagaaataagaatcgaactccacaatgacgacctatttggaattcattcnacggaatgaagaacgaaatgggagtccgatntagttggaatgtttggccatcgattcgactggaatctacaagaatggttgttcctgtggcaaccctgtttagnccactgaaag

SEQ ID NO: 630661 - DNA, 176 bp, Homo sapiens
tcattagacggcgagaaagtcaatggtcgatatcgctagggtgccgctcataaaggtacatcagtaggtggcctgcagtaatgttagcggttaggcgtacgagccagggctaattggttaaaatgagtaggcggatggttccagataataactcagtatgcgggataacggggttg

SEQ ID NO: 630662 - DNA, 178 bp, Homo sapiens
cggacgcgtgggccggaagtagaatttagaggaataaaatatctgagttgcagggtataggtaaatttctcaaggttataggtgggggttcttaaaacaatgagtggtgtgtgttggtctaaagcgactcacaatcgttagtgacttcaactaaaaaaactaacctctctgctgatcg

SEQ ID NO: 630663 - DNA, 645 bp, Homo sapiens
acctagaggatccgtgatgttatccccaacacctctaatacttgtcctgacagatgtttccatacacagcatggtactcagcttattatgatcccacagatgcagtaagaaaactccattaactaaaacgcaggagtctacgtgccatcttatttgtctataagtgtagactgtattgtttcgggtcaacccgagctcaaaatcacaggaagaaccataaaagtgtagcaaattataatttaccgagatctatgaggatcttatttgtaaacatgaattggtcaccatcagttttccaatagcaagagacacaaatcctagaaaaacttatttcaatttccagccttcaggatttccaaattttcccgatacatttcagactagaagaaaaattaactatttcaaacccactttgacatacagaaaagccctggcatactgaaatttcagattgctggacccccatctcgagattttgattcatcacattctggatgtaacaataatttggatcaagattaaggagccaaggccgggcgcagtggctcacactataatcccagaacttttggaggccgatgtgggcagatcacttgaggttaggagttagagccagcatgccaacatggtgaacccatctctatg

SEQ ID NO: 630664 - DNA, 305 bp, Homo sapiens
  misc_feature (40)..(40): n is a, c, g, or t
  misc_feature (61)..(61): n is a, c, g, or t
  misc_feature (90)..(90): n is a, c, g, or t
  misc_feature (119)..(119): n is a, c, g, or t
  misc_feature (159)..(159): n is a, c, g, or t
  misc_feature (164)..(164): n is a, c, g, or t
  misc_feature (170)..(170): n is a, c, g, or t
  misc_feature (185)..(185): n is a, c, g, or t
  misc_feature (192)..(192): n is a, c, g, or t
  misc_feature (236)..(236): n is a, c, g, or t
  misc_feature (285)..(285): n is a, c, g, or t
aaaaaaaaaataaaaaaaaaaaaaacaaaaaaaaacaagnttgagaacctctctgacagcnctccgaaaaaattgtgaactgagccaagnataggaagttatactaatatgttatagantcaggatggaatgttaagttatcaagaataactggatggnttgtntcctgnatcatcttcttgtgngcccatnctcttttgtacaaactgagggttcactgtgatctcctggcccanggctttccgccgctcatccagctcactgcacttcagcatctcctgatcnatgttatgccgcatggctgg

SEQ ID NO: 630665 - DNA, 229 bp, Homo sapiens
accaccatccactacaactacatgtgtaacagttcctgcatgggcggcatgaacccggaggcccatcctcaccatcatcacactggagaactccagtggtattctacctgggacggaacagctttgaggtgcgtgtcggtgcctgtcctgggagagaccggcgcaagacgaaggagactctccgcacgaaaggggagactcaccacgagctgccccccgggagccctag

SEQ ID NO: 630666 - DNA, 636 bp, Homo sapiens
gtacataatccagtcttcagtaattctgtcaaaccgtgatttcttaattgtgtcggtgcaatatctctattatcgatttaacctcaggatatgcagaacaacaggattgtgtagctgctgaaagtctgagcagtgttgtaccgtccccagcccccctcccacatggtcacatgttcactgtcgtgtccttccatctgtaggttaaggtgagctgagagcatctctggacacatggaagggaaccagggattcctgtgatacagattttgaaccatgcagagtactttggttttcttcatgtcctaagggtttgatccagaaaccctggtgcttcccctgtagaatactgtacttcatttaccagaatgagtgatttctgtttcaatcagcatgttcaccaaaaatagaaaagttcttctaaggttaaatttggtattgaaaagttagttggccatttgatcagggaattttctacacacattaggcaaatgtatgcttttcatcctctgggcttacctctctcctctgcaatcctggaagcatcgtgcatagttctttcattgtaagccgctatttaactcccacaatgaaaactgttaaccagtaatgtgctactgaattgtccaaaacgtatcc

SEQ ID NO: 630667 - DNA, 115 bp, Homo sapiens
tctgtgcgtgtgattatcgtgtgtgctgtagcgctatctgtcttaaggcttaggtgggagaatcgctggagctcgggagcacaaggctgcaatgagctatgaccacgagacagtg

SEQ ID NO: 630668 - DNA, 124 bp, Homo sapiens
ggatccccgtcagaaacgctgaactattttgtatacactgcattcaatcaggatgcatttcaccacgctgcattgaatccacggcattcaatcgggatgcattgggcccaatgccgcggtaccg

SEQ ID NO: 630669 - DNA, 379 bp, Homo sapiens
acacatacttccgcaggtacatgaccaggggcccagcttttgggcccagtaactcagctactctttgcggctggcttcatgtctttttttgtggcctgccacgcccatctttatcaccagaatgaggaactcctgtaagttaactgcaccatcagtgttgatatccaactctttgaaccagacgtctgcaccctttttcctgatatactgaggacactcggtctctagcaatttcttcaggtcatccctgtagacggcatgaaaattcccttttatcagggagtacttgtggtagacgtcgatgatagagttcaaggctttctccagctcgtgcaacatgatgcccacgtacttgccccaccaggtcttctgaaagaca

SEQ ID NO: 630670 - DNA, 112 bp, Homo sapiens
tactatgctttagttacatcgtagtagactaccctagcagtttcttgtcccatctcggaggaagttctctagctacaccaattactttgtgacaagttactaggaactggtt

SEQ ID NO: 630671 - DNA, 1646 bp, Homo sapiens
gcgcaattggcatgcatctctgtccctgcccctggtggtggcccactctgatgtgggggagcgagcctgcctctacgtggggtcgccagcgaggccttactgcatgtacgtcgcgccactgcctagctcgagcaaatgcgtagcgtgccggaagttgccctcgctcgatccggtcgatcgtccgtcgttagcgtcctccttcctatgctatccactcgattcggtccgctgcgatgcggtcccctctcgtaccctacgcgtacgtgtggcatcgctagggtgtacctcatgttgaccgtcccaggagggggccttcgtatggccgtttcctgttgctagaccctgccaggtggcacttgatggacggtcgaggggcacgcgttgcaccttctgtagccaaagatcctatcaagctgcggggggcacgcgatactgtgcgcgcgacttgagagttctgcgcgaggaggctgggccggaagcgcgaagccagatcactactcggttccacaaggggtgtggcctatggaggcttcttactggccaggtgcaccgcggtatgtgggggcgacccttttggaacccccgtttcgagacgccttgagtgagggttagaggataccgcacgaatattagtcatagcgcgtgcaaaggcgagcgttgcgtggcgcaaggtgcggatgttgcatggagcaaattcgggtgcaccttagaacttagagggaaagtccttctcggcataaagggttttcagatgggcaattccataacgagcgcgaacttagcggtaagacacaataaaagttgtctcccctcgggctaccgttccgttagcacacggaatgaggcatcctaggcgaaaactcataaagtaattgagagcaacattaatccgcgggaaccgtacttataactctatctaatcagcccacccgtcaaaccggggactgcgcgcgcactcttgtggccaacagatttttatagacacacctcccaaggttgattggagaaaaggttgcttcccaatagggggacattggtgaaagaccgcgaaattctgccttccacggcaagggggttcccaggacaccacatgtccccccttgacctttcacccttgtggcgctttacccaagaaagtgctcaaggtgcaacacagagtgctccacttttaattacatcccacaaaggtgcccgaaagctcagagtgcagcagacatcacaacccacagggggagccattaccaccccgcacagaaagggttaggagcggggtactttccccgggaagaggagaaagcggcgagaaaactgctcacccccagaggtttcacagacgtattttcccacagcacgaccattgtgacgatgccccacaggacaggggacctcttatattatcccatccccatataaagggggaacaccattcctttgaagacgggtttacaacgcttggtaatcaccctaatatagtcgccaggggccgcagcacgagtgtctcgcgctctgggtataacacaaaaggttcgggggtcatacgatcgtagacaccaccagggtctccacgcaaagaagaaatgatctggcgacaaatagaatgatcaagaaaaagatcacaagagccagatataagaaggaccccaccc

SEQ ID NO: 630672 - DNA, 955 bp, Homo sapiens
tcttctttttttctaaaaaaaataatcaagataaactaaaaagaaagaaaaacaaacacattgggactcaatccatggccttttctcaatctgtttataggttttagtgtatttttaatagtgtgtctcgttcccccctcctggttcgcctgggaccattataggatcctctttttctaactgtgctacaccagtttccacgatggtttggaccacaataccccccaaaggtgtggtcacaaaagttaatacaagacttgtgccccccgcttctcaagtttcaagtgaaatcattggttcacaagttgcttcaatggaggatggctttctcacggcctgggaacagcttgtcttcccccccccccggatttcatgaggatcaccgatgggatccgaatttggggcgcaccaaccggcaatctctaaatatggggggctaggcccccccccccaccaaggggttggaggaccacaaacagcgccccaacatgctttttgctcgccgggcatcttcttacgtcccgtcataagggggtcctccctcccatcgaggaggatccgtcgtcccccgggccgctccccaaaggcggcctcactgatttccttccatccccgtgtgtgtcagccagtctcttaatgcccctcaagcttcggtgcttaatgcctcaaccgccacaggtccctcttttcgcttctcatccctcgcgagccgtcaatgtgagtcccaccttcatgttgcaactaagtggcatgacacacaaccgtgcagtctaaaatttatgtgactccgactcgcgtcatcaattgttatttcatgggcatgcttcctccacacctctctcccctgaatcagacaaccctccacacagaaggattttctttctttaatcacccccgttggcgtacaaacccaatcttcattatcctgtcccttacccccaaaacacacataaca

SEQ ID NO: 630673 - DNA, 924 bp, Homo sapiens
  misc_feature (29)..(29): n is a, c, g, or t
  misc_feature (329)..(329): n is a, c, g, or t
  misc_feature (386)..(386): n is a, c, g, or t
  misc_feature (400)..(400): n is a, c, g, or t
  misc_feature (408)..(408): n is a, c, g, or t
  misc_feature (410)..(410): n is a, c, g, or t
  misc_feature (452)..(452): n is a, c, g, or t
  misc_feature (472)..(472): n is a, c, g, or t
  misc_feature (495)..(495): n is a, c, g, or t
  misc_feature (562)..(562): n is a, c, g, or t
  misc_feature (774)..(774): n is a, c, g, or t
  misc_feature (795)..(796): n is a, c, g, or t
  misc_feature (836)..(837): n is a, c, g, or t
aggtggccccggtatgctgcggcgcccgntggcgggctgctgcggcgcctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcacgcgtgacatagcagccggcgaccttcatcgagcatgccgagttctcggggaacctgtatggcacgacgcanggtggcggtgcaggccgtgcaggcatgaaccgcatctgtgtgctggacgtggacctngcacgggtgtgcgngaacatcnanggccaccgatctgcggcccatctacatctctgtgcagtccgncttcactgcgacgtgctggnagcagcggctgcggcagcgcaancactgaaaccgaggagagcctggtgaagcggctggctgctgcccatggccgacatggagagcagcanggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcacccgggcccatacaggaccagggcagcagcattgagccacccccttggcaggcgatacggcagctctgtgccctnggcagcatgtggagtggaggnnatgctgccctgtggttggaacatcctggggtgacccccgnngacagcctcgctgggctgtcccctgtccctatctctcactctggacccagggctgacatcctaataaaataactgttggattagaaa

SEQ ID NO: 630674 - DNA, 313 bp, Homo sapiens
  misc_feature (134)..(134): n is a, c, g, or t
  misc_feature (178)..(178): n is a, c, g, or t
cgctctagaggaccccgtcgtcagcatcaagccaaaaagatttttctcaagccttaagatctcatggagtgtggcgtgtagcctggacttacatgggagttgttacccttttcttcttgctatttctccctttnggaatggatatgtctattctatccctgtcccaccactgtatttnggaagcatatggcttatttggtttcacagtgtcacagctagggagcaatttgcctcaagatgaatcatatcttgagtctcacccatatctgatttagatgatatttaggtgagactgtgggttttaaattttagg

SEQ ID NO: 630675 - DNA, 1070 bp, Homo sapiens
  misc_feature (399)..(399): n is a, c, g, or t
  misc_feature (456)..(456): n is a, c, g, or t
  misc_feature (470)..(470): n is a, c, g, or t
  misc_feature (478)..(478): n is a, c, g, or t
  misc_feature (480)..(480): n is a, c, g, or t
  misc_feature (522)..(522): n is a, c, g, or t
  misc_feature (542)..(542): n is a, c, g, or t
  misc_feature (565)..(565): n is a, c, g, or t
  misc_feature (632)..(632): n is a, c, g, or t
  misc_feature (844)..(844): n is a, c, g, or t
  misc_feature (876)..(876): n is a, c, g, or t
  misc_feature (919)..(919): n is a, c, g, or t
  misc_feature (924)..(924): n is a, c, g, or t
  misc_feature (941)..(942): n is a, c, g, or t
  misc_feature (982)..(983): n is a, c, g, or t
ggaggaccctgtgcaagagtcggccggtgtttctttctccctgcatggacagacccgagacgatagccgcgcgagcgtcgtgaagggctggggccttcacgtcctctgtggctcgtggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcacgcgtgacatagcagccggcgaccttcatcgagcatgccgagttctcggggaacctgtatggcacgacgcanggtggcggtgcaggccgtgcaggcatgaaccgcatctgtgtgctggacgtggacctngcacgggtgtgcgngaacatcnanggccaccgatctgcggcccatctacatctctgtgcagtccgncttcactgcgacgtgctggnagcagcggctgcggcagcgcaancactgaaaccgaggagagcctggtgaagcggctggctgctgcccatggccgacatggagagcagcanggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcacccgggcccatacaggaccagggcagcagcattgagccacccccttggcaggcgatacggcagctctgtgccctnggcagcgggggggtttttttgggggcgccccnccccccccccccctttttttttggggggccccccccaaggganccccnaaatgtggagtggaggnnatgctgccctgtggttggaacatcctggggtgacccccgnngacagcctcgctgggctgtcccctgtccctatctctcactctggacccagggctgacatcctaataaaataactgttggattagaaa

SEQ ID NO: 630676 - DNA, 892 bp, Homo sapiens
gctgtctggcgaggaagttatgggatgtgagcgccgccaccgtgcagtagattctccgcgacgtggtcctctctcctcgggctttgccttcgctctctagcttttcttctttcactcccgctcccgactccagcccgctgggctcacgctctgccggacaccaatcccggcggcctgcccgaggagctcgaggctaggcctggccttgtcccgggagtcccgccctcgccgcaccgggatccgccccggccgaacgcacttccggcagcgccgggcgggagggaccgagcggggagaaaggcctgcggggaggcgcaggatggacgcgttggctgtcatgatgtaggacctcctgacctagaaccatgcccggcgcaggggagaacaacgagcttatggaccggttgccggttgtctgcttgtgcgagaaagcctacctgctggcccgggagcgttcgccggcccacctgttggcttttccctggacgtactaacggcgactccgcccggcctcccgactttaagatgcaggcgttctcttaacatgaccttttcttcgaggctagattctcgaaagaacatcctgaaggtggcttttcttaattagctgcctcaccgggcatggctggagcaagtacgatagtcccctaccatcgaacaggggagaagcccccgttactgggctcagttactaggtgatatcggtggacaccgttgtagcagggacctacgcgacgtgcggtaggaaacagtcggggccggattccccggatgtattgcgagaagcggttagacggcatggaccgagcagagacgtatcacatcctacaagcccccggcacaataaattcaaagctgcatggaattagaaccctcgatagggaaagttgat

SEQ ID NO: 630677 - DNA, 470 bp, Homo sapiens
taggtctacaagacgctacttcccctatcatagaagagcttatcacctttcatgatcacgccctcataatcattttccttatctgcttcctagttctgtatgcccttttcctaacacttacaacaaaactaactaatactaacatctcagacgctcaggaaatagaaaccgtcttaactattcctgcccgccattatcctagtgctcatcgcccttccatccctacggtttctttacataacagagggaggttacgtgtcctccctttaccttctaaataaatttggccccccggggtctttaccttcggggggcacccccttcggggggttttttttaactcctaccatattcccccttttttccccgagcccggggacctcgagtttttctgcggtgtaaaaaggggtgggttccccttatagccccctttgttttatattacacaaaaggggtttcctcttagattt

SEQ ID NO: 630678 - DNA, 834 bp, Homo sapiens
  misc_feature (834)..(834): n is a, c, g, or t
agcggtctccctgcctgagaaatgggccggcccgtgctgcgcgctgggcagcagctggtggcgtgcggtggtccaagatggcgtgaactgcatgctggaccctgtgcgatgtgctggtggctgggagtggggctgccgggtcccggaccacccgatgcgggcatggggtgctgtgcgtgcgcggcctgctgggtcagtgctgacccgtgggaggcacctacttctgtgaccaccagaccagaccttattgcctggagcccaagtcatttctctgccgcctctgctgccaggaggacccggagctggactcagacaaggatgagacaggagcctatctgattgacagggaaccccacctactttggtcctatcctcaaactacctccgatcacgggaaactcatcatcactaaggagttggcacgaacgaacgcgtgtgctggacggacagcggacgttttacaacatcgcgtccctttgtgcgcgctggttaacgcgccacgtgatacagtggacaactgagaacagaacttcacaaaggccccgtgacagcacgtgtaccagagtcctgccagtgtcatggaaagaaagaagccttcagcaggatgggtgttgcaaggatggtccgacgagctggggattttcgaacaggctatgaggcattcgggaattcttccctatagcgtaggggcgaattgaggattcaggcacagaatttcacatcgttgcggtaggtatccaagaggaacgtaaaaataatatattaaccaaatgcgcattggacaagtagaagaccgaagcgacgaaggttaagaatcgtttaagagagaacagn

SEQ ID NO: 630679 - DNA, 461 bp, Homo sapiens
gtagtatagtatgtactacagttaattttatgcagttatgatttaatactgcatcttaatgtttgtttacattcctcttgactgccaatggtgccatgtagtctatagatgtttacagaagttttgataaattttaacttttcatgatagaatcgtgtgcatttcgtggtagtacattatcaaatataaactgggatctacatctattttatgtattcatgacacctttttgttaattttttgatacttctaggctacagggtttgtctgtgagttttttcagattgttgcaaatcttcaaatctttttcaattattgaaaaagaatccacgtataagtggacctacgcagttcaaacccatgtagtccaagggtcaactgtgtattttttttttttttttgagatgcagtctcactccagcctgagcaacagtgagactccatctcaaacaacaacaaca

SEQ ID NO: 630680 - DNA, 496 bp, Homo sapiens
gcacgagtagagaccagggtattgcccaggctggtcttgaacttctggcctcaaggaatctgcctgcctcagcctcccaaagtactgggattacaagtgtgagccaccttgcctgttccggatcatttaaaaaacatttttctttcttttctgtctttttttttttttttttttgagacaagctctcactctgttgcccaggctggagtggtgcagtggcacaatcatggcttactgctgcctctatctcccaggctcaagcaatcttcccacttcagcctcttaagtagctgtgactacaggcacacatgcccccatgcctcgctaattttttaattttttgcagagatgggaatctcactatgttggttaggctggtctcaaactcttgggcccaagctatcctcccacctcagcctctcaaagtgctgtgattacaggtgtgagccatcacacctggcccaaatttttctttctttctttttttttttttttt

SEQ ID NO: 630681 - DNA, 142 bp, Homo sapiens
cacgaggccaatacccactgccattagctgtggcatctgtgtctgcagggctccctgtacatcacccttatccgtgaggatgtgatgcaggcgtataaaatcaccgatgacctgtttactagtttgatagggaatggcatga

SEQ ID NO: 630682 - DNA, 83 bp, Homo sapiens
  misc_feature (41)..(41): n is a, c, g, or t
acccccggaccgaccaaagcccgcgcgccgctgcatcccgngtccagcacctacgtcccgctgccgtcgccgccgtcaccatg

SEQ ID NO: 630683 - DNA, 1846 bp, Homo sapiens
  misc_feature (483)..(483): n is a, c, g, or t
  misc_feature (642)..(642): n is a, c, g, or t
  misc_feature (812)..(812): n is a, c, g, or t
tccgaaagagaggtgtttcttgggcccaatacacaacattcgggaaccaaccccacggacaaaaaaaggaggtctttgggttcctctctcccccccgcgggtggacaggggtgtgtggccccgggggccgggttgtccgcaccccgctggggggcccttatctctctctctctctctctctctctctctcgcaaaacatcttctctctctctcaacgcgtgtgtgtgagcgccactgagacaacacacagagaggtgtgcggagtctctctctgtggggagaccaagaggggtatgtcgcccgcgggtgctctccagacatctctctcaaagacgccccaagagaagacgcgtgagagagtgtcgtctggagaaaccacagagaagcggggtctctctgtgtcgcctctggagagagtgtctctgtgtgtgtgagagacaaacacaaagagatgacacacacactagtgtgtgcgtcgggcgnctctcgcaagaagagtgtgtctctctcttctcagcagagagaacacactcatctgagagaacaacaatagcgtgcagaagagtagtgtgctctctgttgtgcgccccccacatctcgggggacacagacgcgcgcgcccgcgcccgtgagggagaaatntctctcagagagatgatatagagagacggtgcgcgcgcgcagcacactccacagacacaagtgtgtgtgcgcgcacagaagataaacagaggcgcggtgtggaggcggtgtgtgtgtgtgacacgcgcgtgtgagacacgtgtgtagaacagctgtgttgtgaagaaaanaacatcctcctccgctgcaggcgtacatgtggaggagccgcgaagtggagcagacagaagataattaaaagaaatcccacctcctgctggtgatgttcaaacaacattttactacgaaagaagagcggagaatcctacaacattgagaggagagagagatataacaacaacaatacacagaggatcctcaagggcgagtcagaacaaacacaagtatgttggtgtggtgtgattcaccctcctcttgtggtgagagaaaataataattatctccccgactgctgacgaacccccaggcagcaggtggtgagggagaatactacccatacacagaggaagggagggagcggcgaagcagcagaaggcgagggaggcccaacattaaagagagacagaacgcccaccaacacaagcaagtaatgatggccccccctggtaataacacgccgggggggtgtatctaacaacaacaacaggagacgaggaggagaggggaggagagaagacacacgcgcgtgggaaagacaaacctacaacacgagagtgaggcaacgaatatgcacacacaccacaggaagggattgaatgatagactagcagtacaaaaaagatagaaggcacgacaataatgtagatagaccgagatgatagagacgctagtcaaaacagagagggagaggagaggaggggataattatacacccccccctatcttcctctccttcaccggtctggaggaacacagacggcgagtacaataagagacaggcaacaccacccggaggcagagagagggaagagagagatccaacaccacccacaacgggcgcaggacaggaggaagggaggcacgcgcaacaacagaggaagagaacaagaacgccgcagtgagagggaccactctcgcaggagcccgccagcgacgacggtgtcacaacagaagcaatctacctccctcgtggagcaaacagggagcactcacgagagaacaacaaccatctgtcgacgatcgtgggcaaaaacaacgagaggtc

SEQ ID NO: 630684 - DNA, 865 bp, Homo sapiens
ggtttatttatggagaatggttttagaaaccaacatctaggtgctcagtatgcttgctgctactgaggtcatttcatttagttcctctcaactgacagagtaaaaaaaatgctgttttactaacctatgtatttatatatatttataaatacttctatatgtaccaaatctatctacactaaagtacacatgaagtcatactgatgtctccaattataattaattactgcatgggtcagtctagcttcctgtccttgtttatctgtgaactcccattccaacagtgtaaaacctgatttccaccatctggcacccatttacttaattattatcattctcacgtatactagtattatgtagtacgtacaatgaataatctagtctggcagtcctgtaaaaaataacttggttaactacagtaaatgttttatgttgcagttccctttggcccttagtctttcagactgtactcatttccagagttatttcggtcagcacctttaatgcaatggtttcatatacttgtaaaagagttagtcttatcatagtcttcatttcttcctgggatcacctgactcctaaaatgacttttttaaatttacttttggtgttgtaaatttctacagttttggcagatgggtaatgtctgtatctgcattacaggttagaatttaccgcctaaaatactgtgtttccctatatctaacctaaattttaggaacactatcattatggttaaaggtgctttagaaggcgaactggaccattaaggggtcaaatggttactagaggcgttaggggatggggggggccattatggagatccaaggggccgggtccccttgaacggagcgggggaaggaaa

SEQ ID NO: 630685 - DNA, 322 bp, Homo sapiens
ccaggagcgatgaagtgaacatatttttgaaaagaaacaaaattgacaatcctttagccaaactagaaaacagagaaaaagcaaatacaatcagaaatgaaaaaggagacattacaaccaatactgtagaaaatcaaaggatcattagtggctattatgaatgagtatatgccaattgattggattatttagaaaaatgagataaattcctagacacatacaacctaccaaaattgaagaaggaggaaattcaaaacctgaacatacccataacaaataccaagatctaaagcataatagaaagaatcctagcaaaaaaaaa

SEQ ID NO: 630686 - DNA, 324 bp, Homo sapiens
acataatatgtgataattcaggtacatagcaatattgtctctccagacggtttccatatgccaaacagtcataacagatggtatgaacatggtggctactgcttgcaggagcttctatcagatgagtcctcatttccactaacgcagctgtaggcactctttcatcaaaagtgcatccatcaggactatctctaatcgtaggtcggccaaggcagtcctgctttggttgccagggcttcattcagctgaatatgcatatacctgaactctcatggctattctttgtgtcattattaaatcattctgtaagcacatgttctgaac

SEQ ID NO: 630687 - DNA, 453 bp, Homo sapiens
  misc_feature (1)..(1): n is a, c, g, or t
nttctaagggacagcaaaggatgctgatctgctgcgtatgcaagtctcgcgcccatctttcaagtgctaatctcacttgatcacacccacaccccacacaacacaaccctctaacacagtctgtcttggcccacagaagaactctggtaaacacatttcccctgcctgtaagatggcatcacacacccctccctttggttctcgaaaacctggtgactctgtgtcacctgtttccagttacacacttcttcagtcttccccaccttgtacgcaaaccaaaccaatttgtgtgtgttagtttgtctgtttgcacttaaagttctaagcactttggaaagtttctaagcaacttctcacttacaagccacatcttacccaactctcaccacttactattattaaagagtattctcgtggaacacccgcgctagtgccgtattcctacagcccggg

SEQ ID NO: 630688 - DNA, 410 bp, Homo sapiens
  misc_feature (46)..(46): n is a, c, g, or t
  misc_feature (50)..(50): n is a, c, g, or t
  misc_feature (187)..(187): n is a, c, g, or t
  misc_feature (390)..(390): n is a, c, g, or t
  misc_feature (399)..(399): n is a, c, g, or t
tgagacatggtctcactctgccacctaggctgcagtgcgtatgccncttngatgccttgacctctcaggctcaagctatcctccttccgagcctcccaagtagctgagaccacaggcatgtgccaccaggctcggctaatttttaaatatttgtggagacggggtcttactatgttgcccggccttnaactcctgggctcaagtgatccccctgcctcgggctctcaaaatgctgggattacaggcgtgacccaccgtgctcagccaatgattcactttttaaagaaaacagcgttactgagatataattcacataccattacacatcacccgtttaaagtgtacagttaagtgggttttgagtatttttcaaagaatttgtttcagccntcaccacantttattcttag

SEQ ID NO: 630689 - DNA, 236 bp, Homo sapiens
gcgtcgacggtgcaccaaaatctcagaactgaccactcaagaactcgttcatgtaatgaaaaaccactggtactccaaaaacgattgaaattttaaaaaagaaaattataggctgggcacggtggctcacacctgtaatcccagcactttgggaggctgaggcgggcagatcgcctgaggtcgggaatttgagacaagcctggccagcatggtgaaaccccgtctctcctaaaaag

SEQ ID NO: 630690 - DNA, 168 bp, Homo sapiens
ttgtgtacatagtattgatagtctgcctactgcttacagtcggacatacttctggtgggcactgtgcggaaacttgaggatgaaatcagtgagctgcatgcactatgaaaggcatggcctgtctcctcacattgagtgcaaggtccatcgaccaaagccctgtactag

SEQ ID NO: 630691 - DNA, 189 bp, Homo sapiens
  misc_feature (5)..(5): n is a, c, g, or t
  misc_feature (41)..(41): n is a, c, g, or t
  misc_feature (119)..(119): n is a, c, g, or t
tctantcagatatgtaaggtagaggtacattcatcctgagngcaaaaattccctttccacgcttttgtgaaaccagcatatgttatgtatttgcaaggagacaatcgtgggacagcggngccccccaaaaacccagtgacagacattcccactccaaaaggtagaaatcagattaaagaaaggggtgac

SEQ ID NO: 630692 - DNA, 304 bp, Homo sapiens
cccttaaaaagggggggtaaaccccccccgcccggcccaaaaagggtttcccaaggaggcccggaaatcccgggaccttccacacagggaaggtccccaaaccttaaaaaccaacctttaaaagcccaagagccaaagggggggaaaaccttttttttaaaaccccccttccttgttttaggccaaaccgggtttttaaggggatatttaaaaatcggttttttaaaatagccccctccaggaaaaccccctttaaaccgggaaaaggggttatttttcaataaaaaaaaagaattggggccca

SEQ ID NO: 630693 - DNA, 769 bp, Homo sapiens
catgttgccctcccctcccagtgggatttcacgccgcgcataatttatgtgcgccctccttggtgtcctactctgtggccctttttggctccgtgcccccatattctcgggtgtccatgagattcccttgctgtacacactcacatagggcccggcgcgggtgattcatcgcctgccatacccaccaccttggggaggcccaagcgggccgattcccactccgggggttcgagacccctcccgttgtgaacactggggaaccccctcttgttcttgtcaagttccccaatttgctgcccctggtgtgcaaggtgcgcgtatgtccccggctatctcacggagctgtggcccgagtattggcgtgaccccggagtggaggcggggctttccctggtgtctgagggttgcccccctgcactccacacctgggcgaacagagtgagactccgtttccaaaaaaaaaaaaaaaaggaagacgtctagctgggcacgatggctcacgcctggaatcctagcactttgggaggcccaggcgggcgggtggatcacctgaggtcaggagttcaagaccagcctgacccccctggtgaaactccatctctacccaataccaaaaattagctgggtgtggtggcgcatgcctgtaatccccagctactttggaggctgaggcaggagaatcgcttgaaccccggaggcagaggttgctgtgagctgagattgtgcccttgcactttagtttgggtgacagagctagacgccgtttcca

SEQ ID NO: 630694 - DNA, 381 bp, Homo sapiens
aaggggggggtaatttaaagccccccgggtggggttccccctttgggaccataaacaaaatttggttttggtataagccctttggattttttaaaaattttctccccgccaagggaaatagatttggttatacccctataatatatttggtaaaggataaaagggtattataatggccattaaccaacccctggggggcccccccccccccttttgccttttcttttgggggccgggggggggtttctgaacccatttttatccccgttttaaaaaggggacccccgggtttaactttttgttggcccaaacccttttgttttttttccctttttttcccagggtggttccctaaaaaaaaataaatgggatttaacttta

SEQ ID NO: 630695 - DNA, 543 bp, Homo sapiens
  misc_feature (18)..(18): n is a, c, g, or t
  misc_feature (34)..(34): n is a, c, g, or t
  misc_feature (91)..(91): n is a, c, g, or t
  misc_feature (111)..(112): n is a, c, g, or t
  misc_feature (114)..(114): n is a, c, g, or t
  misc_feature (119)..(120): n is a, c, g, or t
  misc_feature (123)..(123): n is a, c, g, or t
  misc_feature (128)..(128): n is a, c, g, or t
  misc_feature (162)..(162): n is a, c, g, or t
  misc_feature (183)..(183): n is a, c, g, or t
  misc_feature (227)..(227): n is a, c, g, or t
  misc_feature (246)..(246): n is a, c, g, or t
  misc_feature (259)..(259): n is a, c, g, or t
  misc_feature (285)..(285): n is a, c, g, or t
  misc_feature (294)..(294): n is a, c, g, or t
  misc_feature (297)..(297): n is a, c, g, or t
  misc_feature (335)..(335): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (372)..(372): n is a, c, g, or t
  misc_feature (381)..(381): n is a, c, g, or t
  misc_feature (383)..(383): n is a, c, g, or t
  misc_feature (387)..(387): n is a, c, g, or t
  misc_feature (404)..(404): n is a, c, g, or t
  misc_feature (415)..(415): n is a, c, g, or t
  misc_feature (433)..(433): n is a, c, g, or t
  misc_feature (440)..(440): n is a, c, g, or t
  misc_feature (442)..(442): n is a, c, g, or t
  misc_feature (451)..(451): n is a, c, g, or t
  misc_feature (458)..(459): n is a, c, g, or t
  misc_feature (461)..(461): n is a, c, g, or t
  misc_feature (468)..(469): n is a, c, g, or t
  misc_feature (527)..(527): n is a, c, g, or t
taatatacaatttaaccntcctccttcaaactancttaaaaactactctctcttatttcatttttcattttctattcattatttttccatnctctttaaaaacatactcannanctttnnaanagcanaaattcaattacttacatacaatattattataantttttcattatatacaaattnacatattacaatttattaacatattacaattttttactttttanaaaaaataaacttacagtnaataaataaacanctttctatatcaatttatttatttantataaaaantanttactatatatatatacatatacatatatatataaatntncatgttctanantataaatatactatatacttaantatttcacntnacanaacattatttcatcttntttcatttttntacattaaaatacatctngcagttngngtctccctnatctctnnanacccagnnatcctcttcccattccaagggtagacgcaccagcagagtcccgcctctccatccatgnatgtctcacactgtct

SEQ ID NO: 630696 - DNA, 301 bp, Homo sapiens
gatgtgtggcaatgagtgtgacctctatcgctggtttacaggggttgccttgggacccttcagtagttggtgggcgtgagctgcaggaatgcacatttgtgcttgggagtgagctgtcaggaaggggaagcggatatcctgcgattctgccttgtactgccctggttgaagccgcacaaccacagctcagctccgcagtgggcccaggcccttgtgtaatgtctgtattaagctcccctggggctggcctggcttgacggaagttgcaaggggggattgccgcattgacggagggacctgg

SEQ ID NO: 630697 - DNA, 795 bp, Homo sapiens
  misc_feature (267)..(267): n is a, c, g, or t
  misc_feature (384)..(384): n is a, c, g, or t
  misc_feature (409)..(409): n is a, c, g, or t
  misc_feature (632)..(632): n is a, c, g, or t
cggaagtagtcctatcatatcatctgcaggaagtaattcctattcgtcaggcatcagacgtgagccttccttacgcaacgtgcacctagtcctaggacccctatccacccaaattctcaggacgtgagccaccgtgaccccccacacatggacgatacgagcccgtgtgaacatcccactaaggaaagtcaccacctcgctaaatcaccattcagtaattcactcagtccattcaggcagtatccagtctacattgcagcttcaccnatagaagttctaaatcaagcaatagacgaacatcgcacaatcaatacataaattacgaagcaacatagctgtaatatccacaattatatactaggcgtctggttataatataccacnttcctaccagaggccctccagtagntaacatctcgatgcttatcccgtctcaccaatgttccgttcgggcatcttctacgtgcatcaaatatcccgtatggtagtcaacagggctctaccaacggtacttggaagtcactggagtggcctcagagcatttccatcgatctatcatgcggtcacacacgtcaacctaaatattttcgcttctatcatgcaaaacaatacaatttggctttcagaatgcncagacgatcagattagggggtcatgaagtaggactgtggtatgatgtgatattctgtatgatcgtcgcgatctgattgatgacgggtactgtactaccaaaactaatagatgagggtcttaaaaaaaaggggggggggaaaaaaaaaaccggggggggccaaa

SEQ ID NO: 630698 - DNA, 196 bp, Homo sapiens
ttttcacgcaggatcaaattcacacataacaatattaacagtacatgtaaaatggtttaacggcccaattacaatctaagattacacacgagaagtacaacacatcacacatatatctcattcatacaacatttaaacatcccagaagaaactccattagcactcctctcccatctacagtaccgggggtaccgag

SEQ ID NO: 630699 - DNA, 814 bp, Homo sapiens
ttcaggctacccagaaccttaagtcctaacaacgacaataaaatgttcaggtgaccacgattcttattctccttgcaaggaaagcccagaaaagtttcagattgaagccaattttcccaggcgagtgctgacctgcatcccttcagaggagtggcccaatccccctacgctacaggaggccggactcagccacacagaagttctttttgttcaggacctaactgatgaatgacatttttttatttctgtcccctcctaccccagtccctaaaagaaatggggaaaaaaaaaaacaacagcatgtctgatataaaaaacatgacagagaaatccatgttattattattattataatacagtatctttattaagagactgctagatccttacgaaatgatcatataccatgctgtccgtaagagtcacaacctgtatatgcactcaatgttatcatcataacaaactcgaatgggaagtaccacccttcctcgagtcctctgtgctaattccttccagggtacagaaactctttaccttactacctacattgtgcccgctgagtaagtggacactccccctagtcactattcacctttgccctaaacacaatggatgagaaaaccactcataaccaagtaattataaatataattctaaaatacctatatagctctttgtgtacacatcaacaacacgcacctacacggaggcaataaaaagctgtaagagacagaagttaaagctattatcatttgacgactaaactaccgcttgatgtataaaacgcatatacacactatcacaccaaggataa

SEQ ID NO: 630700 - DNA, 327 bp, Homo sapiens
tattcttctaagacaaggtatgcctctagcgcccaggatcgagtacactggcgcaatcttggctcacagcagcctacacctcccgggctcaggccatctttccacttcagcctcctgagtagctgggaccacagttgtgcaccaccatgtctggctactttttgtattttttgtagagagagagtttcactatgttgccccggcaggcccggaactcctgagttcaagcaatccacctgcctcgggcctcccaaagtgctgggattacagtcgtaagccaccacgcttgtccaataaatggattttaatggaggagttagagaagtt

SEQ ID NO: 630701 - DNA, 135 bp, Homo sapiens
taaaagtacagcaggatggtctcaatctacctgacctcgtgatccgcctagcctcggcctcccaaagtagctaggattacaggtagtagagccaccgagcccaaccgtgtaacaaaaatactatatctatatttt

SEQ ID NO: 630702 - DNA, 375 bp, Homo sapiens
tcgccacgcacggcaattttttgtgtgttttaatagtagagacggggtttcactgtgtgcccaggctgattttgaactcctgagctcaggcagtctgcccgcctcggcctcccaaagtgataggattacacgcatgagccaacgcaccccgcctcgtatggtaacttctgtgtttaacttattgaggaatcacgtaaactgtgtccactgcagctgtaacgttttacattcacactagcaatgcacaagggttccagtttcttcacctcctcaccagcacttcttattttcaatttttttgatacaagccatcctaatgggtgtgaagtggtatcttagtttgcatttctgtcatttagtgactcgtggaaatgt

SEQ ID NO: 630703 - DNA, 473 bp, Homo sapiens
gaggtgactctagagtgatcttaccttatcctgtgggatccacacaggcgaacagaccctactcctagcctgactgtgtgcaaagagctacctgctccttctccaacctctggaagcaccgcaatgacccatcagcagcagcatcagggagctgtgcggcagtagctggcagaggcggaggctgccgttggcctggccgtcatggagacttgctgtggaggcgctacccctggttggaagccacttgtgatctacccctctgtgccgagggctgaggggggtcccagatcaagttgggctgactcttgccctgactttcctacttttggcaccttccatttcccttgttgctgaatggccctcgcagcatccccgttaagcatcttgtacatacttgtgtcccttccctcttccccatccccacggcataagtgtggggggtaccgaagctctgaattctgtaatccattggt

SEQ ID NO: 630704 - DNA, 211 bp, Homo sapiens
  misc_feature (26)..(26): n is a, c, g, or t
  misc_feature (59)..(59): n is a, c, g, or t
  misc_feature (155)..(155): n is a, c, g, or t
  misc_feature (182)..(182): n is a, c, g, or t
gctccaggacagtcagtcgcccgtcngcctaggccgaccacgctgtgtcctgtgcacgntatctttaggtttcccacacacccactttctgaattctttctccccaaagcaaggaggaacctcgtctcgtcctccaacctcatctcccacttagntatcccttggtaagccagtcaggacanagaggacacatcggtggtcgtcgccccct

SEQ ID NO: 630705 - DNA, 167 bp, Homo sapiens
cgagaaagcctaccatgaacagctttctgtagcagagatcaccattgcttctttgagcagccaaccagatggtgaattgtgaccctcgccatggtaatacatagcttgctgcctgttgtacctggtgacgtgtcccaagatgtcatgctgcattccacatcaaacca

SEQ ID NO: 630706 - DNA, 221 bp, Homo sapiens
  misc_feature (61)..(61): n is a, c, g, or t
ggggtttttttagggtttttaaatgcaaggcattttcccaggggacttttaaaaatcaatnccaggaagcaaaataaaaaatttaaaaatcaaaacccagcagggcacggtggctcgcacctgtaatcctagcactttgggagccaaggcaggcagatttcttgagcccaggagttcgagaccaccctgggcaaaatggtgagatctcatttctaaaaaaa

SEQ ID NO: 630707 - DNA, 260 bp, Homo sapiens
tccaataacttgaccatcgtgaacaaggtgaccctagcggcataacagacgcaatgcctattctagagatccatatcagcaagagggctttacgagctcgatgtagagatcaggacatcccgtatggtgcagccgctattaagggttcgtgtgttgcaacgacttaaagtcctacgtgatctgagttcagaccggagtaatccaggtcggtttctatctagcttcgaattgctccctgtacgataggacacgaatgtgca

SEQ ID NO: 630708 - DNA, 1195 bp, Homo sapiens
  misc_feature (308)..(308): n is a, c, g, or t
agcggagcggtcggcgggacggctcccggatgcaatctgtcccgtcccgtccccgcgcggggtgccgtacgtctgctaagcgcgcctgcgacccggtcgtccggtcgcgctggataggacgctgaggagccatgagtgcgccacgcctgcagaagtgtggcgtgctgctgcttgctctgggctgactcttggcagtgcacagtaagccataataagcattgctggtatttcgaaggactctattccatacccttattatatatgctcgtctcctatcgatggacttgccttgtgcgcgtcccagtgtngcttgttgttgcggagccctcttccattacgtgatgtgatccgtgggtattgatcctctgtcgggaattcctcttggctatgggcgtttcccaggtcctctatcgccctgattcatttccctatgcgtgcacgtgttgtgcacttgctaggtctctcccggtcgctatcgacttatcgttgtcgaaacaatcgtctctactctgtccaccctcggttccagtaaaccttgtgtcacgatcggaccgaggcaaataatcgttaattttgagagggttcgctccaatcaaattgcttacgtaagacgtatgaatgaagcatggttatgcaatgccgcgacctttatacctgaatggagccactcatttttggtccctttacgctttttggaccccgtttttaaatctttcttctacgaagcaaaacgagtgggaccttctggctcgtggaggactttgacgtggacaccgttggtggcggaagattctacacttgccttggaagtaattcactcttcgggaacttgttcaattagaccagccatgagcctccttcatttttcagcgtggccttggttcctcgaggtagcggtatggctcatctaaaggtacgactttgttaggaaattctcttcctgcatgcgtgttctgttgtcctggtccttttccttgtccttgggggccgggcttgttatggggccttggagcagcgcctatgtttcttgggttgggggtccttccaacggatttgcgcttagcgttgttcgacgttgtacacccggggttcccggccgcgtgtgtggcaatgaccgtgtgtcccctttactgggggtggaggcgatggtagctcccacggtatttgctcgacccaggtgtgggtgtacgcaccg

SEQ ID NO: 630709 - DNA, 835 bp, Homo sapiens
agactttgatgactatcacccaccccatagcgtgaggaggacgtcacagtggaactgtcccagcttttaagtatatctagctatgaaactatatgcttgaggacgtaaggaattctgcatgcttgcatgatgtttaagcaaaataagtggccagattttgttgtggtccttcccaaagatgttaagtgatacctacagtatagctatacttaggacagagctctattgtttcactccctgtggcccctgtactaagttttgtccacaggcaatagttgtatcgatggaatgaatagaggttattctgtaatggcaaaagtgttgcctgctcagcatccttctgtagcagacttgagcagtgttcttttcacatattagtctttcattgcacgaatttgttcgttgtagcaagatggaagcaatgtggttattggctaatttcttcatgtattaagtgagtttattttcaaaagatattctgcagtattattcatccttgtacacgttatcccttaccttcagtgttccatgtgcgaagacgcgttagtaatagatccatagatcagctgagttcatcttgtaatattctttatttacttgactattcattactgtagcagctaaccagggaatttgtgtttatgcctgcagaagcaacgttttcataaattgttacctacttgcctcttgtttagcagtccttggatccatgctgatccagttgcaccagtagcgttggacagcatatcactttggcgtcacttgggtcccttgtttgatcaagcatgttctgcagtttattcctttaaccgggcggaccttttggctgttccta

SEQ ID NO: 630710 - DNA, 251 bp, Homo sapiens
ggggaaagtttggggataaaggagagcttaaaggtgtttcaattaagttaaaaaactccccaggctgttgagaattttttgccccttttccccccccaaaacagcatggggcctgacattttttgccctggtcccctttctcttgatgtggaaagtctgaatccagtatttatagccttttaaggttttaaaatccagtatcaaaaaaaaaatcaaaaatcctggttggtgaaataaagagtttaggcata

SEQ ID NO: 630711 - DNA, 392 bp, Homo sapiens
  misc_feature (300)..(300): n is a, c, g, or t
aaatgcaaagaaggcaaatgattcataaaagttgctgagtgaattagaactataatgtgggacaaacactccgcctttctgtctctgcagctagtggtatttccaggttcccagggaactcctgtcccttgctccactgtgcatttttagatggacctgatatttggttacctcccttgtcaggcccaacaatccttgctaaggcacagacttgtgtatttgctgatccctgaggggaaagctgtgattcaggctctgaagtctaaggaattgcagacttagtttcttgtctcccgatgnaaactgctaatctggggtgccaatgggtgtttctgcttacatgggacacctggccccacacaggcatggatttaggaaattattaatgtatg

SEQ ID NO: 630712 - DNA, 922 bp, Homo sapiens
ggctgggtcctcaggctgcgtgctgttggaaggaagtggagaggattccagggagttctgggaccttttcaatactgaagagaggaggctgggtgcatcatgggagacgagactattgggaagaagttacctgcaatctatgaagtcgtccatgactctatgcaaatgcaccgactagtggacacggcaggacaaccgagcaaggattcactgcacagtagctatgtccatatgagggcacagacatgcatgctgaatcgagaatcaaagaaggcgatctagtcactctcatcaataaggactgggatcgacgtagagctggtgggaacagagagctgaacggcgagaacgcaggcgtgtaccccgaataacattcgaggaagttagtgtccaccgggaactcggagacacggcaagggacatagtaccgaaagaacgcccaccggcatcacgagtccgactacctgatccaatccaagaccaaagagggacacgggcgaacagatgaaggagagaacacatgagccagtgaagccagaggagtatccgtcgcgtggaagcggagcgcacggaaaacgtgactcccaaacaacgagaaaacacggacagaagactagaggacggaagaaccaagaagaagaagaagcccaaaacgaacttgagactataaacaagcaagggaccatacagatataccatggccgataaacggccgcaaagaaaagggccctcggagacgcagggataagaaagccaagatggcgtcgtcaagacaaggacgactaagagggcacgattggcacccacagagagaaagggccgggaaagagaacgcaggacaggggtacctggatggacgaagacaaccaatcggaatgacaaagtcccaacaagatagcgacagaaaccgcaccacatcgcc

SEQ ID NO: 630713 - DNA, 187 bp, Homo sapiens
ccgagtgtgtgaggtattagaggatcgtctagctcccagtggtaggatagtaggcacagacacagccattgcgtcactcaccacagcctgccatgttcagtcagcaaaggcagtcagccaaccggtggtagcaccttcccttcttggaaccacaagaaaccagcccactggcggaggctaggagggt

SEQ ID NO: 630714 - DNA, 373 bp, Homo sapiens
  misc_feature (32)..(32): n is a, c, g, or t
  misc_feature (260)..(260): n is a, c, g, or t
  misc_feature (305)..(305): n is a, c, g, or t
tcaccataattaggaaacagactgtgttcttnatttgaaacacaacagtataaatactatagtaaagttgggtgcagtggatcacggctgtggtcccagcactttgggagaccgaggagggatggtcacttgagcccaggagtttgagaccagcctaggcaacatagagagaccttgtctcaacaaaaaaatttaaagttagccaggtgtggtggtttgcacctgtggtcccagctactcaggaggctggggtgggaggntcgcttgagcttaggaggtcaaggctgcagtgagccatgattgtnccacttcaccctgggcaacagagaaagaccctgtctcaataaaaaagaagagaaaaattggagttgag

SEQ ID NO: 630715 - DNA, 245 bp, Homo sapiens
gagaaatcggaaccctcctatgtagctgatgcggaatggaatcatggcacactacattgtggaaaataatttgggagctcctcaaaaagttaaacatgaagcccccatatgacccagcaattccactcctaggtatttatccaagagaaagaaaaacgtgctcccacataaaaacgtgtatataaatcttcacagcagcattatttgtaacagccaaaaggtgaacacaacctggtcgaccgtct

SEQ ID NO: 630716 - DNA, 169 bp, Homo sapiens
gcccgcgcagtacacaatcatgtctgaaccaatcagagtccttgtgactggagcacctggtcaaagcgcatattcactgctgcacagcatgggcaatggatctgactttggtgaagatcagcctataattctatgtgctgttggatatcacccccatgatgggtgtcct

SEQ ID NO: 630717 - DNA, 728 bp, Homo sapiens
caagtggttagacatcggggggagaaccttggtggcccccccttggaggatgcccacgatttcctgttttgaatcctaggaaatggctgccgagtggggagccgggattattaaggtaggccacctttgtggaaaatcgcataattggaggaaatggatagaaattgtgatttccctgagaatcggaacccttggttcccttgaaccctgaattgatgagaggctccctgcttgtatggtgtgtaccaaacgtcacctggaatgggacttttttagacccagatcttcatgacgcttgttccccacccccagattcatcatcatctcttgttacgacccaaaggtctgccagggtgtggtaacttgtgttcttttgggcccactttggggtggagaaagagtggatagtgatgagagcccataattcaggacttattccctcttgttgttgtgttgttttttttgcccctgcacccagagtatgaaatagcttcccggagcgtcccagctataagcttggaagtgtctgtgtgattgtaatcaccatggtgaccaaccactccagaatctaaattggacttctgttgtattctccacccctccaattgttttttagccgtttaatgggtacattttagagtcttcccttttgttggaattagatcctccccttccaatgctgttattaaccacactttaaaaacttggattaaatattggaacctcca

SEQ ID NO: 630718 - DNA, 986 bp, Homo sapiens
ggctggctgcgcatttgtcatcagtggacggatgtgtgtgggattctccgcgctagggttttcggccggtaagacgatgtgcgggcaaggcagagtgtgtttctgcgccgcggcttgggtgttggttgcgcggtataagcggcctctcggggctcttttgtgggccccgtctttcttgttggcggggtgtggtattattctcgcggcaccttggtttatttctgcccccccgccgtgcgtttgacgagtgtactgtggttggctggtgttccgtggcgtgtggtttcgtccgcctcgcccgcccgctgcggcctttctcgataattccgggtgcggccacgcggtcctgttacactgcggggtgggttctccccccccgcgtgcgtggttttgatgactcgccctcctgtgacgtgctggggtggcgagggacaccccctcgggcggggttgtcattccgtctctgttgcgcgggatcgcggttcactccgctccgtgtcttctttttgcccccccctctgtgttggcagtgtgttttaccgcaacgcctccctgccggcggtaagtttcatttccccccccctcggggagggtcgctcctttcgcactgctggagtgtcggggcttatttgtctttgtcggcggtagtaagatccgactcgccacccccgcaggaggcggcctgttgtatagggtgaaagagcaagtgagcgagtgtggcggagtgttgagtatagttcgaggtgacaagttggtcccgcggttgcggtccagagggtgcgtgtttgtgtttagccgccgccgcgcaatccgaatttagtctgtgatacgaagctagtctcccccccacgcgaggcggggtgtctattgtttgctttggtactgaggggttgtgttagatagataggaagaaacaaggccaatcaattaatcctatatttttctccgcgaagcatggttaataagaaccaacaatgaacaagaca

SEQ ID NO: 630719 - DNA, 358 bp, Homo sapiens
  misc_feature (30)..(30): n is a, c, g, or t
  misc_feature (40)..(40): n is a, c, g, or t
  misc_feature (119)..(119): n is a, c, g, or t
  misc_feature (176)..(176): n is a, c, g, or t
  misc_feature (279)..(279): n is a, c, g, or t
  misc_feature (293)..(293): n is a, c, g, or t
  misc_feature (345)..(345): n is a, c, g, or t
  misc_feature (347)..(347): n is a, c, g, or t
  misc_feature (356)..(356): n is a, c, g, or t
ccccgtaaaagtggtaaatttggtttaaangggatgaaangtacccctttttgtaaccctgtaccagcctttgtccttttttaaatatgaagtaccttaaatgtaccttacctatgatngggaaatataatgtgtgcccttcctaggatttgtgaagtggtttcatgaactcctanggaatttgttttccctatcctaactcagtaacagagggtttactccgattatgtatagaaccttagtttgagaaaatgaattttactatgtactgaatttagnggttgagaataatnggatctgtgttattcttagtacccactgataaattgtgcaataaataatcantngcaagtganaa

SEQ ID NO: 630720 - DNA, 247 bp, Homo sapiens
gttctgatagcctcccaaagtgcgggattataggcgtgaaccactgtgcccggccaatcttcatttttatacataaacaatagggcagaggaagccatcagatatgcatttgtctcaggtgaccagagggatgactttgagttctgtcctttgtcccatacctgtgaagataacttaccaatttacattgccagggtgaaaatcaacagaactgtttaagggtatagatcttgaggcaaattgtgaa

SEQ ID NO: 630721 - DNA, 100 bp, Homo sapiens
tgggggtcaacttgttctatttctgcatcatcatttacctgtacggagacctcgccatctacgcggcagctgtgcccttctccctcatgcaggtgacctg

SEQ ID NO: 630722 - DNA, 1849 bp, Homo sapiens
  misc_feature (788)..(788): n is a, c, g, or t
  misc_feature (1680)..(1680): n is a, c, g, or t
gcctgtgctctaacgatgtacgctcggactgagcctctcaggatactagtagtgtggtgcagacgtctggatgacgagctctatgggacgcgctcgtttcctacgacctaggtgtgcccccggtcttcgcgggactgcacgtctcaccatcaaagtatctctgcgccggaagtttgtgccgaggacaggcgaaaatgtatgtggcgctggaacgtgtggacgcgactgcgctggaatcgtgctcggggagtcacaaaggccggggacacatggggggcattggcctagttaaccactgtcgagcgttaagcagcggtgcaacagcaccatgcaggcgtcttagtcttcgaacgtctccctcgcctttgggtaccacgtggagcaaggtggtagcgggatcccccgcgagaacaactgctcgagagactcagctgaccgtctagcactcaagtgcattacacacgttgaccacgaacttagatggaacctctctcaaagcataagcgatagcgcttgctagcagcttgcgcctctacagctagcgagcaagagggtccataccggtttgccctgtggcaaaggtctcagcacaggacagcgagaggtaactagactgcgtgagggaatctctatcatttggcgtaggggcaccttgcccattggcaaaggcccaccgacatgccaacaagggagccgcgagcgtgccagttagcacggccgaaacggccaatatgtgggaccgagagcaaatgggttttccagaacggaaggctttatcatttgcaaancgaaacccgctctcacggggacttgtgcccagtgggcgtgggggacaacgccatcgttgcagtgggggcgccacacgaccgggagaccgaacaagccgccggtctgaggagcgccattgggaaacgccgtcccttgcacctggggttgtgcggttgacgggggccctaggtgtgtcgaacggcggggtgtcggtgcagccgctttggacgaacgggaagagccgcttttcgacccattgagacgcgaaaacgctcatttgaagacgcggcgacttatgagcgcacaatccgacatatccacatttggctggttacctacaagaattcgaagttaggggcgtgtaacacccgcgaggcgctattccggctgcaccggtgcaaactttcgacagaggctatgcgggcgccattggtggcgggagcttccattgggaaccttttgagagaacttcgtatggcgcccctgttggtgtacgcaacagcctttataaacctttgcgcgttcggacgccatatggcgcagaggcgagcgctctcgaaagcgggaacgcaacggacttcccaataccgtttcgctacagaaggtgccacgggcgaaagctccctgaacatcgaggcggggacaaagtgctctccagcgccgcggttgtgatatttcccacccagacagttttttttggaaaaccccgagtggttgctgaagccctgcatgagccccactttgcgtgcagatccaaggccggggttatccactttgaacacatgggatagcgcccgataaactcggcctgcaaccgcacaccacattgcacgggcaacatgcgaagggccatcttcgggcacaacccgcgaccacgtgcccacgcgcttcaacacctgtgtgaccaccagntccacgaatatcagtggcccgacgaaacctctacagaagagacgctgcgaacggccacgcgacgagacaacatacaacgttgtgtacgtcccgacgaaacatacgcgaccaccccacctgcatgacccatcagcatgacatccactcgcagcgccgatcaactagcacg

SEQ ID NO: 630723 - DNA, 595 bp, Homo sapiens
gctccccaatgcccctcagtgcccctctccatagtgcccaacccgatacgagccccagagggtcaacagcggctcagttctgacccccactttgagtgagccaggggaccaagtggtgagaggggtgggtgggactcctcgggactctgccggggttacgtccctttccccctaaactgtcgtggagcggcctcccagaaaaccagagactgctacaggaggaatctttgccacctccatcatagctctggattcttgggctctaagcctgattgtgcccatgtgacctcatggcatagtccatgagatacatggcacagacggccctgaacccctcacatctggaaccgtaatacatactgccacatagccgaaaagagttaccgtgccagaatccatggagccttgagatggagcccctgagtccatatatgaggatgtggctggcacagaaatgagtcagtctgacaagtgatagtggacctgcagatggggggattacgtcaagagatgtacatacaaggatcccttgcaagacaagcgaaggttccccctgaatggagagacttcaatgggggcacgctagcagggaccc

SEQ ID NO: 630724 - DNA, 1686 bp, Homo sapiens
  misc_feature (202)..(202): n is a, c, g, or t
  misc_feature (205)..(205): n is a, c, g, or t
  misc_feature (364)..(364): n is a, c, g, or t
  misc_feature (369)..(369): n is a, c, g, or t
ttagctgtcttatcaagctgttcctccgacttcctatacagaaccccctactaatacctacacttactacatgtactacctgaccctcgtacatacactgcatggctaccagacacaaacagggcgcacatgtattaccacgctgaatcatctacatgcatgcaataccagaaattactaacctctactactactataactnctncttcactagcatacatctcccttaacttatcatccattcaactagatcacagtacaactaagatcatagtaactataatcattcatatcgcataaatcctaccattctgaatcacaccaccattgtgatctcactcatcctactgccgtatgtcaggcnacacncgagatgccaggacacgacccagcacaacgacagcgccctgaatacgtctcacgtaatctactaccatctcctagttctcagtacatccccatatcctcgcgtaatctccaatctgccacctacctctatatcgacccatcaacaatctaaccacctacgactatccaactcacctaccagtctctcttactctcacatcccactctcctcacatatagctcccacacacgtacacactttagtccccacacacctcaccacttgcactcccaaaaccctcacgtgtaaactcatcgcacctccagctcatactaccttcgcacactcagcctttgaaccactcagattagacccgcatccacacctcggttctcacgatcacccttcccctacttacagtgccaacttcccccccttataactgcccctactcgctctgaaaggcccccctgattccggcactgcgccgctccccattccagcctccctgtctcgcccccgccagctcacctccgtcgcgacccctcagctgccgtggctccgtcgcgcccatgccggccaccgccctgcccaccacctcacatccccttcgaacgaccgtccgcatttgcagtccacaaacgcccctctacttgaaggaccatataaacccacctatttaacgcttcttgttacacaccaatttacccccttaggttgcaccgtggacactcccctcaaacttgcaacgccggccaattgactctccattacatcggcacgtcatctcgccatactacggaccgttacctgaacaacaacccgggtacccctttaagcggatgtcacggcccaatcacaagcgactaagcgccacgtattcaaccccccaccttccgcgaaagttaagccaccgtccccgattcaagcttacacatacccgaacagacgcccctcccaagtgcacagagcctatcccccccggggagcagcaccagtcacaccagccgcagccaagagtcagcgcaccccacacgaacagatagcaccccccgagcggtaaccaagcttccgcgccgacgaagacacccggcgccaagtaacacacgccacactcacgacagcgccactcacaagccccgcactaaaagaccgcacccagcagcgtcccccacatagcccccgcaagaactcatccaagcccgcgacaacgagccgctacccacgcgatataccaccggcgaaagcacgcggcagacaccaccgcgcacgcacaacccaccccccatcccccacacacgcaacgccacccccagcttaacaccggcgcgccacct

SEQ ID NO: 630725 - DNA, 307 bp, Homo sapiens
  misc_feature (67)..(67): n is a, c, g, or t
gcccccgttttttttggggggcagccccgggaataggaaaggtccccccttccccttctggcccccngtggggttccccccaaaccccccttttttgtgtttttagggccccccggtttttttttccccgggggggaacccttttccctggtttccttcccccccccccggttgggcccttttggggggggggttttccctttggcccccgggggggggcccccattttttcttttttttttttttttcccccccccccccccgggctttttggggtttggaaaaaaccccctttttgtccctggga

SEQ ID NO: 630726 - DNA, 279 bp, Homo sapiens
gaggatccactaatggtgatgactggatgtctggttactggctacaaattatcagagtagtaaacttcgatatatattgaggggatttaaaactacactaagtatcatttgattcgattcagaaagtactttgagatctctcacaaggctccagtgctatcatggtgagcaattgtcttttatataccggtacttggtagcccatactataggccggtttggggcattctctagaagtttccttttttacacaataaattccttataacagccagggta

SEQ ID NO: 630727 - DNA, 412 bp, Homo sapiens
ttcgtcgaagaacaacggcatttacaatacgaaaacagacaatgccctcagttatgaaatgaataaaaatgtatttagtgctttatttttaactgacagcaaattgacttcctttattgagatcgtggctatttgactgtattatactttagctctataaaggtacattgggtacctggaagatcaagatctacagctgcctatttccacatctttcaatccatctggctcctttaaataggggaaaatgcccttatttggtgtaggagcatttcccaatatgaagttacaggttctatttaaacttactgtcacatcaactgttataatagggccttttgtgttttgttatttcaccttaatatcaccagaattcctgtaatttcacaattgtgattttactatgtagaat

SEQ ID NO: 630728 - DNA, 907 bp, Homo sapiens
agcggggcgactgggccggaacggctggagttctcgcggtgcccagtccgggcgctcccttcaggccagttcggcctacgttcagagagcggtccagagccacggatgatgactgatgtctccgaggctctctcggatcgtttgtatctagttattaacagggagcgcgtgaaatgagcgctgaatctctatcattcatcttcattcagacaaagtaagatcatgggcctaaggactagacagcatgctacaggtgctagagatacaacagtgaacaaagacatgaaaaaactctatcttctggagctgacatttatcatccgatcctgactaggcagtgtaacaacctccaataagacaatgaatacattaatactataatagatctgtgtacacatacttaaattatagaagtaaagctaacaatatagaaaggcgagcacattaagagtgtgggtacacttggggtttggtgcccacaagtgtgctacctgtggcgaatagcgtctccatggaaactctacccttattacggcaaacgacttacttgagacggagagtccgacgagatgcatgtaacagtgggcgttcctgggtgacaaaggcatacgagaatcccacgtggcattgcacatgggcttggggaatatagacaacatacctgacagaacgtggtttcaacactggttgtctaagcccacagatctccagcacacatcttgtattcattcaagtatgtggtcatggcttcatagtcttccgttttgccattcaataagcactatgacgaagaaaatggacaaaaggaactaagtttaaggacaaaggggggaatagaaggagagccttggtatatgttactaagcgactaagcccaaggaataagtttcctatttcggggagaaac

SEQ ID NO: 630729 - DNA, 1097 bp, Homo sapiens
agcggtggctggcgggtgggctgcggccggcggctgctcgccccgaagtgggcgcagcctgcccgctgcctggagggcggccagcattagtgcgcgcgacatcgggtcttttccttcccggcgaggagcagtccagacctcctgctgtgacccgggatgccgacgcacatcggacccaaccggacgacccatcatgccgggtgggcctggggcgggagccacacacacagatacaacatccactgaacagcggcggatgcatcatggagcatcatgacctccatcatcccaacatcgacgccccatcataccttcgagacgaaggcgcgacacacagtggtccagatccaggatcatgagtggcacacagatggatcacttgtcagaaccccaccagacacatcagaacccccgatggacgagcaagacgttatggcaccgaagtccgagatcatatatgggatcacgccatgaccagggcagaagcagaagagattcaacgacgagagacgacgcaacgactttccatatccctatgggttacttttcagctggaaagaagtcttccttacttggaagcaaccttatgacacctcatttctttttcatactgaaggttatttcacgttcctacccatggaaggggcatcaagattattgtaagacaattaacatcagtgggaaaatatcccttcacgaagggggagctttagggcgttgaaacaatggggtttgacgatttaaagaaaggaggcggcataaaaggatatttgatagcaggcattttacaacacgaaaaaatttatgaatagatcatggacccaggttagaaggacgttatgccaaccacgtggtggattgcctcttggatcgcaacattaaagaaccaatatcccctggaccaacggacacttaacacctacatttgcgcccctcacagagcgggatcgataggtaccttggccagccacggaacccttcctgcggtccagtcatgcaagacacaattacccacatgtcttcccacccaaagacactgtggccccaacccggacgagcagccatcatatcagagtactgaacagggttccagacac

SEQ ID NO: 630730 - DNA, 164 bp, Homo sapiens
cgtattacattttctgtctagtcacatttacatttctggtaacagttttttacattcatgtgcttgcgtttcctgggccattcaacgcctccgggccattcaacgcctccgggccattcaacgcctccgggccattcaacgcctctggccattcatcgcctcga

SEQ ID NO: 630731 - DNA, 401 bp, Homo sapiens
atagtatgcgctctatatatactcgtgtgtggaatgtgtcctctctctttccactctgtgaaacctatggttctgccattctgggtgaccctgtgtttctttctggtgcccattccatttgtccaggtaatacttcctcttaaaaatctccaagaagctgggtctccagatcccatttataaccaaccacgtgctgcacatgtagatatatggccatcattctaagcccaaagtagttccattctataaaggtttggagagggaaatccaagctcttaaaggcacttaatttctaagtatgtgcatttcccatctcaacttcaagggaggtgtgaacagtattatcttcactttcaatatccctccgctctactctggaggaggctgtcccctctgtgggg

SEQ ID NO: 630732 - DNA, 547 bp, Homo sapiens
  misc_feature (14)..(14): n is a, c, g, or t
  misc_feature (155)..(155): n is a, c, g, or t
  misc_feature (170)..(170): n is a, c, g, or t
  misc_feature (186)..(186): n is a, c, g, or t
  misc_feature (252)..(252): n is a, c, g, or t
  misc_feature (257)..(257): n is a, c, g, or t
  misc_feature (414)..(414): n is a, c, g, or t
cctctgcggcgccncttgcatcctctctccactgcccactaatatatttctttttccatagcatccaacactggaccaactgctttcttttcttctcttgggaccaaaatttaggggtcttagtttctcactgctatgctctggtctattttgtnttttcttctttttcntggttcgttctgtctntgagctctgtgtttcttgtttattttatggctgggagttactgatgctgtttctgctttctgatgntggantggctttgcttctataagtatgcttcttttatagctgtggctgtaggaacttaatttatagggaggagcttgtggtagctgctgttttagttatagctgtactgactgtgcttattatatatctggggtagcttttcttggtaggggtcttcgtggnttcttatttttcattcctttcactgtggctaaggggtggggtgaggggatggagagggagggctgcttaccatggtttggggcttgaggaagatgagtttgttgatttaaataaagaatttgtcatttttaaa

SEQ ID NO: 630733 - DNA, 683 bp, Homo sapiens
  misc_feature (302)..(302): n is a, c, g, or t
cgggatgatcctcatccggaaacaagggcttctacatagcaggactgtctacatagacagccgtggcgagttctgcccaagacctatcgtgtccccgagcgcacgtcggcagcggggcctatggctccgtgtgctcggccatcgacaagcggtcaggggagaagggtggccatccaaggaagctgagccgaccctttcagtcctgagcatcttcgccataagcgcgccttaccgggagctgttgcttgcttgaagctactattgcatgctattgagaactgtcattgggtgctccttggatngtcttcaaccctcagcgctcctccgctgcagcgaacttcctatgacttctaacctaggtggatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcag

SEQ ID NO: 630734 - DNA, 624 bp, Homo sapiens
  misc_feature (187)..(187): n is a, c, g, or t
  misc_feature (231)..(231): n is a, c, g, or t
  misc_feature (238)..(238): n is a, c, g, or t
  misc_feature (342)..(342): n is a, c, g, or t
  misc_feature (420)..(420): n is a, c, g, or t
  misc_feature (441)..(441): n is a, c, g, or t
  misc_feature (448)..(448): n is a, c, g, or t
  misc_feature (456)..(456): n is a, c, g, or t
gatctcgccgaaatgcccccacctcggaaaccatttccgtcggggtggtggatgcctgaaacggcacacaaggcggtttcgctgcgtgtgttgaccgtggacgactcttcttgtagcagcgcaagcaggtcacgctgttgcctgcaaactggtcggggttgaggtggtagcgctcaatgatggccgncaggccttggattacctgcgcaagctggcagacgaaggcaagangcctgangaagaattcttgatgatgatctctgacatcgagatgccggaaatggatggctacacgctcacggccgaaatacgtaacgatccacgcatgcaaaagttgcatancatcctgcatacttcgttgtcgggggtattcaatcaggcaatggtcaagaaggtcggtgcggatgactttctggccangttccgtcctgatgacctcgnatcccgngtagtcgnccggatcaaggcagcagatcacggctaggggatttcccctggcggtcacacgatttaagaggcggcatcattgtctacgggtaatttggatttcgaacagttccgggtcgtcctggaaaaagcctgtaacatacccctcggtgaaaacaagcagtacctggtatccac

SEQ ID NO: 630735 - DNA, 336 bp, Homo sapiens
  misc_feature (148)..(148): n is a, c, g, or t
  misc_feature (213)..(213): n is a, c, g, or t
  misc_feature (218)..(218): n is a, c, g, or t
  misc_feature (222)..(222): n is a, c, g, or t
ttctcttcagatcgccttcagagtattcccacaggaccctctccagagccttcccatcacgcgagactctcttctggcatgacaaacttctctccttaaccagttctgatacgcacccacaggattgcgccaagttacagcaaagttnagtttgtgcccagcatccaggaatttctttgccaccatcattacctgtttctccagtagttgganccttnagcntcttttcatagtccacttcatagtaacgcaataagtaagtccgtgccgtgtatcaaatctatagtgtcttgtgtcatgtgagggcagatcccaaatatgttctcgtgtataacc

SEQ ID NO: 630736 - DNA, 374 bp, Homo sapiens
atcaagcccctggacaaaaaactcatttttgacagcgctcgtgcccccaaaggcaggatcctccccgtggaggaccattattattaaagtggcattggtgaggctgtgttccaatcccagtagtgggcgagacctggcatccctgtcacccccctggcagttaaccgggtaccaaaaaatgggaaaccggcttaactgcttaaaatgtttggtatcgacagggatgcccttgccccaactgtgaggggcctcatccccaaggcctagggcgggtattaagtgtggggcgggggtctatacattccttaaattttgggaaaggtgctcaaaaatgtactgaaaggaggggtaaatatatgtttttagaaaaatta

SEQ ID NO: 630737 - DNA, 150 bp, Homo sapiens
catgctgctaaagaaaccaagatgctggtggctgctggagacacacgatggggacaggcaaaataggggttgacgaattctccactactggatggctgaaagctaaaaagcactgactgcccctggtcttccacctctctgccctgaaca

SEQ ID NO: 630738 - DNA, 265 bp, Homo sapiens
  misc_feature (1)..(1): n is a, c, g, or t
ntatctcacattagtatgtctggggctagatttcaacacccacgttatgaaaaagtcagttttacaagcctaattttgttgttttttttttttatattcaattaacgttcaaattgcgtcacctattttattcattaggatctttcatattataatttaaccttaaaattcaaccgccatgtgcttttataaaggaaacattttttcagagacgtctgagcccacttttacatggtggtgcctacagccgttaatgtgtgagata

SEQ ID NO: 630739 - DNA, 1045 bp, Homo sapiens
aaccctccggtgtccctgacccaggctaagcttgagcaatgggtgagcaggagcccctacagccttgatcagctgggccagattgcagtcggagaacgatggaggatgagcagctcggtctgactatcatagcctcccggtcgccagtaaagagcatccaggcagatccaggagctgggacaaggacgagcgagagcctgcgaaaggtaccatgtaggcctctgctgggcctgctgtgtggctcgtttcgcgcagcatgcccaatggatccgctcgaacgttcgtggttgactgtctctgtagccgtggatgtgcgaacatcgagccccgtggctcactcctgagatacttggtacgcattgaccggcgacggaccctgggaagagctttcatacgacagccagatcgatttggtggcttgacagtgcatcgagtggttggacgttgacccgtggattacctcgaaatcgtcctgcccgggggggttaacccggcggaggcatacgtggtcctgggcacttggaaaggtagcaattctcgaggcaatttaacgctgtgcaaggggacacactggggcccgcttcacactgagtttgtaaccaaaggaacttgaaacttaaccgaattgtggtaaggggcaaggtctgaccagggccattcaagagggttcccccggtgtttccatccacgcaacggaactagaaccgaacggaactacagaagcacacccttgtacacgttgtggtaagagctggcacaacttccctgtctaccccctatttcccaaaagagaacaggcgcaacctttggcgcacatcgggccaccgtgtgtggaggggaccctgcccagaaggcccctaaacgaaaaaggggccgcgggggccaacggcggacgcatgcaacctttgtaatctggttgtaagcccgggaaagcgtggaaaccctggggagctaacgggggccagcgacgtgtgttttggtccacaccacgtacgcgttggggacacagccccccaagacagacaaaggcacaacaagcatcaat

SEQ ID NO: 630740 - DNA, 112 bp, Homo sapiens
cccccccccccccccatgggggggtggaaaggggggcaaggccctgcctgctcccctttttttcccttggaactgtattaaataaaatcccttttgtttgttcagtttttca

SEQ ID NO: 630741 - DNA, 264 bp, Homo sapiens
acatctgcgcagcgcggactgagactttctccggaagtgcattataaagcgctgataaatcgccctgatgtctattcatcactccatcctgatcaaaaaagtcagtaccatgttctttaatcacttgggcataactctgagaagtatttggcactgaagacacttcgtactctggctggctagtatttcctagatggggaagtagcgagtgatatcctctgattataccttctatttggtctgaagagcacatatactaaagcg

SEQ ID NO: 630742 - DNA, 320 bp, Homo sapiens
  misc_feature (189)..(189): n is a, c, g, or t
actatcagttttgacacaaagacagctgaaaaaaataataaagctggctggacgcggtggctcacacctgtaatcctagctactcaggaggctgaggcaggagaatcacttgaacccaggaggcgaagattgcagtgagctgatatcgcaccattgtactccagcctgtgtgacagagcaatactctgntctcaaaaaaaaaaaaaaaatttcaaatcagagtgtgaggtgattgagacaccccagtttttcctttctactccgaatttccagctgtgattttagccctcctccttttcaacatttcaccgaacccttcg

SEQ ID NO: 630743 - DNA, 426 bp, Homo sapiens
gtctgtgagggtattgccaaaagggattaacatttgagtcagtgggctgggaaaggcagaccccctcttaatctgggtgggcacagtttaatcagctgccagccctgctagaatataagcaggcagaaaaatgtgaaaagaaagatgggtctagcctcccactctacatctttctcccgtggtggatgcttcctgccctcaaacattggacatcagatcggcctgcagatggcctattgtgggacgttgtgatcgtgtgagctaatatttaataaactcatattatatatatatatatactattagttctgtccctctaaagaagcctgactaatacagaggtcatccctagaatttgtcctactacagagagattgcaatttaccccatatgagaattgtgaatagaataaaatgtttgcccaga

SEQ ID NO: 630744 - DNA, 730 bp, Homo sapiens
  misc_feature (28)..(28): n is a, c, g, or t
ggtcttgtgtggctccggaaaggcgttngggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaactttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcattccccctgctattgtggtactccagcaagaggaatatgacactcccaaaacgagaagaactgattggggcttcacagcctcctctcccacgaaattcaggctcctcctccaacaaatccacgtgctttcagcactccacagggtatcttcacatgccactcttctctcttagcccttggccacttttcctggatccttgct

SEQ ID NO: 630745 - DNA, 674 bp, Homo sapiens
agcggagggagctgggcggagcgagctggacggtggacggagcttggtgggcggtgcgtggcgctcccgcaatctcaggataccctggctgctggcggggctgcggtgctggctcggggtgaggtgtgtgtgtgtgtgggtgtgggggtgtgtgtgtgtgtgtgtgtgtgtgtgtgtagacgtggattttaacaaatgctgggtttgagtgtgcgtcaatcctggctttacagttttttctacctaggcttgtacattctcttcacactcccttaagtacccttattctcttcatggccgcgcgcagtgcagccttccgtgcacgaatcccttatgtgtccccaagtttcctccttccgtaatgggatttgctttccgtacactttttaatcgactaaacggataaactccaaagttgagagagactaagtgggattcttcctttgcgctctgaagttcccttgaatgccctcgcgctagcttatacccttcattaacgctcgtcgtgcctgtcattgcttcgtccatgtcgtgcatgccacactaggtttcaaacgtgtcgcgaagtatgtagagtacttataaggaagtgagtgtacgagtgagaccttcagagttctgaacttcgctcctcattactcctgggtggatgggggacgcgtctttcccacaga

SEQ ID NO: 630746 - DNA, 1112 bp, Homo sapiens
  misc_feature (234)..(234): n is a, c, g, or t
  misc_feature (249)..(249): n is a, c, g, or t
gcctcgtgtccgcgcatcaccccgtggctgggggttagctaggggagggcgggaagggcagaggacgcggtggctggaggacgtgtaaccttgcaagaggcgggaggcggggggcagaggtgattgacccccgcccccccgcccgtgggaccaagaaagggatgtgacaggcgaggacgaatgggatctcaggggctggactggagagtggggtacagggatgtgaggaggacnccgcgagtccgcggngggatcccaatagagctgtggccaaggaggaggggagcagcgggaaggctgtgggcactcctgtgtgagggaaagctacaggctcctgcaggtccgagatcggccgaaatcaggcaccccaaggaagccctgctctggccacatggtgtcccctcagaagactccaccagccgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaactttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcattccccctgctattgtggtactccagcaagaggaatatgacactcccaaaacgagaagaactgattggggcttcacagcctcctctcccacgaaattcaggctcctcctccaacaaatccacgtgctttcagcactccacagggtatcttcacatgccactcttctctcttagcccttggccacttttcctggatccttgct

SEQ ID NO: 630747 - DNA, 117 bp, Homo sapiens
ggatttgctggtgcagtacaactaggcttaatagtttggatttgctggtgcagtacaactaggcttaatagggagttagaagcttgaattcgagcagtagtagtagtaggcggccgc

SEQ ID NO: 630748 - DNA, 221 bp, Homo sapiens
tgtataccgccaggcgtctgttgtgctgatcgggccatgctgtctgctggcttccgctgcgcagcagggtaccaagtgtttgcgcaggacggccgcgctggacgcccctttgagggacccatgcttgagacagctgctgtgagggaccgtcctgacgactctgcagccctacgggaacccactcggagggtgccctctgctcagccgggtacctgagctcg

SEQ ID NO: 630749 - DNA, 860 bp, Homo sapiens
gcctcgtgtccgcgcatcaccccgtggctgggggttagctaggggagggcgggaagggcagaggacgcggtggctggaggacgtgtaaccttgcaagaggcgggaggcggggggcagaggtgattgacccccgcccccccgcccgtgggaccaagaaagggatgtgacagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaactttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcattccccctgctattgtggtactccagcaagaggaatatgacactcccaaaacgagaagaactgattggggcttcacagcctcctctcccacgaaattcaggctcctcctccaacaaatccacgtgctttcagcactccacagggtatcttcacatgccactcttctctcttagcccttggccacttttcctggatccttgct

SEQ ID NO: 630750 - DNA, 486 bp, Homo sapiens
aggaattcggcacgagagagagtttgagagagagagttagagagagagagagagagagagatatagagagatttattgatacatacagtgcctttcttactcacttgttcttttctacctttcctgccttgttattttctttttttctcctcctctttgcctattccttccttcgatttcttcattctcattcttttccttttttctttttcttctcttcttatttcttcctttctcttttccttcttttcactcttctctttttatttcttttctcttcttttctttattcccttttttctttttcgttttccatcttcttcttttctcctcccttccttttctttcttccttttttatcttttctcttttttctcttcttttctttcttcttttttctcttttccttcccttctcctttctctcctttcttatcttccttttctcattcctcgttttttctttttttctttttctttctttctt

SEQ ID NO: 630751 - DNA, 167 bp, Homo sapiens
aggtgtagggttgggaggctcaggagctggtgctataagcttctcggggaccacgcttaggatcacaagagctgcatctacgtaagaatcactgattgccaaggaagcacggagtcctttcatatcttcttctacatttaatatctgccacactggtgatgtatccg

SEQ ID NO: 630752 - DNA, 893 bp, Homo sapiens
taaatattatactatcatttaccatctcacttctaggaatactagtatatcgctcacacctcatatactccctactatgcctagaaggaataatactatcgctgtccattatagctactctcataagccctcaagcacccagctccctcttagccaatattgtgcctatgccatactatgtctgttgcccgtcctgcgaagcagcggtgggcctagccctactagtctcaatctccaacacatagtggcctaaactacgtacataacctaaacctactccaatgctaatactaagtcgtcccaacgattatattaactaccacgtgacatgacttgtccaataaaagcacatagatttagaatcaacacgaagccagcccacagcctaatgattagcatcatccccctatctacttttttataataccaaagtcaaacaatcaagcctagttgtagctgttccccaacccttattgcctttccgaccgcccataacaagcccccctcctaatagctaaccatacctgttactccgtaccccgtcacaaatcatggccaagccaaacaaccaactaatccagtgaaccactatccaccacaagaaaactctacctctctatacataatctcccgtacgaaatacgcctttaactctatgaccattccagcagcccacggaattgaattccatatatcagtatcttctgagaacagcacatttagtcccgaccattgggttatctgtcacccgatgaaggcaacagggcagaagcgccctgagcggcaggcacataaaaggcaatctaccaccctacatagggcaccttcccctattcatggcctaattacaaggcaagaaaaccgtaggtcccaaacacatctattagcactca

SEQ ID NO: 630753 - DNA, 286 bp, Homo sapiens
  misc_feature (168)..(168): n is a, c, g, or t
  misc_feature (181)..(181): n is a, c, g, or t
  misc_feature (195)..(195): n is a, c, g, or t
  misc_feature (241)..(241): n is a, c, g, or t
  misc_feature (266)..(266): n is a, c, g, or t
agaattgacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaacaatgatgacgaatgacggaccncgggaaggaatgnatatttaacgaacnactgttcgaagacaggtttaacacattcaaatagcaacagattacngagacctaagtaaactatgccaaangaaatgagatgttggaacgg

SEQ ID NO: 630754 - DNA, 523 bp, Homo sapiens
ggaaggaggtatcacatagtcccatattctggaggcttgtcgtcctttttattcttctttccctaatctgtttcacgctttatttcattaagttgatcttcaatccctgatatcctttcttccgcttgatcaatttggctatgatacttgtgtatgcttcacgaagtttttgtgctgtgtttttcagctccatcaggtcatttatgttcttctctaaactggttattctagttagcaattcgtctaacctttttcaaggttcttagcttccttgcatggggttagaacatgcttctttagcttggaggagtttgttatttcccaccttctgaaacctacttctgtcaactcgtcaaactcattctccgtccagttttgttcccttgctggcgaggagctgtgatcctttggaggagaagaggcattctggttttcagcctttttttgtgctggtttttcctcatcctcatggatttatcgaccttgggtcttctatgtgggtgaccttcgaatggggtttttg

SEQ ID NO: 630755 - DNA, 134 bp, Homo sapiens
gcccgcccccccccccccccccccccccccggggggggtccccctttttccttttggggcgggggaccttttttttaaaaaactctttttgtccccgggggaataaagttggggtgttgtttgggccggggcca

SEQ ID NO: 630756 - DNA, 208 bp, Homo sapiens
ccccccccccactttttttggggtggtttgggtggcccaaacagggttttggccggccccctttttcctgggggggggggccaggggtttcccccgcccctccctggggtagccctggggggggggccctgggttcccaaaattgggaaagggggagaaaaaagatgggccgccccccggtccctttaaggggttttccttcccctga

SEQ ID NO: 630757 - DNA, 405 bp, Homo sapiens
atgaatgtcagtagacatagtagatatgactgataagcaaatctggctaccaggtgaaactctgaaaagaaacctgtcttcctggccgggcacagtggctcacacctgtaatcccagcactttgggagttcgagaagggaagatcactggaggtcaggagtttgagaccagcctggcatggcaaaaccccatctctattaaaaatccaaaacttaggaccgggcatggtggctcatgcctgtaatcagcattttgggaggccgaggtgggtggatcatgaggtcaggagttcgagaccagcctgaccaacatggtgaaaccctgtctctactaaaaacacacacaaaaaattagccgggtgtggtggtgggtgcctgtaatcccacctactcaggcggctgaggc

SEQ ID NO: 630758 - DNA, 252 bp, Homo sapiens
ggcttccagcgcatacagtctttgcttctacagctagtcccatggtctccttatcttcaggaggaaaggtttacctcccagcttgtctgttatctccaatctgattctttagagaataggcatagctttccaactcatttctagtatcaatgcgctccttgagctttttgtcttcctcagcaaacttctcagcatcattaaccatcctttcgatttcttcaggtgtcaggcgattctggtcattggtgatag

SEQ ID NO: 630759 - DNA, 288 bp, Homo sapiens
aacaaaaacagaatcataccaaaatcgagctctagacatccaagacaaggtcaaaccaaaaccaaagtatcaagcaatccaagtcaagtcaaaaacaaaaaccaaagtgccgatacaggcacgccataggtgatcaggccacacttccactcaaatggagtgggcaagttccaaagactagtcttaccaagtttcagatgtccagactccaagtgccagttccttcccggtgttcagccactgcattgatcctccgcgggggctgccacacgcttgtgtaaactgatt

SEQ ID NO: 630760 - DNA, 226 bp, Homo sapiens
  misc_feature (6)..(6): n is a, c, g, or t
  misc_feature (34)..(34): n is a, c, g, or t
caaagntaagggaagctgctcaaacattcagaancacacagacttaactgacaagaggagagtgaagagaagaggtcgatgaacaggggagaagtaaggacatagaattggcatgtcacaagcaaatggtcgagagcaaaggcagccgagccctgaagaacaacagaatgaattgaaatgcgattatggaataacaatgaaccatatggaagcaactttttttggt

SEQ ID NO: 630761 - DNA, 345 bp, Homo sapiens
ccccctttccttttcttcctccccgcccccccttttttctttaggctttaagaagaacagaaaatctttttttcctttttggtttttttttgcccccccgccgttttttatggtttttttattggtggggccccgcccagaataaaattgctgcccccggagggggggcccccccaagtttaccccttggtgaaaggaagatgccccctcttttttggcccgtggtgggggatccgggggtgccccctggtggtcttgttcccgggggttggtcctccttcatggccccctttatgctcctggggctatttttttgggccgggaataaaaatggccgagctgtga

SEQ ID NO: 630762 - DNA, 202 bp, Homo sapiens
  misc_feature (23)..(23): n is a, c, g, or t
gtcggcaaagctctatggaagtngggatcaggaggccttgcagaaaggagtcctgtttgcttctgggcagaactttgcacgctcaattgatggtagacggcagtccaatgagatgacgccaaccagatttgtcgaaatttttgagaagaatctcaaaagttctagttagtaaaaccgaggtcatattcagacccaaggtctt

SEQ ID NO: 630763 - DNA, 503 bp, Homo sapiens
gcggccgcctactactactaaattcgcggccgcgtcgacatcttccctgttgtttcatcaacaacctctactgatttaaaacgggtaccaaacgtattggtattattaggaattcccattttttccgtacttgatgctattagtccaccaacatagcgctctttttctgcttgattacgggttaacgctccacgccccgataatgtaacactctttgcttctggtgctttagtctgccaagttttcttcgttttacccgtcactttatcagtcgtttcaacagcttcaaaacgccccgttaacaccgttgatttaggaaaaagagcgctattatcgaaattaagcttagaatcaacaggttttgatgacatgtggctaacttcagcggatggaactcgtgcactatctaaaatgctttggtgcaattcttttaccgaagaaatcgtattttcccatgcttttccagttgataccgctactcgctcattattgacttgaggaat

SEQ ID NO: 630764 - DNA, 566 bp, Homo sapiens
cagaaccctaatgccaccccagcccagggggcctccagccagtcgggctatgccggcagtggaggcggcagcagtgcttcccacgtttccccacgccagcccagcagccagtggccccacccctaatgacccctaggtttctcttcagggccccaagccaggccatctccccccctcagtacccccaggttcagggcagcacccccccacagttgggccagggccagccccagccctttttcagcttccggcaacggcagcagcagccaaagttccacagccatgcagcccttgactggggaaaaatggcggagcagtggctgcaggaaaaggaggcagaacggcggaaacaaaaacagcgggtgaccccttggccctcccccagccccatggttgaaagcccccccatgtcccttgctggggatgcccccccccttctggacgagatgggtcggtagggggcctgctcctcggactttggtttccttttagggtgggaaagggctgggtgccccctgcctccccccctgcccctccttttttgtccctaaagtggggtgaagtta

SEQ ID NO: 630765 - DNA, 162 bp, Homo sapiens
ctttttttcccccagaaaactccgatagcccttttgaaacttaagggtcgaaggtggatttaccagtaaactgagagtagagtgtttagttgaccagggcccttaagggggtaccccccgcccgtccccctcctcaagtatacttcaaaggcctttttccta

SEQ ID NO: 630766 - DNA, 317 bp, Homo sapiens
ttggggtgcctagaggatcccgacggacgcatcacggagagttctccacctcatatgccagcatgtaccacctacagtgtgtgtgctacttgccacgtcttacagtagttctagaactaagacagacagtgcagccgacaggtctccaggtctcctacaatgcaggaagttaaaactccttgattaaaaaccctcctaagatgaagtcttactatttgaaatgcttccatcaagagtgctagtaatccatgcttcaaagcagtcatattgcttgtaagttggacctaacactttttgatctatgaatgcgtccgccg

SEQ ID NO: 630767 - DNA, 613 bp, Homo sapiens
  misc_feature (22)..(22): n is a, c, g, or t
cctcaaggccgggcaagaacgnaatacatatttcgctgatgcacgttcctccgcctcacgaaacacatataagtactactctccccccctatagcacacacataatattataatatttatatctctacccccttgcctcacgcacattttttgtgctacataacacacccgtgtttttgtaacacacctgaatcattgtatctcaatatatttcgttgttgtgcataaacatctcgtactatacaactatgtttgtggtggatattatagaagagcgcgtgttgttatataggtgaggagcgaagacatgttttttgtagtgtgtatatataagagcgcgatgtataccaccgctttgtatcttgtagcatgtctagatcgatcgacagggtgagcgccacacatatgtctatagtatgttcttaatatatgagctcggtgctaccacgccccatttcttacctcctattctgtatgttaatatggcttacccacataggaggcttctctcctcctccctcaaggcatccctgatagttttaagtaggcttagcaccaccccctactttaatgtggacaagacacaaatcctttttctccaaagtaaacgaga

SEQ ID NO: 630768 - DNA, 895 bp, Homo sapiens
atattctttagatcgaatgtctgtgtccctgaccacgttaagggtagtgtgatgctggctctgagctagttccattaggcagtatcttgatatatgaaccagtgcaagatatacacatcattagtacatagccggatggtaaaggcagcgtattcagagtaggtgcacaaactgagcgtatctgtttggtccggattagtccattatctattagaagtcctgacgaggaccaaaccagttaaattagcacactaggtggacttctgtttgaaggaagggtaaacgttataaggaaacctcaaatactataagatgtgtcaaaggtatttctccagaattaattggcaaagcttagtgctgaaggatttctaaatcagcttctaaaattttcttctcaataagacatatgtttgattacttagggaagattcctcattttattctgccctttatgcatttaatccacatgataggacattacacaccttactatccagaacaactcgtgctcatactgtacatctatttctgtgcttggaactacttgttaacagttttatcgaagctgtcagcacataagggactaaaactgcgtgtattatacattggtggcaattgactaaacagctaaatttctgtgtttctagtatagggacctaagcatttcccactttgcagaacagtgtattactactttccatatgccttccgttaacagggaaggttattagttttggtaaacccctcctgtgccgggttctacccagtataaggtaattgggcgccatagagaacgagaacaggcgcgtgtagggcaacttgtgatgcgaggctcatgtaacaaattaaatcgcgcacacaaagtctttttattgtgatcagcatatagactccc

SEQ ID NO: 630769 - DNA, 1311 bp, Homo sapiens
gctccctgagccggtgctgcgctcctctaatgggtgactccgagctgggggctattgtctggaccgactggtcggcgtgttccacaggaaggcaatccgcagtttgcctaccagacgtgcggtcgcggacggaagtccagtgtcgtgtcgcatcagccgcccagcaccagcagctcgcggccaacccggagcagcgcaaccgcaggaccgagcggccgagctcgcgcatcccagaccaatcactcttccacctgcatccttagacgaccggcgaatgactgaagtgaggtcagagctcgacagatccagcccaagccccggcagccttccataggcacggaagacagcggagcgcgccaccgcgacgacccgccgcggcgtccggggcgccacacgcgcgcggccacagggccgccgctcccggctcgaacgtcccgcggcacgcacgcgcctcggcacgcgcgacggtcacgcaccaggagacccacccgaacggtgcccgactgccactaatgcacaccctacgcggcgcccgaccccatgaaggggcaaaccccagaacaccctcaccgtgccaatgaccatgcccacacggacccccgaggcaacacaaacccgacgccaccaaacacgtgccctggcaacggcacgccacccacgacggcgcgcatcgaccccccccacagacagacctcggcaccgaacccgagccactccacccgacggcggcactacctccagccccgcccccttccccccccccccggcagcaccgaccgccgcacccccactgccacctgcaggacactcagcaacgccccaaccaccgacgcgacgcacagactcacccccatcacagagacaccctcgcgagacgccccccctgcaccccgcgccggaacccgcaccacacccacccaacccacccccccccgccccacaacccacccccacaccacaccccacgcccccacaccgacacgccccgagcaccccaacacaccagccacacacagaacaccccaccgccacaccacaccacacacgcacaaaacaaacgcaaaccacgcaccacaccacaaccaccatcaaacacccgacaaccacccgaccggcaccacggaccaccgcaccctacccagcaccggacagccccaccgaccacccacagagaccccgcgccaacaaccgaaccaacccaacccaatcaccccgagcacaacacccccaacgaacccccagagcataaccccacccgcaaccgcaccaacccgaacgcccaacaccaacccacccaaacccccccacccc

SEQ ID NO: 630770 - DNA, 595 bp, Homo sapiens
  misc_feature (322)..(322): n is a, c, g, or t
tgttcaagagagaatggaaggaaatggaaatggcaaacatggcctgtataactctttcaaagagttttgttctggtgatgatcagagaaatgaggtggtaaagcagatgtgtggtccaatgagtgttctgcttttgttttcaaaagcagatgggagaaatagcagcatgtttgtatgctgatgagcagatttgatagcagggaaaactttaatgattctggacatagaggagagaactgctgagctaatttctttgactaggcaaactgagatgagatctggcgcacaaatgggaggctgggcccttgctgggtcagacagntcattcccagaagtaaaagggtaaccagagattatggactcaaatgcttgagcaggagaagaagtaggggaagttctcttatgaaatattcttctaaatgggtggctttcactgaaacagttagcagggcctcatcttgaagtgggatggggagcaatgtaaagtttcagggaagaagagaagattagcttgtaacaatcctgcaaagaaaaggactactgtttgtacccaccaatccattggtacgacctgaatcggatatgggctaggttt

SEQ ID NO: 630771 - DNA, 479 bp, Homo sapiens
gaaattcggccattatggccgaggaactttttgatattaacaattaatttttcattaccatcgaattattcctcaaaatttggggtttattccccattttaaaccagcaatcccatatgaatactaacccaatttaatacaaattgatactaccctattcaacaacaatataaaccaaaacatcttttaccaataaaactatagaccaaaaaaattaacaaaacaaacataaataaacccaaacctttaaatatcaactcaacatacctaaaaacattatctcagtatattactaatatcaccaattaaactctacaaaatcaaaatcctaactaccagttctaaataccactctaaccctttcaacacaaaatatttacttttaccgaatccatccctaccctttcccatatatcgatcaataccattttcccctattaaatacatccctttttacaaagtaaaatttccctgaacat

SEQ ID NO: 630772 - DNA, 666 bp, Homo sapiens
ggccgatggctgagtggaacggcggaggctcctctagagaatggtggtggtggcgactcgggagcctgagctttggaacgaggattggcgcccatttaagcgtcaatacctcaccagcaaggagcagtttcaccaattcctggaagccaaagggcaggagaagacttgccgggaaaccgaggtaggagaccctgtctgtgcaatgagtctggctgagcctgatggctaagcggatccgactggaggatggacagacggcggacgtggtcacgacggaggaggcagctgagcccgttggtatgcatctacagactcagaagagggcccgtggacgaaaacaagggtccggccccatgtgaagcccagcgtaacctacgacaatgaacaggctgtgtccctccctaatccaggagtctggctgctaagtgtttcttcggtgcatcgctgtccgctttctgcatcgtacgtggggcgctacctggatgaccaggccggccgacctgggccccctgctgcgtgctcttcgagaccttcgaccggtgcccctacggcgtgacctgccgcttcgctggggcccagctgaaggccgagggacagaacctggtgcaggaggagttggcggccgcgtgaaccagcccccgtccatccgaacggctggacaagccc

SEQ ID NO: 630773 - DNA, 199 bp, Homo sapiens
ggtgtagagtagcagcaggatgatggggacggggtcagaagaggtctgatggtctagccagcacaggcgtttttcttattttccataattgggtcttagtcgttctgccagttgtctgcaggtaaataaaggtggcccatggcaatcatgattctgtaattgttatagtgcctttgtaagttgacagtttccaaatccc

SEQ ID NO: 630774 - DNA, 213 bp, Homo sapiens
  misc_feature (55)..(55): n is a, c, g, or t
  misc_feature (205)..(206): n is a, c, g, or t
aacatagcaagtagtaaccgatcaaattgctataacgtgtgtactgaccttatgnggaaaatgctgcaaccctgtttactgcctatgtaagtgaaatcttaacttccccattttggaatgctgactccagtcattaggtgtctgtatttcctgagtggttaccctcaagctttgtgctcaaataaactctatacttaatcataanntatcaaa

SEQ ID NO: 630775 - DNA, 779 bp, Homo sapiens
caggcgcggtggctcatacctgtaatcccagtactttgggaggccgaggagggcagatcacaaggtcaggagttcgagaccagcctggccaacatagtgaaaccctgtgtctgctaaaaatacaaaaattagctgggcatggtggcgcccgcccggaaggagggccgtaatcccagctactcgggaggttgaggcaggagactcacttgaacctgggaggcagaggttgcagtgagctgagattacaccactgcactccagcctgggtgacagagtgagactccatctcaaaaactgaaaataacaatcaaaatatgtattctcctaactgacaatatttacttaatctggaaaacaatgtaactatttttaaagtggttacatctattcttgctgaagaacaataaacagaagttgtttggactaagcataaccaaatttcagaaacagtctaatcaatgccaagtatccaaggcaaactctaatacccatccattgtgcaaaagcacgaagcacgcaagtattaaatcagagcaagctgtcctgagcccatacctattgaatggtgtctaaaatattggtacatggtgtaagaggcttgtcaaaactgggattatggcaagaaaggttgcctgacttcataccctttctggctgcaaatttccagggtgctaaagggcttaatggcattgtaaaccatcttaccattagttacaacacgtttaatattggcatatggccaagcagggctaaataggttaagaggcaaggtggagaca

SEQ ID NO: 630776 - DNA, 121 bp, Homo sapiens
ctgacgtcaggtccaacttgaacgatttgggagtcgtgagatagaaatcaagagatgtttattactgatgaaatctagactggaagcctgatgttagagctcctgccatggggccagcggg

SEQ ID NO: 630777 - DNA, 121 bp, Homo sapiens
gattcatcctatatctccgtcatgatgaaactttggctcacaacagactccaccaccgagccccgtccatttttccaggccaacacttctcatcattccaactcaatacaacacgcctaag

SEQ ID NO: 630778 - DNA, 1018 bp, Homo sapiens
cggacgcgtgggtccggacgcgtgggtcgacccacgcgtccgaataaagtttaataatatccgaacatgtacagctggtatggacctatacatgcatcttcaccagcagctggagcatctccacccttggctatttactggtgtaacatcactatgagctctgttgctattgagaaccatgtattgatagagtcctatctacctaacggagctacctagacacgggctaagccctaggccccactgggcacgcctaacgaaaattccttccacgtgctactacaaggaagacccaacaaggctagaggcgcttcacataccggctcctaagttaccctctcggctaaaccatctccgcttctaacccacagaaagctcatatattccacttaaggggcatacggccgtctctgtctccaccaccccaacaaggatcccttacaccgcgattacactgaggcaagccccatatttggattaccccgagcaacaacctatattggcccgccatatccgcgagcaagcccccaaccataattcgttataccctcctacttttcggcgccccccctatagtgactccccacacctccgacgcaaactctcagaggctactcaccaagcaaatggccgccgaattcactcatacaagggctccgcattattctaccaattatagaagccaccccagaaatcacactacattatacaccaaaagctcacggaaaattccccacttaatccacataaatcacattaaatacaccttaatggacattcaccgcatacaacacgatattctccaagccgggtcacagtagacctccacattttcccggacccgcaaaccaatgcggcctattccgcgagctaacgcgcacacacctttacgacgacgcaccgtgcccaaagggcaaccgaagaccccaccgcgctccctacgcgcccccccccttgcccgggcattcccccccagcgcaaacctctgggcgccacagagcagccaacagccacatgc

SEQ ID NO: 630779 - DNA, 868 bp, Homo sapiens
gaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgcttgtgactgcaagaaggattttgggtccggatggtcagtgcttacaagaaaaatctctcgtgagatagtgtctacattgtgacatgtatataaagagagagagatttaaaaggggccctacaggtaaatggcgattggaaggtgagggaccttgcggaagaatctccattctgagaaaatatacccatagatgctggtcgtgagaaacgaagacttggtgggatctagtacttgtgccatcatgggactaggctctgaggaccgacatggacaccaagcagtctgaattcttcaagggtcccagacttctagcttttttacacggtcgtatgattcaaagtatacaggcccctctgcgtactatggtcttcggttcagggaaggagcttatgtgatgggagaaccaaagattccagaatctggagtgggcgggcacagtgtacaaaagttgaaatcaacttcaggaaggaacagaagatgatgatgacgacgaatgattgaaggatgatgatgaatgaagaaggaaaaggagaggatggaag

SEQ ID NO: 630780 - DNA, 408 bp, Homo sapiens
  misc_feature (85)..(85): n is a, c, g, or t
gctcagttcaccccattaattcaaaagtgtgctcgctttgcaagcccacgtaggtgccgttcttcccttcgtcaatcgtcttgtntagtcagtgcgtccgtctcttcccatgttgatttatgatattgttaatttggcacgtcaacttggtcagctctgatctattcgtaatctttccttatggccgtttgctcagagaggtaggcaacaccacaccgctcggctctacttgaataactataattaataacacacgcacacactctctctattctgatactcactcaccactcgacatctacaaaagaatacataaataaatacacaaaaaaacacaataaaaataaaacaaaatataatgaagaatcaattatataatataaaacaataaaacagccaacatgtcga

SEQ ID NO: 630781 - DNA, 734 bp, Homo sapiens
  misc_feature (478)..(478): n is a, c, g, or t
  misc_feature (489)..(489): n is a, c, g, or t
  misc_feature (503)..(503): n is a, c, g, or t
  misc_feature (521)..(521): n is a, c, g, or t
  misc_feature (727)..(727): n is a, c, g, or t
tagatagagtctcactctgtcgcccaagctgaagtgcagtggcgcgatctcggctcactgcagcctccgcctccggggttcaagcgattctcccacctcagcctccccagtagctgggattacaggcacacaccaccacgtgcagctaatttttgtatttttgtagagacagggttttgccatgttggctaggctggtcttgaactcctgacctcaggtgatccgcccgcctcggcctccctgctgggattacaggcatccaaagcgctggaattacaggcatgagccaccgcacccggccttatcagatgattaagtgaaccttcagtgggcgttgttttgtgggcccacacagaggttcagatttgcctgtcttcgagtgattggaatgtacacacaagagagtgtaattatggtgctggcagaagtattaacctatctggatgtcactgtcttcactctctgactaggctgcttncagggaatctntccacctcaatatntatgagatatctataatnttataacacactcttataggagcctcgggttccttatacacacttgatgacaccagctgttctggtggtcttccatcattggtgatagagccagagtctcactgtgttgcccaggctggccttgaactactgctcaggggatcttcccacctcagccacctgagtagctggggactatagtgcacaccactgtgcctggtcagttntctggtt

SEQ ID NO: 630782 - DNA, 165 bp, Homo sapiens
cgcagcaccgatgctgcagtcgactctaagtatccccacgtccgcattaaagtctaaccgccttagataaataccaagtttacactcacatgaacttactaaaataaatcgtcacaaggactcttccattcacgctgtacattaacaactatttgcacacagcgc

SEQ ID NO: 630783 - DNA, 179 bp, Homo sapiens
  misc_feature (134)..(134): n is a, c, g, or t
accggagtgacgcactggtctactggtctcctgcattcctcttcgcctaaggcgtggaatctataaagcaggcagagagatggcacacgaaacagatcatgccctcaaggctaagcccagctcactcagcctgngtccacaagcgaaggtctctgtgaacctcctattcttctgccact

SEQ ID NO: 630784 - DNA, 109 bp, Homo sapiens
aagtacccacctggcagcatctcaaacccctaggaaggtgaggggctgatggaccacagagcatagggctacagcgagtggtagagagcgagcggcgtgagcgagtgtg

SEQ ID NO: 630785 - DNA, 123 bp, Homo sapiens
ttaggacgtgtcggacacgggacgacggacctgtcggactacgggacgacggactgaccggacgacgggacgacggactgctcggacgacgggacgacggactgatcggacgacgggacgacg

SEQ ID NO: 630786 - DNA, 120 bp, Homo sapiens
caccagatgctcccaccatctttcgggtcctaacacgtgcgctcgtgctccacctccccggcgcggtgggagcatctggtgtcgtgctccacctccccggcgcggtgggagcatctggtg

SEQ ID NO: 630787 - DNA, 415 bp, Homo sapiens
gttaagctcgatgctccacatttgagagtgtcctccaccatactcgtggtcttcaaagtcacggtgtctatcacatttggtcttaacgattcttcagtgttacaagtgagttggaccgctttcaacagctgtttgcattctcatcatttgtgtcaagcttgacgtaggatgtagtccaaagcactgtagatctgagtctaccgggtatgataagtaggctgtaaatctccaatcccacaggtacttgggcacataatcaccgagtcattcatgtactacgcaacagttgtctctggtagctccatatgctgcacatggtatagagagctatcatagagcatggaagtagagatttgcatgctgggcggtcaatgagctgcgcgtcatgtgtgagtgctcagatctgcgagctccg

SEQ ID NO: 630788 - DNA, 524 bp, Homo sapiens
gggatcccctggccaggtctctacctggccagctctctacctcatacagaggggatcagaatagggaatggtggcctgttcatcgtgggtaggtagtagtcatagaccttgagggtggctgggtttcaaggtgggtgaccagcacacttgggctggagggtgaatgtggtaagtctggagtgttcttaatggagctcatccaagtaaaggtgaagttggtgtcagttccaaattcaaccttcttcaccagggggtggctgggagaagtaacggatgggtgccctccaggggacggaacccagatagcatcttcacttccacaatagccatatgggaagagctacgggtccccacatagggggggtgactagtgagagtcacggatcgaggtgaagtgggtggctcacatctagcttttcctatttccacactaagagtaagggtcttcatatgggggggagggagaatattgtatctcaagacggggtggaaaatagacacaggccgtggagtgaggcctccaa

SEQ ID NO: 630789 - DNA, 554 bp, Homo sapiens
gctgcctccatccgaagctctgctgtgcccagtcccctgtggacaagtactataccctcagtggaagcaagctttggatcagtaatgggggcctatcagactatcttcacggtctttgccaatgtacactctatggttacagatccagccacaaggcagtccgtgacatcgcagaagaatcacagtgtctgttgtgggtgtgacgagggggtctgtcaggggtgcatttatcgcgcaattggtgccccgcttggaaagaagaatgggctatcaatggctttcgtaacacaagtcaagagagtgtgctttgaatggacgtacaggaggtgccatcggacgaagctggtgctcgaggtgacgtggtagcggaggtcgtgcattccacggtttgacattgcccaatcctcaatacacctggaatggtcccgggccatcgggcctgcgataccccgtgcgaccaagcattacacatagcaggagcgcaccatgcagttaatcgtcaagagagcggagtgagaagttcgattggcgcgaacttaaaatttcggtgaagc

SEQ ID NO: 630790 - DNA, 375 bp, Homo sapiens
caacgcacaacgtatctgagggtaaggacagctgataggagaaataacaagggcaattcacagagaagaaaggaacagaagtagatttcagattaagaaggaggtaagcccggagtagtggctcatgcctgtaatccggcactttgggaggccgaggcaggtggatcacctgagctcaggagttcgagaccggcctgggcaacatagtgagacctcgtctcagcaaaaaaatgcaaaaattagctgggcgtggttgcatgcacctgtggtcccagccgctcgggaggctgaggtgggaggatctcttgagtccaggaggtcgaggctgcagtgagctgtagttgtgtcactgcactccagcctgggtgaggggga

SEQ ID NO: 630791 - DNA, 1234 bp, Homo sapiens
  misc_feature (670)..(670): n is a, c, g, or t
tacaatgtcagaaaatgtatttgggctttttttttctttttaaaataagtgcattacaaattacagcttagaaagcatttctcgtgatttgtgccaaggtgcctctaaaaaagcagcgcaagttcacagcctacatagaacgggtaacgtggtcaccaggattaattaaagcacaaagatatgtgctaatacacgttacacaaagagaaaaaaaagtgtctttataagtgtcacatcaccttttgtggtcgtacaaaaaaatattatagaaaaccacaagtgtttattcaaaaaaatatcaaatatttatccgagcctagtgtttttatgaagagtcttaaatattctcccctgtgttcttggggtataattattattattattagtgggagaattattattatcacaatctcagagcgaggttttaaattaagagcggtaaactcaagtgggggttttctcgtgaaacacgcggaaaagagttccacgagagatgtcctctctctctcatgtgtttctcactttctccacaattctctccgagcaagaggaagtgtggtgtgcaaattctccccctttgtgctattaaagaggccccgaggggggccacccttgtgggagcccccaacaaagagaggggccattttttcgtccccgcgagcgtgggggncacactatatagagacctctcttccccactattaggctctccccgtgggctgtgtttagtaaattgcctttgtggtctgggacgccaaggggggaaaagaccagagacacctttgtttgccaaaaggcggggaacagcggcatgacgggcgaccaaccttgtcactcccaaaaaaaggcggggggttgatccccttcccaaaggcccggctctcgggtgtggacacagcacgtgggtgttgccactgccacaaaagcgcggggggggaccaccttgtgggttggtcgcaccaacacaagagaaaagttcccccgggaaacagcgtactggggccaacggggtggtctaacacacgatggggcactcccaaggaaccccaccatcccatgatgatgtagggaccctgtcgacctccccgtggtgggcccccccacaaaacgttcacttgtgggggcgtcccccagacagcaactatctatcgcggtgtcaaactaacaagcacacgcgagaaaaaatgaggacgcaacagggatgtaggagcagaaaatcacacccacagggtag

SEQ ID NO: 630792 - DNA, 417 bp, Homo sapiens
gagagagagagagagagagagcgagagagcgatagtgtcagcgatagagactttgaggggagcacagctggagaacctggtctaaatcttctcatccttctagaggatatacattcgaagacaggtgctagactgtttactttatgaggatcacttcttgctcttctatagctgtggagctccctatcacatagtatggcacctgtaccagcagcctactttatcagttgaatgacatactgcttttcagagaggctactgtgtcgaagattgtcgcactccttaacgagatgagcggtactggatgttcactagagcttataccaactggatgagcgtggcatgtatcctgctgatcatgcatgtgagttcagacacttatagcgctgtgcatgatcctcatagtactcaggttgt

SEQ ID NO: 630793 - DNA, 362 bp, Homo sapiens
gggctgcaggattcgcacgagggtcccttcactataacctacatttttgtgacactaagtttttccccattccaggacaggtcaggccctttaaaaatttcaacagctttattgagatataattgatataattcaatcctgcacatgtgtcatgctggagccctattgatttcaacagggatggcgccttgtccaagaagagacccagagccagtgaatgggacatagggtttattttagacttatatacagatgtggtccactggcagtgggctggacaggaccgctactatttgggaggatgtaggttatataacatttctacttagcactctccacttagcaacctccatttaaccctt

SEQ ID NO: 630794 - DNA, 231 bp, Homo sapiens
ctcctgccggctgcaggtcacgtctaatgcccgtcatcaacgaggggcaggaacattatagttgttgctgcctgttttcagccaatcgtcgagggatatctctcatgttctgttgaaaccttaggggaaaaccgctcacataatgtgctttaaaatgacaaaagtcattcgtacgcttaccacacctcctagaaacctgggcttacccagccagggaccccgatgtctttg

SEQ ID NO: 630795 - DNA, 477 bp, Homo sapiens
ataggtttaggtaaaattaactatatttaataggctttcatcactgcaaaactttttttcctttctttctctgtgtctctagtctcttccatttgttctcccttctttactagcaccgaggatttgcttgaaatctctgatagccagtattctcatttatcatattctttctcactttgtgtttccttggtaattttggataactcctttaatttatcttccaaattactggtttttatattctgtactgtcagtcctcctgttcactaatttcaaaatttatagttgtttctcttgtttacttatatagttgtttctcttgtttacttaataacattctcttctttcctatcagtttaattttataaaggctaaccaattaactgtttttaacttctatttccagatatgattttaaaaattaaagcaaaatgtgtataaactttattactgcttcccacagtaaatatttttcag

SEQ ID NO: 630796 - DNA, 1031 bp, Homo sapiens
ctctcaggacgagctgctgtggtcacattcctgcagtctgtgcaggtacccgaattcagccccaagtctggggtcgagatccatgtttctgacctggagctgcagagcgccaatgcctctgttgatgacagtccgtctagaggagctcatagccactctgccgcgatgcccagactagctccctggattcaagatgtaccccagttgactatcgacgaaggatgatgacaggcatacttatcatatggatttcatcgtggcatgcagtccaacgctcaccggtgacagaaaatctatgacattccttctgcgggaccggggcaagagctaagctgattgcatggggaagatcatcccatctcattgaagctacgaaactacagcagtccgtgtgttggccttgtggtgtctgggagctgtaacatacgttgtgcttggggcgccgaacagccttgtactcctgcaagaatggtttcctccatattgtgcaccctgccctttcttatggttatctctgaaccccctggccgtattcacagtcacccagtactataagcaagagtggacatgtgggatcggtttgaggtacaagggctgtagcctaatggtgaggaagatgacccgtcaaacagttcctcgactatttaagacagaggcacaaattagagatcacatgctgtccagggcgggtcatgctctatttctttttcaagccagtgcagcctcaggaacggtgcatcagccggtgacagagatgtgagccggtgtcgaacgacgctgggcgcacgtgtgggcgctgggctggaactgtgctgtacgacacaccggaggatttaaggtccttgtcgattggcactcgggacccgctgtctctaaggggctttggccctttacgcattacaggcctggagtgtgtgggggcacaaatgggtgtgcataaccgagccttctggtgtgtgaggcacgacaacaaaagcggcatagcaccataagtatatagatacacaagagctacaagcgatgtattcagg

SEQ ID NO: 630797 - DNA, 1392 bp, Homo sapiens
  misc_feature (808)..(808): n is a, c, g, or t
ttcggtaagccttcttccttcccagctccttaataaaagcaaagtgattgagtaggtaatgttcaaagtgtctgcctgtgtacatgtacttgtatggattatgtagttcagtaagatgtgcccaagtcatttcagaaagaaagacccttcagttttgatgcatttagctgaacacttgggtagtgagtgggatcctatccagttgaggaatgcttgcaatgctcattgaagggattcgcttcgggacttgtcatcttccagaaaaggaaacatattgtatatttggcccagtgtgattgattgctttatcttcggtaactttgacttgaatgggatttgctcgcattacgtgactatcgaatttaaaactacttatgagtcgacaactaaaatacacaggttcagcgtaatgtctgagcttatgtgtcgagctaacaccaggttactcagtaaccatgacctcgtcctccattccactcatctcaacattaacatagtctacatctgtcgtgccagaaatgcacttgtggcaaggtatagtcctggggtatgaaaggcttctggggcaggaactctggatagggccctacatatgggtctcggtggaatctggttacggggcacaccaggatacaatattacgtcctggtttgccacaattcacctgatgtgtccgcagatcttatcaaccttgcacctggcctgagcggaacccacacggaatacggacgtaaatgccaagagcatgtgcaaaccaccccatcttcagtcattcctcttcagtttcgttctgctgtcttttttttcntcctccaacgaccacattgcaccatagaaggacgataatcaactcacacacgcatcccccactacatcacataacatagtcaagcccaactacatcacccacataccacccaccagactgacgacgcacacccaccaaccacaacactaaccacaccacaactctaccgcacaccctaacgatcagcactactaccccccctaacgacacgtcacacacaaggcagcagacgagcagcagacgcgcgacaagcgagcagcgcgaagcagagcacagcaagagacaagagataagcgacgaaaaagagagggagcaagcgcaaagacaacgacaaaagaagcaagcacaaacgaggaggatggaagcaacaagagaggcgacaaggtgcgaggagcacacacacaaaaggagctgagagacaacagaggaaggggaccagcaacgaaaaaagtggaagacgctgtagcacagcacagacagggagaggacagcgggagcaacacggacgaagcgcacagaacacaggacaagcaagcccagaaggaacgaacaccaacccagcaacagcagaggaaaagacggcg

SEQ ID NO: 630798 - DNA, 201 bp, Homo sapiens
  misc_feature (130)..(130): n is a, c, g, or t
  misc_feature (134)..(134): n is a, c, g, or t
  misc_feature (166)..(166): n is a, c, g, or t
  misc_feature (171)..(171): n is a, c, g, or t
  misc_feature (197)..(197): n is a, c, g, or t
tggccaccatggcggccccatctctactaaaaatacagaaattagctgggcgtggtggcatgcgcctataatcccagctacttgggaggctgagctggagagtcatttgagcccaagagatggaggttgnagtnagcagagatcatgccattgcactccagcctgngcaanaagtatgaaacatcctacaaggggtntgaa

SEQ ID NO: 630799 - DNA, 845 bp, Homo sapiens
ggccaccggggtgctctggtctcgtggggcccctcctccgccccgtcgtcctgactctctctccctcctttcctcagtaggatgtccggcttccagtatcaagctcaatccacgtctcagaggagccagctcggctgtcatcaagggtcctcgagtggattagttctatctttgcttttgccagctgtgggaggtttctaagggccaatagcagagagttcaagtgagatgtcctcctgctgttactgagaatagaatggttacagctactttggttatccattcaggtggaattgaggcatcgtttcagccacctccaaggtggtaataccactagtgtggactgtagatactcggaaacgatgagcgtctcctcataggcgatttactcttcttctgcacaagtcctatgttaccttgggcagtctttgtgtgcctgttatctgcagttgatggcctgctgcttataatgtgggctacacgagtctgtatctggagtagtcgtagaagttcctatgatagactgtgtgttacactgtgtgggcacttttgtgttgtgggtgggtgagcacttgaggcgtgggctaatgggtctgactgagtttgaaatagtgactgttcacgatttttttgtttgaactttccgtcgttgttagaagaaaggggtactgtgttacttgtggtctggtgagcagtatgggatccgtaaatgatctgggaattgggttctagatttggaatctgggggggaaaggctggttggtgaagggacagttacgggagataatttggcttaacggggttgccttacagaaaataagggaaacgggggttttgggaagatg

SEQ ID NO: 630800 - DNA, 234 bp, Homo sapiens
  misc_feature (75)..(75): n is a, c, g, or t
  misc_feature (140)..(140): n is a, c, g, or t
tgctagttatgctaggcatggatggagtagctagatgtggccagagtagctgggtgtggctggaatagctgggtntggctggagtagctgggcatggctgcctactcgaatagctgagtgtggctggaatagctgggttnggttggagtagctggacatggctggaatatctgggtgtggctagagtagctaggtatacatggagtagctgggcatgactggagtagttaggtt

SEQ ID NO: 630801 - DNA, 188 bp, Homo sapiens
gacggcttcaacggaactttagggcgagtgatacgagatgctggtgcagcctgagtctagactccggggacgatgcaagaggaggggcccattgtgctgggatgacgacaagaaagctttggcggaagaaccgtcagtgttagatttcagaccctagagtttcgttattcacttgatgaagcgatggg

SEQ ID NO: 630802 - DNA, 101 bp, Homo sapiens
taaactctacaaagaagttctgccactatattccaagaatgtggttccataagcaaagtcggtttgaaaaattgattaaggctgggtgcagtggctcagtg

SEQ ID NO: 630803 - DNA, 672 bp, Homo sapiens
agtggccattactgccggggttattatgaatatatattctaatttgcttgattccttttctcaacgtatttttatttattttatttttttttagatggagtctcgccctgccgcccaggctggtctcgaactcctgacgtcaggtgatccacctgcctcagctagttgggaggctgaggtgggagacttgcttcaacgtaggaggcagaggttgcagtaaaccgagatcgcgccactgcaccactgcactccagcctgggggacagagtgagatcctgtctcaaaaaaaaaaaacccattattttttttcttttgatattgaattgtcgggcacaggggctcacgccgtgtaattcccaacactttgggaagggctcaaggcgggggggactcaccgtgaggctcaggagttcggaaaacagtctgggccaatcttgacgaaaccccgtctctactaaaatatacaaaattttagccagacttggtgggcccgtgcttgtagtccccagctaactggggaggctgaggcaggagaatcgattgaccccgggaggcggaggttgcagtgagccaagatcacgccttggcactccagcctgggtgacagagcgagactctgtctcaaaaacaaaacaaaacacatttgtacttcacaaaccctcagggggggaa

SEQ ID NO: 630804 - DNA, 335 bp, Homo sapiens
cgaaacaccatctccctctactgtccagggtagagtgcaccggcacattcatagcaaccttcgaacttctgggctcaggtgatcctcctgactcagcctcctgagtatttgggactatagtcatgagcgtcttttcatatttattactcaaaaaggtttcaattgcttatttagctttctgagtctgtgcttgtgccttcaacactttcacaacgattttctgctcctcgataaggaaaggacgcttggtcctgctcactcatttacaccaagcacccaactatctattaacctagccatgggcatcccccttatgagcgggcgcaggattatag

SEQ ID NO: 630805 - DNA, 368 bp, Homo sapiens
  misc_feature (4)..(4): n is a, c, g, or t
  misc_feature (84)..(84): n is a, c, g, or t
  misc_feature (94)..(94): n is a, c, g, or t
  misc_feature (109)..(109): n is a, c, g, or t
  misc_feature (112)..(112): n is a, c, g, or t
  misc_feature (119)..(119): n is a, c, g, or t
  misc_feature (122)..(122): n is a, c, g, or t
  misc_feature (133)..(133): n is a, c, g, or t
  misc_feature (147)..(147): n is a, c, g, or t
  misc_feature (153)..(153): n is a, c, g, or t
  misc_feature (204)..(205): n is a, c, g, or t
  misc_feature (238)..(238): n is a, c, g, or t
  misc_feature (260)..(260): n is a, c, g, or t
  misc_feature (291)..(291): n is a, c, g, or t
  misc_feature (302)..(302): n is a, c, g, or t
  misc_feature (360)..(360): n is a, c, g, or t
agcngccagaatctttgtggattatagatgcaaagtagttaggagtccttggacccacacttaagttacagacagaaaaataanatgaaaaaanaaaaaaaaaaaaaancanaacaaanttnacacaaatagnaaacaaaaaatttnacaaancaaaacaatacaccaataacacaactaaccaaacaaacaaaaacactacannacctaccaactaggaaaacggaaagaaccaagnaaaaaaccaaaaaaagaccacnacccacaaataataaataataaaccaaacanaaaaaaaaaangaaaacaaaccaccaaaaaaaaaaagaccaaacacaccaccaaaaaaacccccaccanaaaaacaa

SEQ ID NO: 630806 - DNA, 1263 bp, Homo sapiens
cgtgacgcgtgtgtcgacccacgcgtcggtgtacggcttccggctggcgtggacgcggtgccgtgcacgcgggaaaagcttccccggtgttccgacgctcgctacgtttgttataactagcatccgctaagaacagtggacataatccttacagagctggctgagtgaggcgaactggttcagcactaaagaaaaggcgcgagcatgacctcaggcatgaggaaccgatgctacgtgaaacgtcatcaagcaaacggtcactgtccaagacagctggaacactccattatccagcacagaatgttcgatgtcaactgtaaggacgaagaatggaactgactcctctaatgcatgcagcactataaacggacgacactcgatatgtgccaaattactactgcgacactggagaccgagtgtcacatagacatacagcatgaacactggatacacagcaccatcatgtaagcatgcactaactggctaataaagacatcaccatgggctaaatgttagaagcgtggtggctgagacacgactgatcgatcagatctgatgggaagaacagcagcatccacatggcagccattagcgggtcaacatgaatagtgtagaccaataatcgaccaactacatttcctcgagagagacctgcataatgacacataagccccagagacataggaataaagagccaaagacatgccccaaagatggaggcaccggtgaacacaaattctcaacacaaacgaaattatacacctggaaacagatccggcaaggcagggaaaaagaagaacatcacagatgcgagagagaacagagccatgaataaatggcccaccagtaataggacaaaaaatacgccagaaataaagcaacacaacaaagacacgacaaagacgcggaacactcataagacatgcagcagagacgacacagagaaacgcctcaaggcgacgaggaagaaaacaagagagacaggaagcgagcgaagtataagtgagtggcaacagacgacaagcacaagaggacacgagcaaaaaacagagacaagacagaaagagaaaagggactccatgtgcaggagaaacaccgaagaaggcgagacaaagagagagcgacgactaagcagacagaggagagaggaagagcacagagacaccaaacatcgactaaagaagagaccgccagatactccggcgacaacaaatgagtgagtcgccgaccgcatataggctagcaacgaagcaagaaagaacg

SEQ ID NO: 630807 - DNA, 124 bp, Homo sapiens
atgtgcagttaaaggttgagaaagaaagaataattttagaatcaactccagtttcaaggtgcaacattataccctgattttaaaggatgcccctcagggggaagttggtacctgagctcgaatt

SEQ ID NO: 630808 - DNA, 114 bp, Homo sapiens
agcggaggagctccgtgacggctgcagcgcgggcgggagcggggacgcgatgtagccgccgacgagctccttgcgggccggggctggcgcctccggggtctgagccgtcgtcca

SEQ ID NO: 630809 - DNA, 648 bp, Homo sapiens
  misc_feature (21)..(21): n is a, c, g, or t
  misc_feature (71)..(71): n is a, c, g, or t
  misc_feature (102)..(102): n is a, c, g, or t
  misc_feature (112)..(112): n is a, c, g, or t
  misc_feature (117)..(117): n is a, c, g, or t
  misc_feature (119)..(121): n is a, c, g, or t
  misc_feature (129)..(129): n is a, c, g, or t
  misc_feature (132)..(132): n is a, c, g, or t
  misc_feature (134)..(134): n is a, c, g, or t
  misc_feature (138)..(138): n is a, c, g, or t
  misc_feature (141)..(141): n is a, c, g, or t
  misc_feature (145)..(145): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (183)..(184): n is a, c, g, or t
  misc_feature (189)..(189): n is a, c, g, or t
  misc_feature (191)..(192): n is a, c, g, or t
  misc_feature (202)..(202): n is a, c, g, or t
  misc_feature (213)..(213): n is a, c, g, or t
  misc_feature (215)..(216): n is a, c, g, or t
  misc_feature (219)..(220): n is a, c, g, or t
  misc_feature (222)..(222): n is a, c, g, or t
  misc_feature (224)..(224): n is a, c, g, or t
  misc_feature (233)..(235): n is a, c, g, or t
  misc_feature (241)..(242): n is a, c, g, or t
  misc_feature (244)..(244): n is a, c, g, or t
  misc_feature (246)..(247): n is a, c, g, or t
  misc_feature (250)..(250): n is a, c, g, or t
  misc_feature (254)..(254): n is a, c, g, or t
  misc_feature (257)..(258): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (285)..(286): n is a, c, g, or t
  misc_feature (288)..(289): n is a, c, g, or t
  misc_feature (295)..(295): n is a, c, g, or t
  misc_feature (305)..(305): n is a, c, g, or t
  misc_feature (308)..(308): n is a, c, g, or t
  misc_feature (314)..(314): n is a, c, g, or t
  misc_feature (317)..(317): n is a, c, g, or t
  misc_feature (330)..(330): n is a, c, g, or t
  misc_feature (394)..(394): n is a, c, g, or t
  misc_feature (442)..(442): n is a, c, g, or t
  misc_feature (451)..(451): n is a, c, g, or t
  misc_feature (503)..(503): n is a, c, g, or t
  misc_feature (516)..(516): n is a, c, g, or t
  misc_feature (548)..(548): n is a, c, g, or t
  misc_feature (563)..(563): n is a, c, g, or t
  misc_feature (566)..(566): n is a, c, g, or t
  misc_feature (639)..(639): n is a, c, g, or t
aaaaccagtaaaacgtcaggnctggagctgtaataagacagagacaggagcagctcacacgtggcctaggnggggaggacgaggccataaatactgcaggangaagcaaggnagccnannncgaggcgnaancngggngtngggngcaaganggcacgggngntaaagggacaggagggaagnngggcngnngggacctggnacagacaccangnnggnngngnttggtttgnnngggtgnngnannganaccnccnngtngncnangaacangagggnctctanntnnggggtngggtcctggnacngctggnacncggacaccaggtngttcatgttgctctcggcctcggtgaactccatctcgtccatgccctcgcccgtgtaccagtgnaggaagggcttgcgccggaacatgggggtgaactgctcggagatgggnttgaacagntcctggatggccgtgctgttcccgatgaaggtggaggacatcttgagggcgnggggggggatgtnacacacggccaccttcacgttgttggggatanactccacgaagtagntgntgttcttgctctggatggccagcatctgctcgtccacctccttcatggacatgcggccccggaacacggtggncacgtcagt

SEQ ID NO: 630810 - DNA, 134 bp, Homo sapiens
cccagggtcaggactatctgtcgtgcaagaacggacgctaagaaagtggtgaatcccctgtttgagaaaaggcctaagagttttggcattggacaggacatccagtcccataagagagacctcacccgcttctg

SEQ ID NO: 630811 - DNA, 418 bp, Homo sapiens
tatcagccggtccggcatactggacttctaccatgattgtaagtttcctgaggcctcctcagctacgtggaactgtgagtcaattaaacttcttttcttttattttatttatttatttagggacagtgtctcgctctgtcacctaggctggagtgcaatggcgtgatcttggctcacttcaatctctacctcctggattcaagcaattctcctgcctcagcctccaaagtagctgggattacaggcatgtaccaccactccggctaatttttgtgtttttaatggagacagggttttaccgtgttggccgggctggtctcgaactcctgacctcagacgatccatctgccttggcctcccaaagtgctgggcttacaggtatgagccaccatacttggcataagaaggtccaggtatg

SEQ ID NO: 630812 - DNA, 160 bp, Homo sapiens
gaagccttataggtagaggcgacaaacctaccgagcctgtgatagctgtctgtccaagatagagtcgtagttcaactttaactttgcccacagaaccctctaactcccctttaaatttaactgttagtccaaagaggaacactctttgacactaggaaaa

SEQ ID NO: 630813 - DNA, 733 bp, Homo sapiens
tggctggtaggcccggggggttgctggccgaatggggcaagttcatgaaaccggggaagggggtgctggtccgggtctgggacgctactcccggacgcaaagtctgtctatcgtgaaaaactattgtatgtatgggccacctcagatcgcccctacagccatgctcgggtggctgggaattggaccgctacccccgcaaagtgacagctgcctaaggggcaagaagaagatcgccaagagatcaaagataaaatctttggtgaaagtgtataactacaatcacctaatgcccacaaggtactcgtggggattacctccccttgggacaaaacgtggtcgtcaatagggatgtctctcagagactccgtgctctataaacgcaaggcccgagcgggaggccaaggttcaagttttgaagagagatacaagacaggcaagaccaaggtggttctcccagaaacgggggtttaagcatgcttggtttggatcctattaacatatttttataaacgaagaaaaagcatacaaaaacaaaaacaaaaaaaaaaatcgcgccggggtctattatgtgcgcgggggggcgaaaacagaggtgtatcagtaagaggcactggggactacatgttgtgtctcagaccccagttttcgtgtgcaacgggggggataagaggggcccccaaagggaggcagtaaaatgcaaaaccgggactgaaagagactgacaggaaaatca

SEQ ID NO: 630814 - DNA, 291 bp, Homo sapiens
aacatatccagcttgtctaacacatcacagattattagttacaaggtgtagattaatgagcttatattgtattcctggatcttttgagttaataccaatggtaccttgtccagaggcctatcatcattcctagtaggtggccacagagtaagagatattaagaagctccctgatgagtcatcatctagcgaggccctgtgtaggctttattataggagtacattgacttctggggcatcaaaggctccctctatcatatctctgtcattgctctcagcacgacacacactt

SEQ ID NO: 630815 - DNA, 781 bp, Homo sapiens
cgcacgcagcgcgagaacgaactacggtaggtacgaggctgcgtttacgcttgtgtccctctttctagctgtcgcgcacgagtcccgacgggccgctccacgcctcgacatgtcgtacaactacgtggtaactggcccagaagcccaccgccgtgaacggctgcgtgacctggacacttaacttcggccgaagacttacacctgttgatttgccaaaaacacgagattagagatctatgtgtgtcaccgcctgagtgggcttctggcccgtcaaagaggtgggcatgtatgggaagattgctggtcatggagcttaaacagtgcccaatggtggtgagagcaatggacctgctgtttatcttgacagcgaagtacaatagcctgacatcctggagtataaacagagtggcgagagcatagacatcattacgcgagcccatggcaatgtaccaggaccgcattggacgcccctcagagaccggcataattggcatcattgaccctgagatgccggatgattggcctgcgtctactatgatgggcttttcaaggttataaccagctaggatcgcgcataataaagaagtcacggccttcaacatcctgcctggcagggatctgcatgtccatagaatgccgagttcctatatggtttgccaagcacctactatactggttatgctaccaggaccctcagggcggcgcgtaaaaacctatgaggtgtctaccgagagacggactccatcagggccttggaaccgtacatttcaatctaggctac

SEQ ID NO: 630816 - DNA, 782 bp, Homo sapiens
  misc_feature (207)..(207): n is a, c, g, or t
  misc_feature (296)..(296): n is a, c, g, or t
  misc_feature (374)..(374): n is a, c, g, or t
  misc_feature (608)..(608): n is a, c, g, or t
  misc_feature (665)..(666): n is a, c, g, or t
  misc_feature (689)..(689): n is a, c, g, or t
  misc_feature (695)..(695): n is a, c, g, or t
  misc_feature (735)..(735): n is a, c, g, or t
  misc_feature (742)..(742): n is a, c, g, or t
  misc_feature (751)..(751): n is a, c, g, or t
  misc_feature (761)..(761): n is a, c, g, or t
ccccggagagcgacccctcccccggccctcgggcccgggggagggattgggcgtttcatcacaaccacattcttgcccaggaccaaatagaccccagccgctttggtcaaaaagtgggacttggacgtgaggagtgtccttccgtcagaagagttgagccaggttcgagtgcacggagcgtcccttccatcaggagaggtgcagagnccaagccgtttttgcccaagaaggagaaaatgaagctgaggcgtgagcaatggttgcagaaaatcgaagccataaatctggttgagcanaagcacagggaggaccgaaggcgaagggccccggtggtggtgggggacctgcaccctctcaggaatgccctgcccaanttgttggggtttaaggttggcagcgggggccaagcccccagcagggaaagcaacaagccccggccctcaaagttcagccggatgagcgcagcccaaagacagcagtttttcgaggaaaaaaggacccggtttcaggagttgttggccagtccggcctacagagcaagcccccctggtggccattgggcaaacgttggcccggcaaatgcagttggaaaatggcggccagttttnaccagggcagggggcatgccccaactcctcaggacacatgtgggccaagtaaaaagnnccggcccctcaaggaccatggcntgagcntggtggacgcccttccctttggtcggttgtggggctcaanaaatggntttgtgaanttcccctgcnctgccagggccgttcccatga

SEQ ID NO: 630817 - DNA, 793 bp, Homo sapiens
  misc_feature (11)..(11): n is a, c, g, or t
  misc_feature (68)..(68): n is a, c, g, or t
  misc_feature (70)..(70): n is a, c, g, or t
  misc_feature (98)..(99): n is a, c, g, or t
  misc_feature (107)..(107): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (126)..(126): n is a, c, g, or t
  misc_feature (138)..(138): n is a, c, g, or t
  misc_feature (141)..(141): n is a, c, g, or t
  misc_feature (219)..(219): n is a, c, g, or t
  misc_feature (239)..(239): n is a, c, g, or t
  misc_feature (248)..(249): n is a, c, g, or t
  misc_feature (268)..(268): n is a, c, g, or t
  misc_feature (279)..(279): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (296)..(296): n is a, c, g, or t
  misc_feature (300)..(300): n is a, c, g, or t
  misc_feature (304)..(304): n is a, c, g, or t
  misc_feature (308)..(308): n is a, c, g, or t
  misc_feature (324)..(325): n is a, c, g, or t
  misc_feature (329)..(329): n is a, c, g, or t
  misc_feature (333)..(333): n is a, c, g, or t
  misc_feature (340)..(340): n is a, c, g, or t
  misc_feature (342)..(342): n is a, c, g, or t
  misc_feature (347)..(347): n is a, c, g, or t
  misc_feature (368)..(368): n is a, c, g, or t
  misc_feature (371)..(371): n is a, c, g, or t
  misc_feature (407)..(407): n is a, c, g, or t
  misc_feature (449)..(449): n is a, c, g, or t
  misc_feature (455)..(455): n is a, c, g, or t
  misc_feature (470)..(470): n is a, c, g, or t
  misc_feature (509)..(509): n is a, c, g, or t
  misc_feature (525)..(525): n is a, c, g, or t
  misc_feature (527)..(527): n is a, c, g, or t
  misc_feature (600)..(600): n is a, c, g, or t
  misc_feature (779)..(779): n is a, c, g, or t
ccattaaaaantactgtttttaaaaactaataacttaaaactgcctctcgctaataagaaaaccaaantngtccacaaaactttctcctttccttctnnaggttttncgttgcnttnttntctttnaccagtcttttnctnctaaacttatttggccatttgaaacaaacagttctgagaccgttcttccaccactgtttaagggtggggtggcaggtnttagggttttttttcttttngccttctgnnctttctgggctgtcttggngtccttgcctnctcctncngcnttnttntccnctgntttnttgtcacccaccgcgnntgtntgtntcttttntngttcngcaatgcgtcccaaaggtggntantctgagatgctctcaacacacatgggcttgccaggnaccttatcaacaatggcagcttcaccagtcttcaagattttngggccntcttccagctttttnccagaacggcgttcattcttttccttctgctctgcaaanttgcttgctttgtgtncngtgtggcaatccaatacaggggcatagccggcgcttatttggcctggttggttcaggttaatcacctgggcantgtagccagctgcttccattggtgggtcatttttgctgtcaccagcaacgttgccacgacgaacatccttggcagacacattcttgacattgaagcccacattgtccccaggaagagcttcactcaaagcttcatggtgcatttcgacagattttacttccgttgtaacgttgactggngcaaaggtgaccac

SEQ ID NO: 630818 - DNA, 92 bp, Homo sapiens
ccccccccccgtccccccccccccccaaacacagcatttgggttcttttaacctgggccccaggtgccccccaataaaatcctttgttgaga

SEQ ID NO: 630819 - DNA, 178 bp, Homo sapiens
  misc_feature (138)..(138): n is a, c, g, or t
ctcaccgtgggtggacactttcctccttaacagaactttgttccagccactgacccattctaactcttccccctctgactctcctgcgcagggtctgttcctggtttcccacgctgcataacaggaagacatatcccntcccctgtggcagcaacggctacaactgggacgggacggg

SEQ ID NO: 630820 - DNA, 962 bp, Homo sapiens
  misc_feature (590)..(590): n is a, c, g, or t
attgagtgttggtgaaccccagagtgggttataggggagaaatgggcaatagagcccaaattctttttggccacatagatgtaggcaacaaattattggggaaggattttgcattccagtcttccaatgtttaacaatggggggatataggatttataatatcctggggcgcgatgcgaatgccccccaagtttcccgacctcattaggattccttcttcggttcatgggattcgttcggggtccctatggagtttttttcagggctagaagtattcatgagaatgaaactgccgggcttatctgatgggttagagggccttttgagaaagaaaatccagggggataactcgggatattgctccccggtcaatagaagtttttaaaaggctgtgacccaatcctgctaataatggaaatagtgggaaaagaatagaagagcacgccagttcaaagagaataatctagtggagaaaaaccacggagagccgtattgaagctttggaactagaaatttctttcttggtgattaaaagaggaccacaagtgttattcaccacgagattttttgttgcctcgctggcctcattngctataaccacatagattgttgagtggcactattttcttgtttagtttttcattgaaaataatattgccataattctacacactataatatgccaataaaatggagttattgttttgacaaccctctcttaacactatttttggaagatgacactttctgagttttcagagaattaacatataaatccacgaagcacagagttccgtaaactcgagaacttctggaacacgttgaatcagctttaacctatggtggctttgcctttaaactagaggtgtgtgatggtagattatttcagataagtatgtaaaactgtttcctgaacaaataagatgtatgaacggagcagaaataaatactttttctaatta

SEQ ID NO: 630821 - DNA, 680 bp, Homo sapiens
ggcgaggcgaggcaatggcttttcggacccacggagcgacagagcgagcggccctacggccgtcggctggcctggcggcctgagatgtatcttgggaagaaggcggcagcccgcggcggctggcgtgctgcagcgtgcagcaacccgggacggagtgctggccctgggacagcatggctgtgctcctgaagaactgggtcttgagtgtgggcctgctgcagccaccgcgggtgcctagtcagggcccagcctgaggtctgggcctggttgtgctgtgtgtgggggatgcagcacagccctgaaagaaaatgagcctccctggtgggcctcgcacccccctgtgtgggccctggcgggaacctgccgggggtccaggaggggctcaggtgccaggccctactgtcgtgccatgggtctgcgaccccatggaaacctgaatagcagagactccggagggggcgtcggaccagaccggacgcaagcgggcgaaggtcagagtacagagatgatggattgaaagctttggtcgcaacctctacagaagatgagtcatcactctccgacagaaagagcagaaactgccaaaagacagcagaaaggaacaaagatagcttccgccccaaacaaccacacataaaagagccacagtgcagcacacaacatgaaagtgacgcctgaag

SEQ ID NO: 630822 - DNA, 312 bp, Homo sapiens
acaaaaaggggagtatgtggtatggtaccctgcagtcattattgcgcacaagccttatttacccttcctttttacaatttagatactaatttcagtccattgtagaagagcactttgctataacctctcaagacataaaactgcagttttttggaactatgtgaactgtactgtatcatgtggtccaaatgaattgttcacttggggaataggatatgcttgtgttcacacccgctcaggtcctctttggattccagcacgacgcctcaaatcattccatgacgtgactgggacccgacctatacatgctcg

SEQ ID NO: 630823 - DNA, 378 bp, Homo sapiens
atttacctaaatagattatggtgattttgttgaaccaatatttaataagcatctgtatccccagccctggcaatacaaagatgaataagcagagtttgctcataaatcagtcagaagttgctgtatgttttctagcatataattcattgtcttctcctcagtttttacctattagcattaaatctctgatttccaggaacaaagtttctgagttgccttcaaatgtattttaattttgaaactagaacaataatacatctagtcaagaagttataagatgatggttgaatataacaaaatattttggtgctagaactcagccttacactgttttgtatatatacaaataaattatgtccccaacctgaaaaaaaaaaa

SEQ ID NO: 630824 - DNA, 316 bp, Homo sapiens
aaccctaataacggacgtacaccacagctcacggcaacggtggatccttaacccactgagcgaggccagggaccgaacccgcaacctcatggttcctagttggattcgttaaccactgcaccacaacgggaactccttattttcacttttttaaactaaagaacatcacagtcgaattactcagcagttagtagccaaattcattaaactttacatcccttaacatttatttttaaagccatttttattaaactttggaactgtttgtatatatttttatacgtaattaggtttcgggatcctctagatcacctcg

SEQ ID NO: 630825 - DNA, 1200 bp, Homo sapiens
gcctgcggtccggacggacagtgcgtgccccgagctctccgactccccccgcccgccattgccgaggcagctcgatgcccaattcgcgtccccagtatgacatcgcctgagagcatgccccagatagccgagcgtccatcggcaccgtgagttgtgaaatactcccatacaatctgcacaagcctacatgtcaggaacagggatccatgctcaaggacaggctggccctagtcgtgcggcttatctacatggcacatctgtccgctccggtacttcggtgccagtctgtcctcgcctggtcaacaacagttctgtcaactatcacgcccagctgcattgtggtgcgttgcttctgggtgtagggctacacagcacccggctccacacgattctgcctccggtggaaattgcgagtcgtcgaacgactttgcgccgtgtcccctcataaattgttacgcgtagtatccttgtgcacctctacttgccttgcaaacgcagtaggtcgaaaattatcgactatgggcaatctattccgtaacccgaagcatctagctgggtagcgggccaccccggaccattccgaatagttaccaccatgtaccaccccaagaacatcgccaagaaactgcctcagttccctcgcttagaatagggctaaagcaaacggtgtccgacaagttcggtctccgcatcgaaccaaggacacattcgttcattgaagactgtggtctccccgagcctttccgggcgcttccccaaggttaccgtgcagccctcggttcttgttctcgcctttccccccatttcaccgcggcgttccggcccagcagctttttaggggaccgcccttttctcgtctcctcgaattaccaaccaccggcacaagacgcaactttttcacgtcttgggctcggcgggactaacttttaacccccccgggttacccccctgttttacctttcgtccttgtgccccaagaatattcctagccccttgggggacctttgggtagttgggcgcccacggggggtgcttgcggatttgcgtacctatgtaacctggcgctttacgtcccccttatgccccattttattacctcctttcgcccggcgtgttgattgcgcgatgtggcgatagacccccgtatgtggtggctactctccaaatgggaggggcgtttcatatgtcgatgtgtttcca

SEQ ID NO: 630826 - DNA, 205 bp, Homo sapiens
  misc_feature (13)..(13): n is a, c, g, or t
  misc_feature (20)..(20): n is a, c, g, or t
  misc_feature (23)..(23): n is a, c, g, or t
  misc_feature (47)..(47): n is a, c, g, or t
  misc_feature (60)..(60): n is a, c, g, or t
  misc_feature (75)..(75): n is a, c, g, or t
  misc_feature (82)..(82): n is a, c, g, or t
  misc_feature (88)..(88): n is a, c, g, or t
  misc_feature (101)..(101): n is a, c, g, or t
  misc_feature (136)..(136): n is a, c, g, or t
  misc_feature (138)..(138): n is a, c, g, or t
  misc_feature (162)..(162): n is a, c, g, or t
  misc_feature (166)..(167): n is a, c, g, or t
  misc_feature (171)..(172): n is a, c, g, or t
  misc_feature (188)..(188): n is a, c, g, or t
  misc_feature (200)..(200): n is a, c, g, or t
gttatcactaacntgttatnttnaagagatgttaaatatttatatgntttgttgactagntgaaatgtgcattcntgttagngttgantaaagaatctggnagttgcttaattgcggcaattaaacaatttatggntntattttgtaaaacaaactactggnaatnncttnntaatacctattttcantctgattacctnttttt

SEQ ID NO: 630827 - DNA, 275 bp, Homo sapiens
tgtgcctgctctggttcgccaatggcaggcgccctgcagtgcatcccctgtgatgcctacaccatgaaggagctcatagatgtgtgcccgtgatgagtctctgcagaaggtctcccactgtcctggtctgcgctccaggtctgttgatcctgtggcacccaggcctttcatcacagtcatccagcgctcgtgtctcggtatcatttgctgacctctgacaccaccaatcatgcttcgccagctgctggtcacggctcaactcgctgagtggtact

SEQ ID NO: 630828 - DNA, 468 bp, Homo sapiens
cagttcctctggaagaggaaaagcacagaccccatgaatagcccttttgcactcattgggtagagtcaatgaaaagctgctggtgagaaaacttttgaaaacacttcttggtcaggcacggtggctcacacctgtaatcccagcactttgggaggccgagctgggctgatcacttgaggtcaagctttccagaccagcctcaccaacatggtgaaaccccatctctactaaaactacaaaaattacctgggcgtggtggtggccgcctgtaatcccagctactcaggaggctgaggcaggagaatcacttgaacccaggaggtggaggttgcagtgaacccagatcatgccactgcactccagcctgggtgacaagagagactccatctcaagacaaacaaacaaacaaacaaacacacacaaacacttcttaatttagaaaacaacaagaacaccaaaaaaaaaaaa

SEQ ID NO: 630829 - DNA, 736 bp, Homo sapiens
agcggagtcctgttacacctcccgcggcgcgcacagcggcaacccgggcgtgcgggggcgcgccgccggtcaggaggggcctgcggaggcgcgaggcccccggaagcgccttcccggaaggcagggaggcaacgccggctccggaggcggcctgggcgatggcggcggagttctggccataacgtgcgcaacgcgcaagtaggaggatgcctcactcgggctgccggcatggcggagcagcgttgggggctgcagcgggcaccgggcccgcggggccgccgctgccgcccttacgtcctctctggggcccgtgcttccccttgccggcgggcactctctactcattggcaggcgcaacaagcgcgtccgttggacaggcccgcttcccctttcctctccacctcctgcccggcttggacctcaatcgtgccattccgatactgccgcaaaggggtcggcgacaccctgcccgcacgtttgcgtggcacagtgaccgatattcctcaacatacgacatacagtacattggggtgcccggagagcctgttcatattggacggcaatggttacaagcaccgcatttgaccagaatgttcagacggcagacatgcacactgcgcaatgtatgaagcccagagtcccactggcagccgcataagaatcctacattccccgattgacggtcacatgggcaccacaagacagggcattgaccacccttatcctcagccagaat

SEQ ID NO: 630830 - DNA, 1182 bp, Homo sapiens
  misc_feature (1)..(1): n is a, c, g, or t
  misc_feature (61)..(61): n is a, c, g, or t
  misc_feature (408)..(408): n is a, c, g, or t
  misc_feature (528)..(528): n is a, c, g, or t
  misc_feature (535)..(535): n is a, c, g, or t
  misc_feature (540)..(540): n is a, c, g, or t
  misc_feature (632)..(632): n is a, c, g, or t
  misc_feature (703)..(703): n is a, c, g, or t
  misc_feature (755)..(755): n is a, c, g, or t
  misc_feature (757)..(757): n is a, c, g, or t
  misc_feature (763)..(763): n is a, c, g, or t
  misc_feature (767)..(767): n is a, c, g, or t
  misc_feature (769)..(769): n is a, c, g, or t
  misc_feature (793)..(793): n is a, c, g, or t
  misc_feature (796)..(796): n is a, c, g, or t
  misc_feature (798)..(798): n is a, c, g, or t
  misc_feature (808)..(808): n is a, c, g, or t
  misc_feature (856)..(856): n is a, c, g, or t
  misc_feature (873)..(873): n is a, c, g, or t
  misc_feature (876)..(876): n is a, c, g, or t
  misc_feature (903)..(903): n is a, c, g, or t
  misc_feature (914)..(914): n is a, c, g, or t
  misc_feature (943)..(943): n is a, c, g, or t
  misc_feature (946)..(946): n is a, c, g, or t
  misc_feature (957)..(957): n is a, c, g, or t
  misc_feature (1006)..(1006): n is a, c, g, or t
  misc_feature (1031)..(1031): n is a, c, g, or t
  misc_feature (1063)..(1063): n is a, c, g, or t
  misc_feature (1065)..(1065): n is a, c, g, or t
  misc_feature (1069)..(1069): n is a, c, g, or t
  misc_feature (1078)..(1078): n is a, c, g, or t
  misc_feature (1080)..(1080): n is a, c, g, or t
  misc_feature (1085)..(1085): n is a, c, g, or t
  misc_feature (1090)..(1090): n is a, c, g, or t
  misc_feature (1098)..(1098): n is a, c, g, or t
  misc_feature (1102)..(1102): n is a, c, g, or t
  misc_feature (1106)..(1106): n is a, c, g, or t
  misc_feature (1147)..(1147): n is a, c, g, or t
ngagagagggaggacctccatgagtcctccaagggcagtgcctctgcaactgctgggggtncaggggaagcagggagtgcatggggctcctccagcaaagatgagcgccagggctgcgtggatgtgcccaccggtggcctgcagggccgcagctcagctcaacgtcctggatgcccatgtcacgtagctgcggcagcgggggctgccactggctctgaaggctgggctgcccagaggcctgaagggcatgcggtagggcttggctgaagagatcattggtgaagggcgttcctgaatggacaccagaggacaatggtgagggccctgaggaatgaccctgggtgccaggagttggtgtgtgagaacagcactccggagtgctggccagggccaaggcggtggccagcncactctgggtgaggggccggggcccagcagcgccactgttccccagggaggctgggcgggagcggggagtgctgctagagggtgtggacctggtgtttgggtgaaagttatcctcatcanctgagancactncaaacaggaagccacctggcatatcccggtatgagctggagggcatgctccgggaagaggagttagttccaggcattggggcactgcctgcnacggagtgcagaaccaggacaatggcatttacgagggccgggtgagccggcaccaacgtatcaagcatatngggatcagcgaagacagaaaagaggtccttgttctggagaaccccaagagcnanagggtnactncngaggcctggggtggccacaatganctnanccagaaactncttattgctgagcatcttaaagaccgccttcctgttagaggagccgcngtgcagggcagtgtgcnaanccgggaactctcttaagggagccactntgtccacaggntccggtttctgaacaggttcaggccaggnctntcgcagaacanggacagttgacccagggtgaatgccacacaaagttaagtgtcttggcancttttagcttccgaccacagttgancagaccaatcagcccagggtctggacagactncngggngtttgccancnataancgccncagaaatnaaanctanagccccccagcgagtttctcccagttctgtttttggaacgnagaataaactttggagtaattggtgggcaacaagc

SEQ ID NO: 630831 - DNA, 105 bp, Homo sapiens
gttcaaagcagtgccgctgtcgggttctgggtgtttgaccctcagcggtacgattccaaaacactgctacgtgtgtctaaagtgattgtttcccatcgacagtaa

SEQ ID NO: 630832 - DNA, 547 bp, Homo sapiens
tgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagagggctgagagattaccatacaagggtgattacaacatgtaaagacaatttaatctcttgtttcactgtgttctggtcaaataatgtgtgtaccaaaagagataaaatatataaagcagagaatggtattatctatccccatcttgaaaacaccctatagttatgtgacaatgtgcactcctgtacgaatagagcttaataatgatatattaaatacatcaga

SEQ ID NO: 630833 - DNA, 363 bp, Homo sapiens
  misc_feature (173)..(173): n is a, c, g, or t
  misc_feature (195)..(195): n is a, c, g, or t
  misc_feature (261)..(261): n is a, c, g, or t
  misc_feature (282)..(283): n is a, c, g, or t
  misc_feature (285)..(285): n is a, c, g, or t
  misc_feature (290)..(290): n is a, c, g, or t
  misc_feature (343)..(343): n is a, c, g, or t
tggccagtgtgggaccgggacgggaaggaagaaggaggctagagagcagggggaaaaggtgcacttggccagtgcgcctgccaggaatgagtccatgcgttgtctgccaacccctaccacagtgtttgtgccttcagctgagggggcacctatgggccctgaaccctgctggngctccacgaccctgagagaagnggtgagaagaatcatctctgcacctcgggtctctgccagaggaagacttaagcatccctgcgaccncacattctagacagagatganntncaggnttggcccatgctacaaacacaaaatttgcaatagaaaagataagaccaaaaantcataagaaaagcaaaaaaa

SEQ ID NO: 630834 - DNA, 722 bp, Homo sapiens
  misc_feature (258)..(258): n is a, c, g, or t
  misc_feature (261)..(261): n is a, c, g, or t
  misc_feature (271)..(271): n is a, c, g, or t
  misc_feature (274)..(274): n is a, c, g, or t
gtggaagtgcccggaaattggtatgcaaggtaatggccctttccctccacttcttcctggctgggcggcaagcacggccagtacaggaacggctccaggtttctgacttggaggcacaggctttaggacaaggaaaagctggaaaaggaactgtccccaaagggtcgggagtgtttgaccctgctctctcagcggctgggctctcaaaagtttttctttggagaagcccccgcctccttggaagcctttgttttcagntanttggccctgntgntgcaggcaaaactgcccagtgggaaactgcaggtccccctgggtggggtgcacaacctttgtgcctattgtacccacattttcagtttttaattcccctgggatggaggtgagggacccccgcaacgccaaacaccagcaggcccaaagatttaggaggagccataccggggccggaaccaaatcctatttgtgttggcaggaatggcaaccatggtggggtaccccttgctcaacggcattgtttccatccaaggggcaaagcctggttgggccccaggcacccggaccctggggatgggttaggaggattaaaaggaattatttgtcctcccgctcccaaaaatggtttttttatttttatgcatttcaaaggcccccgggcctccttgttgttgggacaaccggacacggggggttgccccccaaaataaaacccctccccctta

SEQ ID NO: 630835 - DNA, 248 bp, Homo sapiens
tctaagcgacttatatccttcagatactctttaagtgtagtgagtattctaatgtctccagagtgtgagtacgacatatgatcattgtcaatccatggcatttgtctgtcatacagtttagaaccacgtgttgtagtgcaatagagtacaattgaaacaggttacattctgagatccttgagtgcaagggccatgcattatgttcgaacagttccactcgccgctagtatacatgaacaataatgcgt

SEQ ID NO: 630836 - DNA, 376 bp, Homo sapiens
  misc_feature (173)..(173): n is a, c, g, or t
  misc_feature (195)..(195): n is a, c, g, or t
  misc_feature (261)..(261): n is a, c, g, or t
  misc_feature (282)..(283): n is a, c, g, or t
  misc_feature (285)..(285): n is a, c, g, or t
  misc_feature (290)..(290): n is a, c, g, or t
  misc_feature (307)..(307): n is a, c, g, or t
  misc_feature (318)..(318): n is a, c, g, or t
  misc_feature (326)..(326): n is a, c, g, or t
  misc_feature (352)..(352): n is a, c, g, or t
tggccagtgtgggaccgggacgggaaggaagaaggaggctagagagcagggggaaaaggtgcacttggccagtgcgcctgccaggaatgagtccatgcgttgtctgccaacccctaccacagtgtttgtgccttcagctgagggggcacctatgggccctgaaccctgctggngctccacgaccctgagagaagnggtgagaagaatcatctctgcacctcgggtctctgccagaggaagacttaagcatccctgcgaccncacattctagacagagatganntncaggnttggcccatgcatgccnttcttcacaantttgcaantagactgtaaaataggaccaataaanccttttggaagagccaaaaaaaaa

SEQ ID NO: 630837 - DNA, 1188 bp, Homo sapiens
tatttttcttatgtaatttcttaatgatattactattatgttttctattttaattattgttgtgttcttgaattgttttatattagatacaactcttcttagagtgggtgatgaaaaagaaataataaccacagaacatacataacaacagataatcggacataacaaacacagagatgaacaatgaacacgaatcacaacatacacatcataataagcaagagagacggtggtgcgtgcctactaattacacgcacgcttacgggtacgagtcacggtaatggcgtgacgcaccctcgctttgggtgcccaggacagtgcggctggaattgtagcgtgtgttaacatttcatagagtgtaacgttgactggagccagatgattcagatatgacgtcatagtttggtaaccgtatatgacaatgatatgggttcgtgagctgaatggtatcaaagtaaatacatcaagagatttgcgagtagcagacaaactaacggcagaggcttatatatgcatcaattcttgtgcatttagctatgtctaatacaaagggcaactattggttatataaaggcaacatggtaactaacgggcagaagatagtatggcttaaatagataagtagagaggagaagcaataaacaaaaggtatcggatgtaggacaattattactgacgcagtctgattcgaacaaaaaacaccaaggaggggatacatatacaggagcctcgagatggggggtcaaaagccgtgtgcacattaacaactcaacgagttccaattaatatagtacgacagtcaagtaggcccactagcagacgtcttactagggatcatataaccctgtggggagcaaacgaattcaattcaaccggtccccatcatcacttctaaaaaacattcaaacaccagtttgcccgcatggttaccaccattgggggaaggtacagcaagtccattaacgggcggggaaaacttctcaagtcccggttacactctaaaagttacgcctttttagtcaacacagtctcacttagcaaccttttggttctaaggacaataaccttaagcaaatgttgcgctaagtgaaagaccaactagacaggtattagcaataaactgggataacaaggtcctggtatctcacacaaaactacagcgggacatgaccaacatcggacacggtt

SEQ ID NO: 630838 - DNA, 417 bp, Homo sapiens
ataggcgcgttctgcgtgcggaggagctgcagcgtgttggcgcaggcacacaccacggtggacgagctcgcacggcgggaagacgtgcgccactacctgcagggcctgcagcagtatctgcagggctgttgctgaaggccaccaatgagaagctgagtgtttacgccgccctgcagaggcagctgctgagtcccggcacggtcctcatcctgctggaggcgcaggcgtgctcaggcttcctgctggaccctgtgcggaaccggtggctgacctgtcaacgaggctgtgaaggagggttgtggtgagccccgagctgcaccacaagctgctgtcggccgagcgcgccgtcacttggctacaaggacccctacactggccagcagatctctctcttccaagccacgcagaaagcgccta

SEQ ID NO: 630839 - DNA, 140 bp, Homo sapiens
  misc_feature (8)..(8): n is a, c, g, or t
  misc_feature (14)..(14): n is a, c, g, or t
  misc_feature (42)..(42): n is a, c, g, or t
  misc_feature (85)..(85): n is a, c, g, or t
  misc_feature (100)..(100): n is a, c, g, or t
ctgtctgncacagnaccgcctccatcccatgtcccgcccagncccgcccccaacccaaggtgctgagagatctccagctgcaacnacgcaccccccaagngtggccgctgttacagaaacaataaaccctgatgggcatg

SEQ ID NO: 630840 - DNA, 613 bp, Homo sapiens
acagggatacttaaagatgcaggagtaaacaacctaaccatacaagtggaaaaggaggcatactttcagcatatgtccggcctgagtactggatttcatgatgttctggctatgacgaagcagatggaatccctgaaatactgcaaagatggcacttacatcatgtgagacgcagccctgcggcaatgaacagtgaacagcggaggtcggatgaggtgataatgtcagagcagagtgaaagttgcacataattgtacgaaaactttttaagctccctactgttagattaaggagtctgttttaaaagaaaattgagatgcagaatgaagcattcattgaataagaaaattgtcgctctgtttgaattatgtgcttgaaaggaatcttgcattggaatgaacatgatgtaaccgtacacatcatcttcaggaatggacgcataatgatggattctggtgaagaccaaaatttcttctgtgcatttactctcagtcaggaagcatccccactgtaaatatgtatttacatgtttattacaaagactcagatgaagtttttagtcgattttttgcatatctgaaggacaaaatgagaataaaattctatatttatg

SEQ ID NO: 630841 - DNA, 347 bp, Homo sapiens
cgactacagcagctatgcaagggcgttaacgatctctcaaaactgatcagtttgtgcaaagtaaaccagttcttttaagagaagactggtgcactagcccagggtcagggatattaaaatctagcacataaagcccatgactagaaggtagaaatacaggcaatatactatgagggcaacaaccatcaattacagttaggaatttttctgtaacaacgaaatggataatcaaatattgcaacgactcaagtattacggagcaaagtgcatttctacagtatgcagtgtggctattcagtattctaacttagaacagcctatgataaggggcagccgagaaggacaca

SEQ ID NO: 630842 - DNA, 502 bp, Homo sapiens
  misc_feature (38)..(38): n is a, c, g, or t
  misc_feature (477)..(477): n is a, c, g, or t
  misc_feature (483)..(483): n is a, c, g, or t
tagcactctgttgcccaggcctggagtgcaatggcaanatctcggctcgctatagcctgtgcctcctgggttcaggcaattctcctgcctcagcctcccgagtagctggaattacaagtgtgcaccaccatgtccagctagtttttgtatttttagtagagattgggttttgccccattggtcaggctggtctcgaactcctgacctcaagtgatccgcctgcctcggccttccaaagtgctgtgattatagacatgagccactgtgcctggtcttggatgagatttaaatgggaggacttggagtaaagcagattaccctccataatgtgtgtggggcttcgtccagttcagttgaaggccttcctaacgtcaaagggctggacctccccctggaggcagggaaggggatgcttgccagcagggggggcattttgggatgggggattagccattcctcccccgcatttttccagcnttcccntcctaccttgttcagattt

SEQ ID NO: 630843 - DNA, 83 bp, Homo sapiens
ttactggaaagactgaagaccacaaatctttttggacattttggctgtataaagcatatcatttattaccatgaaccctggaa

SEQ ID NO: 630844 - DNA, 107 bp, Homo sapiens
tagtcggtacctgatgcatgttgcgcggcggattgaccaccgaccgtatccgcgacgagaaggtgaaggtactgcgttcgctgcgccgcattgatcagaccaatgta

SEQ ID NO: 630845 - DNA, 614 bp, Homo sapiens
ggctgcggcagatggcgacagttggcggtcggcgccatggcagggcttgcaggactcctgctgccttggtgatccctgggctgacagccatgagagcacagcggctcagttcctgtagagtgagggttgaagtaaagcggagtggcagccgctgtcgcccgctggctcccattaggtcggttactctgcagcggtgctcgtgcagccttggtgaaggccctgcccggcagacgatctatgtattgcctccagtggactgcttgctctcgtccttctcttcgatccttcagagcctccttcgaactctcgcgcccctgttgggtttcgatggcctatcgtcctactggtttcactgcggacttcgttactcttgtcttcaagcgtatcccttacccttggaataccggggaaggcctttttgtgggcaactttttgttgccctttgggctttttctctggggcaggctcccttgtttccttgtattctgccttataagcctcgcgtgtggggtaaaacttgttttctctcgatgactcattgcttcccggattcccgcgggttcccagcaatccgtgggctttgatcccggcttttgtgtgcaccttaacggcca

SEQ ID NO: 630846 - DNA, 269 bp, Homo sapiens
  misc_feature (215)..(215): n is a, c, g, or t
  misc_feature (246)..(246): n is a, c, g, or t
  misc_feature (267)..(267): n is a, c, g, or t
cagcctgctctcagcggtctgcctgagaatacatcaggggcctctgaagaggactgagccgccgtgcagccagcctcgggggtcatggttttaaaaccaggtgtaccttacgttgggtgtcctgcaggttactataccttgagtttaaagtcgacttcctcttacatttctcccctgctttggatctgctttgtgcttggctgctgagagagcanacagggctaagacagtgtattcttccaaggntttttggccttttaaacgggncg

SEQ ID NO: 630847 - DNA, 528 bp, Homo sapiens
gcggatatgagccagcggataaatattctcagccgcctgtgcagtcagacaattctgggaagcattagatatcctacctccgctaagtgcctttctattgactttggcttcgtgtcgcgctaggcagacttgcgcaactcctgcatcctggagccaaacgccaaatgaactactgcactcaagttgaataaactctaaagatctgctctcagggaagcccaaacttccatgattccatttatagatggcttcaaaacaagtaaaacctatctatggtgatacaagtcagaagagtggctaggataaccagtggtggtaatgatggcagagagatttctggagtgctggttatgttccacatcctgatcagagtggtgtttcaactggcatgtatacttggtaaatcttcatcaagctgtatgcttaagatgtgtccattatatagtatataagtgttttaactttagaaattaaggatgtaggtgtcaggtggtacagagattcccataagaaaaaagtgggctagta

SEQ ID NO: 630848 - DNA, 1266 bp, Homo sapiens
ggttgactcccaacggtgacggctcccttcccacactcctatggcgaccagctctcctcccccgtgtactcccaacttctcgcgccgacttggcgccaggcagtggcataccatctaacggtgctctttagaaacgactaatgctatccctcgtgggcgcagaacacccatcctcacgttctctgaccctgagctggtgggctcgagcccctaaatgtcctacaccgtcgtagtcccgttgaggccttagacgaggatggtgatctgattggttgcgcatgggtgtgggctcaggagatatgatccgctgtgattttaaagatcccattccccatgctactgtgtaccttcgtgtcatttaggggcccttaaggacccataacatctcagggggaccaaataggcacgctcgccaagcgcggtccacagacatcgtgcgaggatcgcttactccgtcaagcgtgccatcggggcagtatgtgggtcgtccatcgtgccctacacacgggtgccgtagccttgatcaggtcttttgcaatcccacggcggaatcaggaggtgccaggtatgcggcactcttggccgtgcagcgactatgaggaacaggattggttcgtcctttgtccagtgtaccccgtgcccataccgcaaaagcttcctgagtcgtcatgacaagtcccaagctcccttttttccaatgactctgttaaagcttgacctgtccagtcctctatacctaccagaggaacgaggaccttgctgaatcaacacttgtgttgccacgcatacgtccttgcccacccaatgcaagatttcaggcgacgagaacccctggtggccatgggtaaaacccattaataagcaggggacaccgaagcaagctcgacggcattgagcaagacagtagggcgcacaaaccaccgataaagtgattcccgatattggatggcgcaattgatactcccaagtcacgccgttggaattgggccaagggccatcccccgatttgcttagagccagattggccaggctttcaatctcctttgttggagacaatgttggggcctccacgtcccaattctttccattccttaggaacccaaggtagacacccgcgcagagcaccccctggaaaattcatttgccttcccgtcattagtactgccccctaacttgtgaagacattccgaagttaaacttttgggcgcaggcatcatagatgcgcgccacgagggagtccaccattttacacactataccccatag

SEQ ID NO: 630849 - DNA, 604 bp, Homo sapiens
  misc_feature (430)..(430): n is a, c, g, or t
gatgcagtagctgaacaagtaccgtctgcggactaactgcaaaaatgctggtccgtgcacgttgctgcggcgtggtccgcagcccttcctcgtcggggctggactggtctccagaacatgcttaggcgcttcatcattgtcatctcgcttgcagagtggaaggttccaatgccctcgtacaacacgtcagtcttcaaacatgacatggggaactgcttgagtatgtccgtctattctgtgcaatgagcggtattcgttgagaagcatgagtacctctgttgatctagaagaaacgtgggcgtgtcttccaatctattggtgatggtatagcccgctgtatagtggcgcgtgaagacaaatgtgttcaatgccacccaataatagtggatataaagtaatacgtctcacgtgctgtaatagtgggctatgntctcgttggaaacctgttcgaggaacccttgggaaacaaggttgttggagatgattcgctctgatcgtaatcgtcaagaatgaatatcacctaaattagaccgaaagggaggagtgtaggatggagatcgacaatagccaatgtgcccattgccatgtgctgaggagcacaggg

SEQ ID NO: 630850 - DNA, 114 bp, Homo sapiens
gaggattactgatcttccgtcccagaaaaatgcacacacacagacacaccgcattttgcatactttaagaaattcacaggctgggcgcggtggctcacccctgtaatcccagca

SEQ ID NO: 630851 - DNA, 135 bp, Homo sapiens
tactctacataggctcctctagctctggctctgtctctgtctctgaccgtgggaatgtgatgactagtctcactctcctcccgtaccctggaggcccgcctcatctcctgcaggcttagtaagacctcgtacata

SEQ ID NO: 630852 - DNA, 169 bp, Homo sapiens
tcatccacagtaggtcgagggtatctctcccacggctacatgaaggctgcagcgattatggcatgcgtgcagatgctatgaaatctaaaagagccagattaatttaatgtcttacagatttctcttatagactgtgtgtttcatactgttactcaaaaaaaatacatat

SEQ ID NO: 630853 - DNA, 216 bp, Homo sapiens
ggcaccttgatcttggacttgttgatttattaaataattccacattctcctgagatcaaggaaaatacttttcagagtggctttcttggtgtctaacatttctgctttattgcagcgaagacacaaataaaatcctgatcctttaccagccccctcctcacctccaccctcaacccatcttcctagtgtttgtgaaataaacttggtatttgtctg

SEQ ID NO: 630854 - DNA, 358 bp, Homo sapiens
aaaggctggggaacatagtgacatcccatctttacataaaatttttaaaaaattaacaaggcatgggggggcacacctgtagtctcagctacttggctgagggaggatccctggagtctgagggttcaaggctgcagtgagctgtgatttgtgccactgcaccccagcctgggggggtggcagagtgagaccctgtctataacggcaccccatataataaattcttcgtcttcgcggcccgcgaattctagttagtagttggacctcggtaaatttccggaacacggtattcactgctagcgctgttactctatgtttttccaccttttcatctgtggtcaccttagcatagatcggg

SEQ ID NO: 630855 - DNA, 551 bp, Homo sapiens
cccaaaacgaggagtagcattactgtgggcatatctacacaccacactatcctgtagaatacgtgactatgctcccagattatgtgtgacagagcaggatttcttcacgatactagccttatcctctatgaggaagtaaaaccgaatataacagagagaatacaggactatgacgtgtctctatgataaagcccttgatgaactaatggatggtgccatcatagtatttcagaaggatgacccctgaaaatgataaccgtgaattacccaccgcaacggagtatttccgagatctctaccaccgcgtagatgtcctttactgtgataaaacaatccctaatgatcctggatttgtggttacgttatcaaaatagaatgaattatttatcaggttgcaaagacagttgaacagaggctcaacacagatccaatgttgctgcagtttatcaagtctcaaggttatagggctggcccaagtcatcctcttagacctaattatgcaggtcctttaagagatcttctacagttataacagcctagacaaactaagc

SEQ ID NO: 630856 - DNA, 759 bp, Homo sapiens
cgccgcgagttcccacttaggatgggtagcacagactttgaatggtcgctgatcccgatttgtgcactagttagcactggtcagggtccctgtatttccgtgcactgggggagataaatggtttgctcctaattctctttgaaaactgggcctccctgctctgtgattggataaatgatgttcccctcccccccccctccccccccatattgctccaccaggggagagccccatatgggggagccaaatttgaccaaatgggaattagaggagtgccagttttaaaaggaaaagttgctgtcatccaaatggccagccctttcccccagctactgtttttggggcccagatggctgccctagccagccaatcactgcccagggccagatcatggcttttggagggaggtgagtttagggagggccacggaccactcctcctacccctcataccctccccgcatataccaaaggggaggttttagacacggctccctgagatgttataccccacgaggagtcactccttcattcctcctctgtctctttgcactgttttttggtcttggccccaagcctgagtgacgaatttcctactggatgtacccagttcccatttttaagggggggaaaggtttcaaatggggaaaaacacaccaaaaaaaatcactaaaattccccccaatcttgtttctggcactttagaaaactgccaacaaaatacgtaataaagaatacatatatatatatctacacacca

SEQ ID NO: 630857 - DNA, 983 bp, Homo sapiens
tgaaccgcagaaggcggtggaccatacgcgccagctcttctgggagaagaagctgatgcgggctgaactgccttcgacattgctgaggagctggtcaagaccatggacctccccaaggggcctgcagggggtgggacctggctgcactggatgagactgctgctgtctggcacatctgccagctgcccttgcacatatagcaccatgcccatcaacgggacagctctacgggacgccgttggagaagaacccctggcgtatggctcaacaccacgcagcccctgtgcaaagccttcatggtgacccgacgaggacactcaggaagcaggaacgagctggtgcacgcacggtgcggacacccggcctggcaggaggctgctgatggccgacatgctggcgcaccgtggaggacgcttggcccgtgacggggagcgcgccgcctggaaccaaggcctgcagctgaggacgacgacgaggaagcacgacgcaggaggaggagcgaggagcccgacccggcaccggagcatggagcacgtcaagggcacgaggccctcccgacgacgcccgcgcgcgcctgcatggcagaccagacatgccgaaccggcggaaccttcggagcccccaacgttcaaaccagggatcaagacggcagaacagaccaacgcccacgagatgcacaagcccaaggacggacacgtgcccgcgacccaccaatggcaccccgctccctacgggcacagtccaccaacatcaccacgtgggtgcgcaaccagtgtcggccaacaacaatactctagggcaccatgcagccacccaacaccagaactaagaatcccgcttccactgacatcggtctacctgcttcaccataagcatacacgagatactcgcgcaaagattgcaccgggcatgatcacttttctcgccccttggccgtggcgattgccccacagcaccgtttcggtcagcacacatagcgaccc

SEQ ID NO: 630858 - DNA, 247 bp, Homo sapiens
catatcgaatcgagccggtaccctatgtctcgatcgttaataacacataaaatcctgtatcccagcactttgagaggttgaggtgggcagattgcctgaggtcgggagttcgagactagcctgtgcgacatggtgaaacctcgtttctgctaaaaaatacaaaaaattagccgggcgtggtggcgggtgcctgaggtcccggctactcgggaggctgaggctggagaatcacttgaacctggaggcg

SEQ ID NO: 630859 - DNA, 125 bp, Homo sapiens
  misc_feature (39)..(39): n is a, c, g, or t
  misc_feature (115)..(115): n is a, c, g, or t
tcagaccccaactctaagaagagcaagtgttccaaatangctgcattgtagagtttaggcgcagtgacctttccataatgggtaggagtggtcactgcgcctaaactctacaatnacttatttgg

SEQ ID NO: 630860 - DNA, 426 bp, Homo sapiens
  misc_feature (18)..(18): n is a, c, g, or t
ctcaactctgttgccccnggatggagtgcagtggccacaaccttggcctcactgtaaacttcaccctcccgggtttcaagcaattcctcatgcctcagccctccccaagtagccgggactacaagcgtacccacccatgccccaggatgtacagccctcccagcacggtgctcgcttccctaatgccattccacagtatttgttgcagagaaggaagcagcatgcccaggacagatggagacaggactaatttggcttgaggtatgtaattttgaacttgagcctctctctgggactgtaaaactccaaatcaaagtcttaatctgagaatacatacatctgaaagagtgattagggactggtaaacatctattaatattcaactctgatacaaagtacaagttgtttattcttaccacgcaaggc

SEQ ID NO: 630861 - DNA, 1143 bp, Homo sapiens
  misc_feature (435)..(435): n is a, c, g, or t
ggagaaggtggaggagaaggcaagccggaaagagcgaaagaaagaacgtggtggaggagagaggagacacggggctgaggaagaagaagaagataagtggcgatggatggagaggaggaagatgaatggggaatgagatggaagatgaggaagaggaagaaggaggatgatgagtgggcccggcggctgaagagagcgtggcagaagaggaggatgaagcggatcgctagagtggcaagagagacgatgaaaatggggtcatcggtgggttgaggctccatggcaatgaggcatggggtttgaggaggcgcttcttcgtgagcggtaggagggtagggggtgagtgggccagcccagagttccacgctctagtcgtatctatcctggacgtcctcctggcgtcttggtgcctctctgtcgacccaggagccatgntcgaccccgtcgtttctgttgctccctcgagccgttctacatgtccggcatcgtcgcggagacgactagccgcccacatccttagctcgtccacatcttggcgcaatctgttgtctcacctctcgtgtgaacttgcgtcgctatccgtgcacgctcatctcatagcttggcctccgctaacttagcatcacgtgctgcgtcgtctgtatgcgtctccctattctcctcgtcctccatactcatagtcgtcgattctgtcgctcgcgggtatgccttcatctcccaccttacatgctctggtcatcacactcctagacacttctatgagtcctggccccatttcacccttaatcccttgccagtgaatcacgcgtggggaatcgtgctcttcaatgaatccccacatctttcatcaagcatggagaagtccaaggggaacgggggcgatgggtgaccggagcggttttggagagggcctgtaggagccccaacaaagagttgggacacaaccaattacaccagatccccaattattatcggacataacgtctacacctaagaagggaaaagtgggtccgaaggaaagcactgggtactccagaaagagacgagaacgcacatacacacagcggggcgcgcacgcccccaatagaagtgataaccccagggacggggggggacacaagagtatagggcggataccacagg

SEQ ID NO: 630862 - DNA, 160 bp, Homo sapiens
tcgctggatagtaggtagggacatgtgggaatctgcagagagcgcagtcagtgagccagtgatgaaccctcctttctcatctacacaccagcagtgcccagtcccagctgtgtcactgcacagtgctcccaaccttccaaactgcatcacactgtgggca

SEQ ID NO: 630863 - DNA, 1568 bp, Homo sapiens
  misc_feature (284)..(284): n is a, c, g, or t
  misc_feature (872)..(872): n is a, c, g, or t
gcgggacgaggcatcagatcgggctgataggagcgtgggtgtctcctctctccgaccatggtcgatggtagctcgcccactgatatacgagggatactccgagagacggtggggaggtcactctgagccacacagagagtgtcgctattggcctgctagtaattcaaggcctcctaatatcgactcagactattagtggtaaccttagtacacacgggaatcgttgctcgcaatagaactaacgaggatcacgcgcctattgctttgtcgaggtggatagttanagcgaaggtcaattgcacgacttgaggtggcgatgagtcttgtgtgccggtacgtgggtccagtagcgctgtggagctcgtagaattcccaagacgtatcggagtgtgtgggatgagggactgtcacctgctatcttggaccagagggattgcgatctcttcgggaagacacgtgatagtcagatgggagagcgcgaaagaggtattggcatgcaaagcaaaagataccgtgggcggcctgaattgagcggctccagttagaatgtgggagactaggcaacaccaaagcacagcgaatgaacgtccccctgcgttgttcgttgcaccgagtgtttagcgctcgaggcgccctaaccgatgcgactttgtgtccagtagtcctaaccaagtgttctaatacgttatatggagggcaacgatatcccttgaacaactttaccatatatggctcacgtcgtggaacatgaattcacacaccggtcgtggaagaggcggcttaaccacaccgacagcggaccccacaaggggaaacagggctgtgcttctttgtggcgtacacctttgaagggaaacacctttgaagacagncccttgggacactcgaagttatcccaagacggagggggtacataaatatgccccattcgttcaacgccgcaaacttgacgcatggcttgtggacaaacatggggcaacaaacattggaggaaaaaccccggtcggcccgcttatttccaagacggcaagaggagggaccccggatgtccttccaattcctatattaattggacgcgcattaacgtgtgtattcattcaaagagggcctttccggaaaaccaattccccgtggccaattaacattcattgggctgtacaccggtgtatagggacacacacgctggcacacaattttatggacagggcctggcgtcccctgtggttggagagctgtgtgtgagacggcttacactgggccttgtgggacctgagacaacggggtaaaccccggagacaggtcaggagtgacattgcgctcagggacagcatgtgggggtaaagaccggagtgccgcagaggagcgaccacacgacgactacccgaggcaagacgagacactaagaagtaacgcacacacgcttgcaaacgccgcagaacacaaagacgacgtgcagacccgaccaaggaaaaccacgcaggcgcctaacgacaccacagacagagaagagcgaggaaaccaccataacaaccgacaaacgtagcggagacagcgcgaaaagagaggta

SEQ ID NO: 630864 - DNA, 807 bp, Homo sapiens
ggagagagagagaactagtctcgagttatatttttattgattaaacctcccccaccctttgtcctgaaacgcttggtatcccaccttggtatggggtcatcggggtcgaggaggtagtcattcattcctatgggtcgtgtgcgtggagtctgtgtgttcgtcgggtttgtttggcggtcccagagctgaagtgcctactcttgtcggcgtcagacgcctccagagccgtagatttgccaatcgcctcccactactgacgaattagtcaccacaggcgagtccgcaatgtgaaactcatctacctttgcaactttccagatgttccagtggtgtggaaaatgtctcttcctggtaaaatagtgggaatgctatctcatttacaccttgacccagagcctaccctattgaaggacttcctaattatctcagggctaattaggaacgcatgaacctcattgaacttggccaagctagagtatcaaggggcttgatggaatcagctctgaacctggggaggacctcttgacctctgactatgcccctctccagacaacttctttgtggtgatggagcactgtcttgaaccatggcttgacagctaaagaaaacttttctcggacaaaataaatccttcggggggcctctagaactggtagaaaacgcttgtcccaaaagccgcagagataacagcaagtgtaaagatctcccaggacttaagaccccagtaggtagaggaagagcctgccttccgtgggcataagtggcaaagaactcccagaatatatgaacgtctgatcactaagaaac

SEQ ID NO: 630865 - DNA, 613 bp, Homo sapiens
tctagcctcgccatgtggtgggactacaggcacgtgcaccatgcccatgctaattttttgtatttttagtagaaacaggtttcatcatgttagcctggaggtctcaatcttctgaccttgtgatctacctgcctcggcctcccaaactgctgggatttcaggcatgagccaccgcgcctggccgtatagtttttttttgagacagagtctgactttatcacccaggctggagtgcagtgatgtgatcatgacttactgcagcctcaacttcctgggatcaatgatcctcccacctcagcttcccaagtagctgggaccacaggcatgtgccaccatgccctgctaatttttgtattttttggtagagacagggtctcgccacgttgcccaggctggttgggaattcctgggctcaagcgatccacttgctttgacctcccaaagtgctgggagtacagatgtgagccaccgcacccagcatgtatttcaaatgttttataatgaacacatattacttttacaatcaggataagacaaaactaaaaaaaccttgtttatgtataaaaggcatagctgagaacgtgaacatgatgcaggatactcactccgacct

SEQ ID NO: 630866 - DNA, 377 bp, Homo sapiens
agacttcgggctccagtaatcctccccactcagccttctgagtagctgggaccacagcgcaccaccacggctggctaacttttgtatttttgggtagagacagggtttcaccatgctgcccaagctggttttgaactcctgtgctcaagtgatccacccaccttggcctcctaaagtgctggaattacaggcatgagccactaagaccggccaagaacaaaaacttttttttttggttggttggtaggatttttggagacagagtctccctctgtcacccaggtgggagtgcagtgcacagtctcggctcgctgcaagctccacctctcgggttcatgccattctcctgcctcagcctcccaagtagcggggacggt

SEQ ID NO: 630867 - DNA, 111 bp, Homo sapiens
accatacttatcaggacggcagctgatcagaccgctatctcttcccaccagcagagaaactgactttaaataatttaagtgaaaatatgatttatcaccccaacgctatct

SEQ ID NO: 630868 - DNA, 1675 bp, Homo sapiens
tgtgcggtcttcctgtcgtcgtttatggtcttagtctcggagggtgcggcgtgctgtgttgcggtgagtagctgtcgtgtgcacgtgttgctccgttgcgtcgtctcgtcgcagtgtggttgttggttgctcgttgtggtatttgtgctcgcgttctcttagtagttggtgcctgcttggtggtcgtgctcttgttgcgggtgcgtgctcgccgctgttgctcgcgtgtcgttgttttcgcttgcgtggtctccgcgcttcgtcgctatggtgctggtgtgcccttgttgcctgtgttgtctcgtcctccgctttcgtgagttgatgccgtggtgcttgcgttgtacgggggtggtgctgcatgcggtggttgtggaggtggtggcttgatcaggtgtgggctgctgttcttgtgtgcccatgtgtgttgtgtggtggtgttggatgggggtggtggctgccccgtggggtgccgttgttgagtgtgcgcgggggtgcgggggctcgtcgatgcttttgttgcgaggtggtgttgtctctgtggtggcgctgcgcgtgtggtgctccgtgccggtcgcgtgggtgtgcgttgggtgtcgcttggtgtggttgtctgttcttggatgcattgtcttcctcgggatcattggttgaccgtgtatgaacttgggctggttgtggtcgctccattgtttcctcgcccgttgtccaggggtccattgcacggtttgtttggtgtgttccccttttgttgtgtgcgtatggctgctttcttcggatcgtctccccctgcttttgattgctggcgatcgccatctgtgggtcgggatagtctgtgggcctcctactggtttccatctggggtcttggtgtgggtgcgtgcctgtgtctatcgatcgcgctagtgtcacggtcttgttgtctgcctacctactgtgtatgtctctgccgttgcggtgagtgatgccctgctttcttggggctgctgtgttgggtttcgggttggtggcccacgaccttgcccagttgatcgcctttgggcgctttgtctcgttggtgccgttcgtttcccccgttgtggtggttgtgtggtgtcgcttggtctcgcacggtggatcggggatccgggggggtgcagcccgagcaggccgtcgcctgccagttgctgcgcacgtcctgtgagcacgtttcaggcgtagcatgtcttgacgctcgtgcgatcaggggttggtttctggtctgcactgaggagtacgatacacacagaagcgagtaaaataagaacgcgtattgttcacttgtggtacggcgtgagagctgaacttatccaaccaggcgaatgtgggaccttgggcctatgccatttctcgttgctagttctgggcgcagtgtcaggggacctgtgtggggtgtgaacccaaggcactactgcccacctgccacagtaaacgcatctgcacttgactcaatgctgcccgagccctcccttccccctatccaacctgggtaggtggatatggggccacagttgcccggatgctcttatatacgagagtaggttgatgtgatctttacatgcttcttgagtctaatgcttggacaacttaatcacctagcagtttctaaaccaataaatcaaactgctggggaacgagcatacgtgcgtggtccgcca

SEQ ID NO: 630869 - DNA, 206 bp, Homo sapiens
gagatcacaggtcgggaatctgcacagagcaggatagctgagtgagtcggggagctttgtgctgggccggcatcttccttgaaggcgggactgttcatctacttcaggaatcagaaaggacactctggacttcagccaaccaggattcctgacgctgaacagtgcagattaccacccttcgacctgggggctcctcgtagacgtcg

SEQ ID NO: 630870 - DNA, 287 bp, Homo sapiens
agaccaattccagatggataaaagatttaaacgaaaacagaaaagaactaaaatatgtgggtaaatatttcctttatcttggggtagggaaaacctctctaaatatatcatgaaaagaagaaactattaaaaaattgacgattttggctacacaaaaattaagatctatacagcaaaagaaatcataaataaggttaaaagacatatggtaaccctaagaaaaatatgttttgtaatatttctcacaagcaaagagaaaatatccttattatacaaagagttctcat

SEQ ID NO: 630871 - DNA, 290 bp, Homo sapiens
tattgatgccgaacttagtgcggacacccgatcggcatagcgcactacagcccagaactcctggactcaagcgatcctccagagacaaaggttgcagtgagccaagattgtgccactgcactccatccagcctgggtgacagagtgagactcttgctcaaaatataataggctgggcacagtggctcacacctgtaatcccagcactttgggaggccgaggtggatggatcacttgaggtcaggagttcgagagcagcctggccaatatggtgaacctggtcttctactt

SEQ ID NO: 630872 - DNA, 149 bp, Homo sapiens
acaaagaggaatatgggagctacaactcaagatgagatttggttggagacacagccaaaccatatcctacttattttcctatcctagcattattgagtccgggggataacttgcttcatggagtggtctccccaggactcaataatgca

SEQ ID NO: 630873 - DNA, 327 bp, Homo sapiens
agggtggtgctggtgttgcgggaacgctggcatttttgccgggacggccgggtgctgctgggctcgagggccctgagggagcggcccctaggcctgatgggcttccagctcctgccgcttccctttgagggaatggaggtcccagagagggcctgcccccgctcaagagcttccttaggcaaaagctcccggccctgggcctgcgctgggggcctgaagggggcttaggggattatgtggggttccggatggcccccccctggggggggggtgatttgccctttggttccctgggttttggtttttccttaaagttcctttccttca

SEQ ID NO: 630874 - DNA, 133 bp, Homo sapiens
ccttgttgtgtgaattagctctgaacctctctactaccagtaatgcatttgtcccacatttcattctgatagaaccatgaacaccatagcaccaaacaaaaatccgaggcgttagatgatgtctcggattaaa

SEQ ID NO: 630875 - DNA, 105 bp, Homo sapiens
gcagctttcttccagcagagaaagacaagcaatcgccaaatgaacaagcaaaatatatagtacatacagctaggtgctacagaaacttaaagcagtgaaggggcg

SEQ ID NO: 630876 - DNA, 411 bp, Homo sapiens
  misc_feature (71)..(71): n is a, c, g, or t
  misc_feature (369)..(369): n is a, c, g, or t
  misc_feature (399)..(399): n is a, c, g, or t
tccttttcatttgcttggtaaatattcctccatccctttattttgagcctgtgtgtgtctttgcatgtganatgggtctcctgaatacagtacaccaatgggtcttgagtctttttccaacttgccagtctgtgtctttttactggggcatttagcccagttacatttaaggttaatattgttacatgtgaaatttatcctgtcatgatgttgttaggtgtttatttttcccattagttaaggcagtttctttatagtgtcgatggtcattacaatttggtatgtttttgcagtggctcatactgtttgtccctttccatgtttagtgcttccttcaggagctcttgtaaggtaagaatgtggatttanttcttgtaaggcaaatatgtggatttacanctgggtgctgta

SEQ ID NO: 630877 - DNA, 191 bp, Homo sapiens
cagcgagtgtggcacatatcacgcacgatcactgccaaatctaagggcacgcactatatcagaatctgggccgtctgcaggtcacgtgatgggcagggtgtggaggaatttattgtaatgatcgttaaacatcaagcgatccttattttttttgatcttgacagatttgacaccccttctgtcgtcttctc

SEQ ID NO: 630878 - DNA, 218 bp, Homo sapiens
aaatccggggcggttccgaattggtcgaatttggtgtgtgttaatacgcgtcaggtaattggtgaagggtgtataatccaataggaatattgtttcaggtttgtatggggaaaatgttgctaacatttcttgtcccagtctgcaaagaagcacaattctattgctttgtcttgcttatagtcattaaatcattacttttacataaaaaaaagtcgacg

SEQ ID NO: 630879 - DNA, 624 bp, Homo sapiens
  misc_feature (69)..(69): n is a, c, g, or t
  misc_feature (434)..(434): n is a, c, g, or t
acacacataatacttagtacatttccttatatgtaaataattagtaatgtaacacatcgtgtgaatganattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgcacatcttgctattagcagagttgtggggaaatcctgtcatattttggtgaatagatatatgagttggntatatcatcttttaggggcgccattgtggcaaatatcaaaacacccttgaaactgtaaggtataacacttctagttgtgttcgatatacaccgtgtcacttcacaatattgagtcgccatacatatgtcctataatacttggaatacacacttaatcaaatgctctataagaagtactaaaataaaaaat

SEQ ID NO: 630880 - DNA, 160 bp, Homo sapiens
cttacactccaatctagcccctaccccaacttaggaaggcactggcccgctacaggcattagcccgttaaatcccctagaagtcccactccgtaagacacatcgtattactcgcatcaggagtataatcacctgagctcaccatagtctatatgcaatca

SEQ ID NO: 630881 - DNA, 888 bp, Homo sapiens
agcgtgtgtgtgtgtgtatgtgtgtgtgtgtgtgtgtgtgtgtacttaaaggtctggtcccatagcttcatcagatgcttagagatccaagacctggcatattacagtcatggcccaaactgaagatccacatatacttcatccacttaataccaaatttattgcgacccttcactcagtcttacgtacttgtacatagaactcagtctacttatttgttctattaagtgttctaacctgtcatcactattaaatagtggaatttgaatttcttggttttttaaacaaatgtgtagggggcagattctcttttcttgggtttttcttacaacttagtaaggccttggcataatgaatcgcacatttatagatgtaaaaattacttaactatgaaagcatgcagtggggtcgagttctccagcacatagcggacttggaaatttaagccaaaaaggcagttgggtaattggctactccagttacatgttttaactccttgaggttgtatggtttatccacatggcgtggttggcaacattctgcaaattatgtttagtttatgatagtatccaaacacataaaagtagtgtaaatgttaacatttttggctcagttagtgtgactttggcaggaatactgcgaaaattaggaccgcccgttccgtcagcatctgaaataaaatgttcaattctaatggaacttaagatgtcgttccacgctggagacatattttttgtaacatgactacccaggtaatccttcacttggactagaagctttgctccccctcttttggcggacaattctccggacaaccactaaagtctccccggcacccaacgtaaaacgggaaccccacatggacacaacgcccgtcaaacccgaaat

SEQ ID NO: 630882 - DNA, 234 bp, Homo sapiens
gtcactcatttacaccaatacacccaactatctattaacctagaacatgagcatggccttatgagcgggcgcagtgaatatgggcttgcgctctaagattaaaaatgccctagcccacttcttaccacaaggcagacctacaccccttatccccatactagtaattatcgcgaccatcagactactcattcaaccacttggcctgggcggacgcctaaccggtaacattactgc

SEQ ID NO: 630883 - DNA, 141 bp, Homo sapiens
gaatgtgcattataggaatagtaaaacatcaagcaagaacagcgtcattcacaagtcacaagcagtttatagtttagacatattctatctagaatcctgtgtgtcaggcacatcttaccaatgggagatccgtctagagat

SEQ ID NO: 630884 - DNA, 204 bp, Homo sapiens
gggagagagagagagagagagagagagagagagagagagagagagagagacagccacccagtaggctctcatgacttgtggtagggggcgcagtcagagaggtccccctagagggaggcaggagagtctgcaggggagagagaaaaagagagtctggagacgcaacacaagacgtctcctccagcacagcgggagatggcctgt

SEQ ID NO: 630885 - DNA, 779 bp, Homo sapiens
tgatgcggcctgggtcagactcaagtcagatacaaccctgattttgaccttgcccttggcaggccccacatcctcttattcctacatccctttctcccttccctcctctgctcctcaagtaagaggtgcagagatgaggtccttctggactaacaagccaaaaaagagaaagaaaaaaataatttattcttttctgttgtattgtgcgtaagttaagaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagctgacggccagtaaagtggacttaactcccaaggtgtgtcgcgccggacaccgggccctggacatgctgcttccatgtgcagtcccttccctgcttctcgctgtctgtccttgttcccacctcccagccccgcaggttgcagagttgttgtctgcagtccagtgtgggtagagcgatcggtgtacggggttcctgcgctccttgtctcttctcccaaatcttttcccttcaaggaaacaaatatgttcagaggtcctgtcttctgtccccatctttctggcgatagtatccgctgtatgatgtggatgccctcactgctgagttccagcctttttggacctccgtgcggggagaggcagaagggacgggctccagatgctccacttttccacgccttgggggctcaga

SEQ ID NO: 630886 - DNA, 800 bp, Homo sapiens
  misc_feature (415)..(415): n is a, c, g, or t
ttgccaagtagaccctcactgaggggcctgagcagccccagcaacttgtccaagccaaactggcagccccccggtgggcctcatcaagggagaagacaagatactatggccctgttgctgagtgagtggagcggggtggggctctgggaggatggcaggagggattagagcaagccgtgaagatttactgtactttctctcacagacaagtaaagaaatcaacgttgaaccctaatgctaaggagttcaatcctacaaagcctctgctgtctgtggtgagctgggacaggagaatgtggactttggtttctgtggggagacttgggcagtgcttatagatgaatagggggaggaacacttcacttccaggaccacttgcctggcaggcagtgtgaggagatgtcataaaaatgtnaggatggcacctttggggctggcttggggaaaatggactcaggtctctaggtttgggtgatcaggggatcagggatcccagtgagtctgatgaggggttaacaggcttttctttggttcttggcatttggctgagggagtattggagtggggtagtcatgaacagaggccagctgacttggcttgagcccctgtatttggaaggtttgtgatcttgggacggcacttacattctctgcctcacctggaactttaaaatactcatctcctcataagggttaatgtgaggctttatcaagaaaaagtgcagaaaatgtttgggatgcagcatttcacgaatggtaattattaccactctagcctgggcaggagtagagggaaaaatc

SEQ ID NO: 630887 - DNA, 240 bp, Homo sapiens
gagaggttaaatagcagtactattgacccagcgatgagggctctgacagtgggctttagtggagtcataatgtggatgtctgtaaagaggtatctttacgtataaaatgctatttgttgtaacgctaggtcatattcaagttgtttggctcatggagctttgatatgctccttgggcatgtgatgatgtgagtatgtacaatgtgaagggggtaggctactgtgtttgtgtcagggggcg

SEQ ID NO: 630888 - DNA, 623 bp, Homo sapiens
  misc_feature (15)..(15): n is a, c, g, or t
  misc_feature (61)..(61): n is a, c, g, or t
  misc_feature (77)..(77): n is a, c, g, or t
  misc_feature (91)..(91): n is a, c, g, or t
  misc_feature (105)..(105): n is a, c, g, or t
  misc_feature (136)..(136): n is a, c, g, or t
  misc_feature (172)..(172): n is a, c, g, or t
  misc_feature (179)..(179): n is a, c, g, or t
cggcttccaggtaanccccggtggctatcccatagggggtgtgtctggaccggggaggggncctgctccccttgggncataattagtccgngcactaccaattangtaccattcaaacctggattattttaaatangatcttccagctgtactgtaaatggagtactgcatngtagtcnccatatgtttattatttcctataatatttaaggaattgcctaaacatatacaaaatgtaccagttactaaaacagctaattatttctttcttcccctatgaaaggaaggggctttgctgttcttacatggctagaaccataataaacaatgtacttgcaattgtaacataagtattacaatgttattagtaataatcttgaagccttgttttttgaagtccattttattttaatcagtatattgcactaattattttaggtattttcattatatgaaatctaccatgtgtcagatgatttaatctatttaagtgttgatctgctagcagaacttgtacattttacagtaactcaaaactagtaaggagaacagttcaccggtgtttagttttatattgaggtgctcaggttggaataaagtgatgtaaaaagcaaaaaaaaaaa

SEQ ID NO: 630889 - DNA, 613 bp, Homo sapiens
  misc_feature (2)..(2): n is a, c, g, or t
  misc_feature (102)..(102): n is a, c, g, or t
  misc_feature (108)..(109): n is a, c, g, or t
  misc_feature (143)..(143): n is a, c, g, or t
  misc_feature (151)..(151): n is a, c, g, or t
  misc_feature (176)..(176): n is a, c, g, or t
  misc_feature (212)..(212): n is a, c, g, or t
  misc_feature (343)..(343): n is a, c, g, or t
  misc_feature (445)..(445): n is a, c, g, or t
  misc_feature (464)..(464): n is a, c, g, or t
  misc_feature (474)..(475): n is a, c, g, or t
  misc_feature (479)..(479): n is a, c, g, or t
  misc_feature (483)..(483): n is a, c, g, or t
  misc_feature (501)..(501): n is a, c, g, or t
  misc_feature (504)..(504): n is a, c, g, or t
  misc_feature (520)..(520): n is a, c, g, or t
  misc_feature (564)..(564): n is a, c, g, or t
gncatacacagacagatggagaggctagagactgggaggtgggggtgtggaagctgggccaccagttcctgagggggcaggggagatgagtgaaggagcgcnaaggtnncgcgagaagaatggagcaggcttccccagggggncgcgctgnggcttgggcacccctgcctcctggnccagcgtgctttgcttccgcgagcccgctcgctgcnaagcgcagagagagctaaggtgagcagacgagcatcttccccgagagaaccctggctgggtgggtagcgttctctggaagggtagcctggattgggggactcttcgcttgaagaaaggtggcaggtgtgcnatggcccctcggcaggtgggggctggcactgcccatgtctggttcctcagctgggggctcagtggctggcgctgcccctcgcggactgttcgctcacacagngcactctgtttggattttnaaggctcgcnnaggngacntttgcaggctggggaatnggngggccaggggagccgncagagggcccacgcatgggatgggccgtgcggcgtcctgtcccngatcgggacccccaagggcgtccctccgtccccgccgtcgccctcctcc

SEQ ID NO: 630890 - DNA, 433 bp, Homo sapiens
tgaaaagctaagtatctaatttttccaactggcttgatcatcaagtatttttatttcttagttaataaattacattggtgtttatttttaaagttatatatgcacgtggattgaagaaacaaataattcaagtctttttatttaaaagaaaaaaaagcacactaccctcactttcccctagatgaccactacctagaaagcacactcttattacctcccacccctgacctccactatttcttgctctttacatggacatacttttagctcttttaggtgattggatatttgctccagtattttgaaactacatgcttttcttgctgtttttaaatttttctgaactaggttgacccaaaaggttaaaataacagccactatagatttaagtcaaagttaattttattctgagccaagtttgaggactatagat

SEQ ID NO: 630891 - DNA, 203 bp, Homo sapiens
cattatgtgggccgggctgcgctccctccggggcccagggaggcccttgactaggcctagcttctgaataggtcctgcatgtcacttgacttgtggcactgcaatcttcacatcccatgtctccatctctccttctgccctcctcttcttagcctgcatgggattgcagtataagagcccccttgggtaaatccagtgataca

SEQ ID NO: 630892 - DNA, 1248 bp, Homo sapiens
  misc_feature (1248)..(1248): n is a, c, g, or t
ggacgcgtgggcggccgggagcgagacgcccgggagctcgtggaacagatgcggcgcccgcggcggcctgggggtctcggggtggatccgggggtcttccggctgcgtcctctggcctccctgcgtgcgtgagcatggccgcaccgtgcggtgtgctagctatgctgcaccgttcaatgttgcctcatccggtccttgtcatacttattgagcctggcgtggtgctcgtgctgctcaccttggcaaggtcttgtattcacggatggcttggtttgggcatgttgccagtgtgggaccgtggcgggaaggcccaggacgccattctagcaacgtccaccatcgctctcagttcatcgctagagcggcgtgtagcacacggttgttggctacctgaaacacaacgtcgagtgcttccccagagggattagttcccttgtgccaactgcaatggacccatctatcctcacgcataattgttgcattgctacttcgagggacttgactggaggacggcaatcctccataggacttctgcccgcacgccaaagatggcacccgttgcacatagaggagaccaggtgtactgggctttggtgcacacgcaaaagacgacccttggatacctagacttggtaggacgactgctatttaccattgtgaacagtacccacaatagagggcagccaggaccgctcgttggctatagcgccaaaggcaagttcctgggcggaattcccaccaaacactaccaccaggatgagtggcaaatatggagcttaggaagccttagtgtgcgcagcaggcttgccttcatactggccaacacccgtcatgggaaagaggctatggaagcgtggcgctcgcctggtaccttacctactgtgtgagaaggccagcgcaatgccttgacatagggccccgcaacaagtcgctaaccacccaaaaccctgtcaagagtgggattgaaacctggaaagcataggatcggtaaggctagggaggggccataaccctgggttgccacgcaaacgaacaggacttccccgcttgaatgggagcccaggaagagccccaagaaatggaggaacaccaccaggagacgtaggacaagagagtataggcacgccgcagtacaggagttggagcgccctaggcaccactaagaaagagaaaacgtggcaccacgggggctcacaatcggcgagaccaccatagacagcacgaacacagagacaggacgagagtacn

SEQ ID NO: 630893 - DNA, 274 bp, Homo sapiens
tccgagctctgtacctacaattagaagagacgagatcacgtccatgtgcagcacgagggtggctcggagcccctcaccctgagattgggttgaaaaggagggagctgctctcagtgctagtgttcagcaaacagtgcccagggctctgatgagtctctcatcgcttgtaaagcctgagacagctgcctgtgttgtgactgagattgcaggatttcttcacacctctcctttgtgacttcaagaggctctgggcatctctttctaccaagtggat

SEQ ID NO: 630894 - DNA, 387 bp, Homo sapiens
ttaatgacagagacgggttctgggaaacttcacatcattaggcgaccttgtcattgtgctggccgagtgcacgcacacacttctggaaggcacagcctgccacacgcctgcactgacgggagagcccaatgcttataggctacaaacctggacagcacagtactgtcccagacactctaagccactgtaacacaatggcaagtagatgtctcaacacacagaagggaagtaaaaacacagtctgatcatcttagcggaccaccagtatgtatggtccgtcgtgaacagaaacatcgtgaggcagcccgacagcaggaccactgctgcaccggcggcctagagacatctgctgagcaaaggagcaattcctgccggatccctgagagt

SEQ ID NO: 630895 - DNA, 731 bp, Homo sapiens
ctctgtagtacaccagagacgtgagatgaaccatccaccaagaacctgaaggacctaggttaggagatgcgctcctgtacttggtgggcacctaattgtgtgccatcagtgcagtcgccttagccacccccatgggaagatcgctagtggtgcctcaacacaccacgaacaccgagggtgataaaaagcactgggatgtgtgcagatctcatgaacaatataggtgacctatacacatacacatgctattgctacaccttggcgcataatttaacacgagcttgatccgctattgagagtgagtgccttgagacagattgtggacaactctctgccaccacagattgtgtgacagcgagacccgacacaggggcttcggcggagatcactgtgatactgcgctatgcgcagagctgtgacaccagccctacatccctatgagactgcggataaacaccgtccgctaccacttgctctgtatcactcttgagatagatctcgagcgcatgagtgatgcgtactaagaatcttccagcagactgctgtgatactagttctgttagagcgggctatttgaggactgttcgcacctgaactccatgtgcacgcaagtactactgactctgttgaatatccccatgtgactgggaggctacttcttcttacaggaactggactctagagcggcccgggcccataacaccataacagtttatacgtctggcctgctt

SEQ ID NO: 630896 - DNA, 241 bp, Homo sapiens
ctggactacccacttgagtgaatatagatagaagaatataaatatatatacatatatacataatatacataaatattcataaatatatatacacataatatataaatatatatatacataaatatgtatattaatatattaaatatgtacacaaaatctatacataaatattaatatatatacataaatatgaatatatatacacacattaatgaaaggtattaccctgggtagtcacaga

SEQ ID NO: 630897 - DNA, 233 bp, Homo sapiens
  misc_feature (73)..(73): n is a, c, g, or t
  misc_feature (86)..(86): n is a, c, g, or t
  misc_feature (89)..(89): n is a, c, g, or t
ctagtttagggaggcagaggcgcagtgtatgagatcgtgccattgcactccagcctgaacaacaagagggaanatcatctcaaaanaanaaaaaaaaagtatttgcaggatctgcgtctgaaactaggaccgttcacgcttcagaggcagaaagaaacctgtgcagaaaaccggtgtgcgagtctcccacacggactgggggcgccttccgtggggggggggtctccctaaga

SEQ ID NO: 630898 - DNA, 1062 bp, Homo sapiens
ggcccatcctccggaagatacgagaccttcctgaaccattacctctgtgagagagttcatggactcgctccctagaactcccggctgcacgagatgatgacaatccttgtcccttgggacaaaggactcatggggcctctgagtgaccctatcacaggcgaagtccctatgtgtcccctgcttggaagcaggaggcaggtacgtctcagccaggaggtctgctagcaactgtggcaggccggcgagggccggtctggcagtgaggccacacaccagataactgtggaacccacaatcgaggacacgcataccgtcaacgcacattgaagccacgcaagccaggatggtggtccatcgtcgtggggaccacgggctgtgtggacagaccgacgcgcaatcgccccaggctgattgcatggagcgccttatgtgacccgagggtgaccgatgagttgaacgcgacatgcaattgtataatgagtcgagcctcaagcctcgagctcgggattctcgtggcgtgatggtcttgataggcaagcatacagggtggtatagcccagaccgaaaactgggagcccccatcggccttgcagcccgtgagatgttggggcttgcccaggctgacaggattgcgcaacaaggtaaaggacagccccagtcccacagaaaggacgcggggacaccttgattcctttactggcaacttggagaggggtactcacatgcctagagcgtacagctttcacaggaagcggaaaccccaagggcttggagaagtggcggttgacgcacaaccgatccactcagtggggactgaagtgtagccattgaagccggtgggaacggtaggaaccaaccaaggaagttattgctcggacctcgaaattccacttgcgtttcaaagggcgatccctattaccacacgagggtgtcaacaatcccggaggcggccatgaccgggcgtgggtggtggcataaattgtcaagtggactgaaaagtgacgtacataatggaagacgcaccatataaccagaataaagtatagagtaggaatagaccat

SEQ ID NO: 630899 - DNA, 1003 bp, Homo sapiens
  misc_feature (721)..(721): n is a, c, g, or t
gtctccgcgccttatctgccaaagctgcgtgctctgtgactgcccagcctgcggctgtatcccggatcacttcctgggtagtgctccacgggcacgagcctctgattgggctacctgtagattggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgtngggatggtggccgatcctgataacccttttggtgctggacatcctgagcgggctcttccacctcttactcctttcttcccggacaagcctatcacccagtatccacatgcggctgtggaagtaacacccctcctcattgctgggctcaggccatggaaccaatgcccgagtcaccttcagcggctccctctgagtacttccagcgaactccttcttcaactcagcagtgcagaaggcggcgccgtgtccagaggtattccagaacaggctactatgaactag

SEQ ID NO: 630900 - DNA, 308 bp, Homo sapiens
ccggttttttttttccggggcccccaccgttttttggccccggttggtattgcttgcccttaattttattttggggggggggcccccccttaattttttttcccttgggggtttctttttttgggaacttgccaaattttccttttttttccgccttgggggggggggttaaataaaatttgggtccttggggttttttttccccatttaggggttaaccctttttttcccatttggggggtgggctgtttaaattttgactccctgttttaaacccccggggataaaagaacttttcccccctttta

SEQ ID NO: 630901 - DNA, 916 bp, Homo sapiens
  misc_feature (634)..(634): n is a, c, g, or t
gtctccgcgccttatctgccaaagctgcgtgctctgtgactgcccagcctgcggctgtatcccggatcacttcctgggtagtgctccacgggcacgagcctctgattgggctacctgtagattggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaaggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgtngggatggtggccgatcctgataacccttttggtgctggacatcctgagcgggctcttccacctcttactcctttcttcccggacaagcctatcacccagtatccacatgcggctgtggaagtaacacccctcctcattgctgggctcaggccatggaaccaatgcccgagtcaccttcagcggctccctctgagtacttccagcgaactccttcttcaactcagcagtgcagaaggcggcgccgtgtccagaggtattccagaacaggctactatgaactag

SEQ ID NO: 630902 - DNA, 1027 bp, Homo sapiens
tttttttttcctgtttctcttgttggctgtcttgtaataggttgcgtgtttgtcactgtttgttattttattttgtctcgtttgatattccttctttttgtgtgttgtttgtcgttatctctgtctcggtatttttagtgtccttatctgtctttcttgtcctacttttctttctccttctctctcttgtttgtttgttttttctttctttgtgttcctattttttctcctgtcctttttttctgcattcagtcttttgttatggtgcatcttttgtctcgtgcgtttcttttgttcttgtttcttcttctttttcttctgttctttgattatttttgtcatattgccggttttctattcttgtgttctcgttcgatcctcttcttgctgtggttccatgctttcttctattgttcctttccgattttctcttctccttggttgtccttctgtgttcttctttctctcctgccgagtggctctctctcttatgtgcttttttttttttatttcttgtttccttgttgcaattctttttatttttcatttttgtatttatttgttttttttctgttttatctttgtcttttctttctgctgtcactttttctatggtgtcgtgtctttgtattttttgtccctattgtctcatatcttgtttatcatcatatgtctatcgtcttgtaatacatttgatttgtatatttctttctctcacggtttaatcagtaagatgcttatgtgttttcgatgtgcagggtatgttgactatatctctctggattcacctgaaaatattgtgaataacacgtgactcacactcaggcatcttctgggtcacgtcctatgctgcgctggggccgagtggctgccacatgcccccctcatttgcatggctcatcccccactcaagcaatagggccccgcccataggaagacccccagagagagggtcagcaggggggccccagcatgcgccttcccctccaatagcccatggtggggcaggctgttactaccagctccc

SEQ ID NO: 630903 - DNA, 197 bp, Homo sapiens
tcaagcttctaacgatgtacggggacatgcctggctcgtttttaaattttttgtggacatcgggtctcactgtgtttcccaggctggtctcaaactcctgtgcttaagtgatccttttgccttggcctcccaaaagtgttgggattacagggtatgagccactactcctgacctcagattctttttaaaagaaaaaa

SEQ ID NO: 630904 - DNA, 332 bp, Homo sapiens
cgtcttatggcggcaggcacctgtaatcccagctaccaggaggctgagtcaggagaattgcttgaccccagagggcggaggttgcagtgggccaagattacaccactgcactccagcctgggcaatgaagcgagaccctgtctctaaaatcactgaattaaaaatttttaaagccatgcgcgatggctcacgcctgtaatcccagcacttggggaggtcaaggcgggcagatcacctgaggtcaggagttcgagaccagcctggccaagagatgatgaaaccccgtctctactaaaaatagaaaaaattagctggccatggagtaaatggca

SEQ ID NO: 630905 - DNA, 837 bp, Homo sapiens
  misc_feature (1)..(1): n is a, c, g, or t
  misc_feature (304)..(304): n is a, c, g, or t
  misc_feature (308)..(308): n is a, c, g, or t
  misc_feature (312)..(312): n is a, c, g, or t
  misc_feature (328)..(328): n is a, c, g, or t
  misc_feature (338)..(338): n is a, c, g, or t
  misc_feature (351)..(351): n is a, c, g, or t
  misc_feature (363)..(363): n is a, c, g, or t
  misc_feature (365)..(367): n is a, c, g, or t
  misc_feature (377)..(377): n is a, c, g, or t
  misc_feature (392)..(393): n is a, c, g, or t
  misc_feature (400)..(402): n is a, c, g, or t
  misc_feature (404)..(404): n is a, c, g, or t
  misc_feature (413)..(413): n is a, c, g, or t
  misc_feature (416)..(416): n is a, c, g, or t
  misc_feature (418)..(418): n is a, c, g, or t
  misc_feature (425)..(429): n is a, c, g, or t
  misc_feature (433)..(433): n is a, c, g, or t
  misc_feature (440)..(440): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (458)..(458): n is a, c, g, or t
  misc_feature (460)..(460): n is a, c, g, or t
  misc_feature (462)..(462): n is a, c, g, or t
  misc_feature (469)..(470): n is a, c, g, or t
  misc_feature (473)..(473): n is a, c, g, or t
  misc_feature (475)..(475): n is a, c, g, or t
  misc_feature (481)..(481): n is a, c, g, or t
  misc_feature (488)..(488): n is a, c, g, or t
  misc_feature (710)..(710): n is a, c, g, or t
  misc_feature (716)..(716): n is a, c, g, or t
  misc_feature (732)..(732): n is a, c, g, or t
  misc_feature (749)..(749): n is a, c, g, or t
  misc_feature (752)..(752): n is a, c, g, or t
  misc_feature (760)..(760): n is a, c, g, or t
  misc_feature (765)..(765): n is a, c, g, or t
  misc_feature (770)..(770): n is a, c, g, or t
  misc_feature (773)..(773): n is a, c, g, or t
  misc_feature (820)..(820): n is a, c, g, or t
nataaacaaacattcactttatgcctgatgacagcaacactgtgatggggtggcactgtgccccacggacaggtccacaactgaacacatggctctatctctccttttgggcttaaagtttagtgttattttattttacaaatatttacagtcattttgtaaaaaggcagtttttagtagcagaaaattcttctgttttatagtatggtatcacagttactagcgtatctccaatgtcaaaccaagataaacagcatcacaagatgtcacagactaatacaacttccctttggccaggggaaangatntgtntctttttttttttttnttcaaaagtntaacctctaaggngaccggtttctntnnncctcaatatntacaaattcactttnntgttttnnntnttatttttnttnantgtttannnnnattngtttttnttttcccttttntntngntntnttttttnngtntnattttngtttttngtaataatttaccacattataatctatttaacataactaccctcagtaaatatttcataaaatactttattctttttacatttttcttttaaccttctcatttatttttttttttttacaaaatttatctaatcttttatttcaatcttcaattatttacattaacaaccttacaaacctttaacatattatatatatccccttctctatcctttcaaattnttcttnatatatataaaatttnaccacttcacttctatnatnatttaatnataantcaancanacttatcatccacatttataactatctctccctatttaaacttaaanactcttttcatcttcca

SEQ ID NO: 630906 - DNA, 102 bp, Homo sapiens
ggatggtgccctacagttcccgtgccaaggcataggcacgtcagagttcatgtgtaggcgcaatcaggcaacatcatccattcgggcttgcatgtggggcag

SEQ ID NO: 630907 - DNA, 186 bp, Homo sapiens
ctgccccggaacgagaggatccccagcactttgggagagcgaggtcagtgtatcacttgaggtcaggagttagaaaccagcctgacctcaagtgatccgcctgccttggctgccagagtgctgggtttacaggcatgagcctccccgcccggatagtcttgtcattttcttcagcctcagatgtca

SEQ ID NO: 630908 - DNA, 258 bp, Homo sapiens
gattgtaagccgaggcgcgattcattagtccggggccgtgtggtagagggggtgcgcgtcttgctcgtccgctgcccttagtccaccgcggatccctcccgcttgtcaggtgtcggccagcgggtaagccgactggcggaaatgctgagagaggagaagggaaatgttgaatgggctaaaagtggtgcaaacatgagaggagtgcgtgatcccagcaacctgacactagggatcagtctcccactcagcaaatgcaga

SEQ ID NO: 630909 - DNA, 818 bp, Homo sapiens
  misc_feature (18)..(18): n is a, c, g, or t
  misc_feature (135)..(135): n is a, c, g, or t
  misc_feature (142)..(143): n is a, c, g, or t
  misc_feature (147)..(147): n is a, c, g, or t
  misc_feature (150)..(150): n is a, c, g, or t
  misc_feature (217)..(217): n is a, c, g, or t
  misc_feature (226)..(226): n is a, c, g, or t
  misc_feature (272)..(272): n is a, c, g, or t
  misc_feature (296)..(296): n is a, c, g, or t
  misc_feature (301)..(301): n is a, c, g, or t
  misc_feature (372)..(372): n is a, c, g, or t
  misc_feature (453)..(453): n is a, c, g, or t
  misc_feature (513)..(513): n is a, c, g, or t
  misc_feature (515)..(515): n is a, c, g, or t
  misc_feature (526)..(526): n is a, c, g, or t
  misc_feature (532)..(532): n is a, c, g, or t
  misc_feature (541)..(541): n is a, c, g, or t
  misc_feature (552)..(552): n is a, c, g, or t
  misc_feature (586)..(586): n is a, c, g, or t
  misc_feature (598)..(598): n is a, c, g, or t
  misc_feature (607)..(607): n is a, c, g, or t
  misc_feature (632)..(632): n is a, c, g, or t
  misc_feature (664)..(664): n is a, c, g, or t
  misc_feature (680)..(680): n is a, c, g, or t
  misc_feature (692)..(692): n is a, c, g, or t
  misc_feature (702)..(702): n is a, c, g, or t
  misc_feature (747)..(747): n is a, c, g, or t
  misc_feature (754)..(754): n is a, c, g, or t
  misc_feature (769)..(769): n is a, c, g, or t
gaaaagggaagagtgagngggggagatggggagatccggctcccaaggatttcaggaaacacagtggggcacctgatctagcacacattcagagggtagggaggggaagggatctagctatactctgggcatggngcagggnnggtngtncttgctatggaggaaaggagagaggaaggacagaggaagagtggtcccccatctcatctcgacaatntcaaaaganaggagtatatggggacctagctaccagggagggatggatgcaagangggattccaggatctaacagatcnttganactctggatttattcttaagaaacaacctccctcagagaatctggatctgggggaaatggtggtgtcagcnaatctcctttagagactccaaagcaacaccagtttggggttccctgacacctacacaaaatgtggaaatgaagagtttggnaatggtgagtagatccctttgggaagttggtaatgtccctgttctacttaattagactgntntgaagtagagnttgttnactagcggncattcgcaggntcaaagggtaagttgtggcatgcagcacaaagcngtattagagccnccagtaganactagagggaatatggggtttatcncatagataaaattccttaaaaagtttccctgncacaggatgcccttanaccttccatggnggtctaaagnttgacagcaagcaagagtgtgcttctctagataaatgtatgagcnatctaancaagaagtctggcancagatcagacttcctgtttgggaaagtatccagagcccaatttaggaga

SEQ ID NO: 630910 - DNA, 1226 bp, Homo sapiens
actagtactagatcggagggccgccctttttgttttatttttaaaatgaaatcctttttttgcttgggcaactaagtagcttacagaagtaaataagggattcacatttaagaaagaaaaacgagaccgacaagaagcacaaaacaaaaaacaaacagacaacacctaaccaaagaacacaaaaagaaacaacaaacaaccaaagaaatacagacagataacgcccagcgctatcccccgaaggcgcccacatccacgagcgcgcccgcaaccacaacacacacgacacacaggaaccacaaacacaacacactaccaaacacctacaacccacacccagaacacaacaaccaccagcacactccacacacgacaccacaaagacaaagaaaaaaaaccagacaccaacccacaccatagaccagccacaatcagcagcaccacacaatctggatcgagacgcgcggcgcgccgcgcacacgcgcgccgacccgcgcgacagaacgcggaccgagacgcaacgcaacaaccacgcgacgaccagggtagcacactaaaaagctaaacacaacacaccaacgaaaaccgcaggacaacacagaggacagacgagcaagctcgaatcaaaacacagcaacaccccgcaaaaagacaccaaacgagcgcagcccacccaagcagaccagacgcaccagcaacacgcaccccccgaagggaacccaaacgaaccatagcaagaaagaacgccgagcagcagcaggcatgcacgccgccgcaacaacacaagagaaaggacgacagagcggagagagagaacacgacacccacgacgcgagaagacggagcgcacacacgcagcccgacccgacaccgcaagcgcgcatgagaccacgacacaacctaacgcacacgacacgcgcaccaccgagcacgaggcatgaaccaggctaacgcaagacgaccgcgaagaacacaacggataggcagataacagagcccaacccacacgcacacacagcgcacatcacacgacaaacatagaccgcaaggacacctccacgatcgccgcgccgaaccaacccagcaccagcccgagcgcacgagagcgaacacgaacatcaagcaccacccacgagcctacacacaccgacgcgcgaaacaaacatagagagcgaccagacagcgaccagccggaagcggagcctcgcgaccacgacccgcagacc

SEQ ID NO: 630911 - DNA, 428 bp, Homo sapiens
  misc_feature (355)..(355): n is a, c, g, or t
  misc_feature (378)..(378): n is a, c, g, or t
  misc_feature (415)..(415): n is a, c, g, or t
gcaacagagttttgctcttgttgcccagggaacaactagagcataaataattccaatatgatggagaaaatgatagtattaaatgactttgcccaatgccacacagagagaattaaccccaatttcctggcttctaatccaatctctctctctctctctctccacacacacacacacacacacactcacacgcgccacataaacacacacacaatctgtctctctctctgcctctcccctgcacacacacactctctcactcgctcgctttctgtttccctctctctttcccctactctctctctctttctctctctttctctcttcagccctttctttcctccttagggatcancttggcttctgtggcacacagtnggaagggcaagcacctttttggtctttttcacaactnttccagactggag

SEQ ID NO: 630912 - DNA, 124 bp, Homo sapiens
atagagctgagcaggatccccgatcaggcgcattacttgtacccaccctctggtgggccctgacctcggggtctcacctgggctcttccttctttgggtgagctatcatgaaaaccgcgtgatc

SEQ ID NO: 630913 - DNA, 396 bp, Homo sapiens
ctccacccgacggggtgcaggggggctatctcagctcactgcagaactccgcctcccaggtccaagcgattctcctgacctcagcctcccaagtagctgagactacacggcacgtgccaccacacccagcttatttttgtgtttttagtagagacaggctttcactattttggccgggatggtctcgatctcttgacctcgtgatctgtccacctcggcctccccaagtgctgggattacagggattacgggcatgagccaccgctcctggccaagagattatatctgaagtgtaaagtgaacttgcactagatgacttggtgtcctttcctgagagaggaagagggccttttatgttctgtactcttctcccgagtcccaccccgtcgggtggag

SEQ ID NO: 630914 - DNA, 362 bp, Homo sapiens
agttgaatgtggtttgtaatgtgtatatgctgtgtgctgtgaggtatgtggtgtgtgttaaatgtgtgtggtgtgtgtgtgtatactgtgtgttgtgtgtggttgtatatgtggtgtgtgtagtgtgtggtatgtgtatagtgattgtgttgtgtgttgtgtgtaatgtgtgtgttatgtataggtatgtgtgtagtgtgtgatgttggtgtgcatgtgtgtgttcagtgtgtatagagtgtattgtgtggcatatgtatgtgtagtgtgcatgtatttgtgcggtgtgtaatatgtgtggtatgtatgtctgtgtatggtgtatggtgtgtgtatgtggtgtgtggtgtggaggtagcact

SEQ ID NO: 630915 - DNA, 502 bp, Homo sapiens
tcaaattccacaaaatccacaggggggcggacgggtaatacccactatgggaaaacatcccgtaaaccggccggtggccaggccatgggagtgacggaacgggtgacatcggttggagcatgcttggtgtggcgggtaggatgccaccgtggtgcatacacttggtacatcgggggtgaggggagggtttcctaagaataatggggggagggtaaaatggggatttttgggtggtccctttttggagggggtgggggggtatagtactcagcttatgccctaaaatactatgtataaaacccccgaaagtatggtgtgggtgtgtacgtgtagagtgtgtgtgggtatccgtcgggcagtaaaagcttggtctccgggaccttagggaatcctttcctcttttccctccagaagtattggtcacaggattggtaattaagagctctactaagtgggttaccatgaccatgtggcagcaacccttatgcttctaatccctaca

SEQ ID NO: 630916 - DNA, 202 bp, Homo sapiens
  misc_feature (5)..(5): n is a, c, g, or t
  misc_feature (18)..(19): n is a, c, g, or t
  misc_feature (24)..(24): n is a, c, g, or t
  misc_feature (57)..(57): n is a, c, g, or t
  misc_feature (78)..(78): n is a, c, g, or t
  misc_feature (114)..(114): n is a, c, g, or t
  misc_feature (123)..(123): n is a, c, g, or t
  misc_feature (147)..(147): n is a, c, g, or t
  misc_feature (150)..(150): n is a, c, g, or t
  misc_feature (170)..(170): n is a, c, g, or t
  misc_feature (178)..(178): n is a, c, g, or t
  misc_feature (188)..(188): n is a, c, g, or t
gctgncccctggtttggnnccttncctgcaagttatcttccaccttttcacttatgnccttcccatttcaaattagancctaaagtccttcaatcactttcttgcctcaatggnttacacctnccttgacaaccacaaccctgcgcnttntggctcaatataatcactgncttgatgncctccaactnacctatggatatct

SEQ ID NO: 630917 - DNA, 386 bp, Homo sapiens
gaccgtctacagaggaaagccctgggatcgattatgtacaagttggttttcctcctttgcttagtattgtaagcagaatgaatcagacaaccattactagtgtcttggaatatctaagtaattggtttggagaaagagactttactccagaattgggaagatggttttatgctttgttggcttgtcttgaaaagcctttattacctgaggctcattcactaatccgacagcttgcaagaagatgttctgaagtgaggctgctggtgggcagtaaagatgacgaaagagtcccagctttgaatctgctgatctgcttagttagcaggtattttgatcaacgcgatttagctgatgagccatcttgatggcgccttacctcctaggga

SEQ ID NO: 630918 - DNA, 752 bp, Homo sapiens
  misc_feature (345)..(345): n is a, c, g, or t
  misc_feature (389)..(389): n is a, c, g, or t
cttcatagctggtagtcaatgatgtatcggacagatgtggtgagggctaggaaaagagtttgttgggaaccctgggttatcggcctcgtcatcttcatatccctgattgtcctggcagtagtgcattggcactcactgtacattcatgtgagatagtaatcaaagagaagacctacaattactatacgcacattgtcatttacaactgacaaactatatgctgagtttggcacgagaggcttctaacaattttacagaaatgagcctagagacttgtaatcaatgggtgaaagaatgccatttctatcaacaagtctcccacttaagcgcgaagcaattctgtcnaagtctctaggttgatccaagttccagtcaacaccaccagagcnatggaagtgttgcgttccatatgctgttgatcttgtagcatttcactctactgaggatcctgaaactgtagcatacacacattgtctcaactttgtttctcacatgacaaagctgcacagatgcgtgtaggagcccctaaagtagatcctcactcagttcaaaattagtaccaatcatgaagacagaaactagacagctatctaaaccattgctgctggtaacacgaagcaagtaaaactctaggtcagagtctcaggatcgtaggtgggacagaagtagaagagggtgcatggccctgggaggctagcctgcagtgggatgggagtcatcgctgtggagcaagcttaattaatgccacatgg

SEQ ID NO: 630919 - DNA, 405 bp, Homo sapiens
gaccagcgtaacaaccaagtagttcgtgccttcgcgggcatgtataggaagacctgtatgggaaggacctatagcgaagaggcattgcgtcgcccaaagacgatagtttgctggcatgtatcagcacaccgtgttaggctcaggagaatgatccatcactagcaaccgatagaaccgtcgacatggtgaccatggactatttgtgccactccattcatctattattggcgagacacgtcactttttgaacaatcgtgctctgtgatgcacgtgagctcataaaactggcttctcgtatatggttcgcttatgagaaaatgtacatcgaaaatctagtgggcgtataacagccccctttgaaagggaaaggtccttttttcaatcatgtttcagcttacgccacag

SEQ ID NO: 630920 - DNA, 608 bp, Homo sapiens
  misc_feature (13)..(14): n is a, c, g, or t
  misc_feature (101)..(101): n is a, c, g, or t
  misc_feature (171)..(171): n is a, c, g, or t
  misc_feature (480)..(480): n is a, c, g, or t
agcctttcagtcnnggacgggcgcggaagaacgccttcctggaaggaacgccgcgatggctgcgcagggagagccccaggtccagttcaaactgtgtatgnggatgtcgggtcgaaatgggttggtaccgtggaaaaaacgacctttggtgaaaagcgtccattgtgaccntggtgtgaaattttggaggaaaggacaagttcatgtgttagcccaaccttgtgggggtgttgttgcggagggtttcatcccccttagttgttccacacccaacagaggaccctattagttcaactgttatgggacacaagccgggccatggagacaattcggggtggaacctgagcagattgcgctaattttaattaatttcccaaagggcccccagtttgtttgccaattcattcaattgttttgagtgtacacattcggagaggttaaccttaacagggacatgttgttggctcttaaatcgtgggncaattaggaagagattccgtgggtaaccggaagcgtgttggtgcacaaacattcccccatgtgtcgttgtgtgtgcgcaaacaaagggtggatacttaagggaccgaggaacagctgaagcgcgaaac

SEQ ID NO: 630921 - DNA, 575 bp, Homo sapiens
  misc_feature (17)..(17): n is a, c, g, or t
  misc_feature (28)..(28): n is a, c, g, or t
  misc_feature (218)..(218): n is a, c, g, or t
  misc_feature (230)..(230): n is a, c, g, or t
  misc_feature (250)..(250): n is a, c, g, or t
  misc_feature (281)..(281): n is a, c, g, or t
  misc_feature (423)..(423): n is a, c, g, or t
  misc_feature (509)..(509): n is a, c, g, or t
  misc_feature (519)..(519): n is a, c, g, or t
  misc_feature (533)..(533): n is a, c, g, or t
  misc_feature (571)..(571): n is a, c, g, or t
tcccagcagccaaggtngcgcccctggntctaagaaagatccagtctctgtaagctgtgtatgggctcaggcctaaacctgtgtgaacccaacaacaaagagggatactacggttacacaggcgctttcaggtgtctggttgagaagggagatgtggccttggtgaaacaccagactgtcccacagaacactgggggaaaaacccctgatccatgggntaagaatctgantgaaaaagattatgagttgntgtgccttgatggtaccaggaaacctgtggnggagtatgcgaactgccacctggccagagccccgaatcacgctgtggtcacacggaaagataaggaagcttgcgtccacaagatattacgtcaacagcagcacctatttggaagcaacgtaactgactgctcgggcaacttngggtttggtccggtcgggaaaccaaggaccttcttgttcagagatgaacagtttgtttgggccaacttcatgacaagaaacacatnttgaaaattncttaggagaagatntgtcaaggttgtgggtaaccctgagaaattctccaccncatc

SEQ ID NO: 630922 - DNA, 390 bp, Homo sapiens
gtttgtacgtctacacgtcctggtgtgagaagttggcagagatcatctggcagaaccggcagcagatccgcagcgatagcacctctgcaagcagctgcctatcccggcccagtgaaggagatgctggcggaaggcaacgccaccatcagggacattatctcagccctggtgaccggcacgttcatcattgagaagcagcctcctcaggtcctgaagaccccagaccaagtttgcagccactgtgcgcctgtggatgagcgggaagctagaacgttcacattgaaccccccccagggtaaaggccaccattcatcaggtgagcagcaggccaagttctctgctcaagaacgagaacacccgccgtcattcaggggtaccgagctcggaatc

SEQ ID NO: 630923 - DNA, 481 bp, Homo sapiens
agacatctcaaaaaaaaagaaaaaaaaaaagtagcggggcgtggtggtgggtgccggtgatcccagctactcgggaggctgaatgaggaaatctctggaactcagaaggcggaggtggcagtgagccgagatggccctacggcactccacccggggtgacagagcgagactctatctcaaataaaacaaaacaaaaaaattattttggacggtagtcacccggtggtgctgtcaaatagtaggtcttattaattctatttttggtacccattaatcatccccactttcctccaaccccccagaactggttcatcttataagtgaaagtgtgtacccttggaacaacatcttcccaatcccttcagggcccagcttcgggtaaccacggtcctacgctcggcttccatgagttggactttttttagattccacattggagatcacgcagtattggtctttcggtgtcgggcttatttcactg

SEQ ID NO: 630924 - DNA, 386 bp, Homo sapiens
gactcctcaggcggggagagaggggcgattcctccagcggccgggacaggtgcaatgcctcaggaagtgggcttggtcaattaaagcttgtgaaggtgtagataagggtgttagctccttcatcagtctgagggtagcaaggacagttccactgcagaagcagtggcagagaggctttcagttgcccctggaggctctgtccagggagtggctgagttgctactggctcgacagctctggcaggggggttaggtagaggcccaggcctgcaagacttgcctagtgagaagatacaggaatgggaacccaggtaacagtctggccacttttccatagggccgctgcagtatgcccagggcccacttcagtctctagtagcctcagat

SEQ ID NO: 630925 - DNA, 86 bp, Homo sapiens
ggattcagttgacattcaggttgacttttgttacaaagaatttagagggggccaggtgcggtggctcacacctgtaatcccagcac

SEQ ID NO: 630926 - DNA, 140 bp, Homo sapiens
taggggaaacaagattcatgttttattcccccagagaaaactcaaaagtaggaagctcctccttccgggaaaactggtcacaggtgactttcaggtctcaccaaagggaggaggtacagaaagagtgcgtgggtgtttgt

SEQ ID NO: 630927 - DNA, 107 bp, Homo sapiens
  misc_feature (3)..(3): n is a, c, g, or t
tantataacttcaggacgtgggttcccattcctacttactcaagccaatccatattggcattacttagatgggactgaccccctcatggggtagagctttggtcgct

SEQ ID NO: 630928 - DNA, 1078 bp, Homo sapiens
ggcgccgtgcgcataggcgaacgtcggtcaaggcgcccggcgcgacggaaggccatgcccgggcctggtgagccagtgggggctccagtgctgcttgtcaacgcaggagacgcggatagtagacacggagtctccgtagacgcggacgctgcgatggtgccagggtgttgtagccactgggtaccgccgggcgggtcgacggactcgatggctgagggatgctgggtagcgatggctacttacatagcctactggatggtgtgaaacctgtggcgctccacctggtgagccatcctgcacgtgcatcccaaatcgcgtccaaatgacccgaaacgtggtctggacgtagtgcagatctcatgaacagctctacttgggctaaagttcccttagtatcaggtgcctggattaccagtaattgggctatggcattggattgcgccgtgagtgttgacctttagttgttgctctgcccgttctttgcctgtcttatacttgcctcccattaaattccatggttgccatatcggtccgcctttgtgacgttcggatgccaaaggtattcctctcgcgtgcaaaagacagggcggcgtcggccctgcgcccttgtccccctgaactctcgtccttggatgaactcccagacgggttgtggcaacggaatccctgctggtccccggttcaagacctactcggtccctgggctccagcttcaaaattcaccaggtcctgtcggtccgacccattatttttttggccgaggaggagagatcacccacggcagagtacatcactggcgcacttcacattttcacccaggggacttagggtccgcctagcaaggaagacttgcccaccatcctgagtaccgtgtggaatgcttcctcgcgttgcacctgccctttggcttcgaactagggtatccttctgcctgattgaccacttggacacttgtcattcccgttgccacctatattctaaggcggcctacatttgctacactcacaaaagtcggtcgcgtgcggccgacaccgtgggcctattagcacctacccgttccgtctacacctgcccgcct

SEQ ID NO: 630929 - DNA, 1819 bp, Homo sapiens
  misc_feature (1819)..(1819): n is a, c, g, or t
ggttggctccgtggtgcagtgccgagactgcgcggagggctcgtccgatcagcggcgtgcgtgctgtgcatgtggggaggcctgcatgctgccatgtgtgtgggtgctgttagacatgtgctgctgtgcgtgcctgaggctgatggtgtgctgtgcatgcaggtttatcttgtgtcctgctggctgaccgttcgtgcctgtggccctggtgggttggtgaagtgcctggtggcagtgggtgtctgtcccgtgtggtttgcactggtgtgcctgctgtgtgtgcgtgtggctcgcctggcctgatcggtggttcgcacgtgatgtggccttggtgcccggcttgaaatgtgagaatgtgctgcctgtcaggtcagcccagtgcccttgcctgcctgggtgccagctttttgacctgacatgatcggcttccacctgactggagggtgcccccagccttagagtgaacgagacgggcagagcagggcagagatgtgcggcgaagagcccgcaggaggaagggccctgcaggggaccggaattcggacgagagcagcgaacaggggacggcagaattcgtcgccagcatgtcgcaacagaatggtcattacccaatgtgaaatgtcaacctgagtagcccctggaactgcacaccctttggattatccttccccaagatctttggtgaaatcgaagatccaacgcttgcctttaggacaccaggacaggcgcagatacacaagtgtcaacagacaagtcatagcttttgtctcgcctctgggaagtctctagctgatggggaacgcggatgtggcaggggttggcgccctgagaccggacagcacatcccctgggatgagaagacaagcgcaccaagcaacggagaatgtgcctatgggcggatgaaacaccatatcatttacaccgcaggagaacagccattctgagggacagcacgccaggcgcatagttgtatgcaccccaaagacttcaattatcaagaaagaaacatggagagttaggtgatacacggcgacatagccccacgaggtaaagtatttgcaatagatacgctattggaggatacagccgtatggatgcagaaagaaagtagacgcacagagaccgaacgccgtgacgtatgtaacacgataaaggtattatcttatccagaacggaacacagtaaccagaatagcaacataccacctcagattacgacaggagaaagcagatattgcgtaggtaacgtctgtggcgaacttatatacgagaactgttaggctatataacttaaagggagaagggcaaacgtacgaagagaatagagtaactatgaagcagttgaggtctatcaacaaacacgacgagaacaagcaaacctacatctacgtacgaaacaaacacaattcgaatactcaaaagatacactttgtctgtgtccaaacagtgattctcacataactaaacgaacactcgatcaaactactgcccccgcatcatcatgcttccgatgagagtgccacactgacagcggccatacatacagcgccatgctccgctcgtcatggaacagcgatgtggtctgacaccgatcagagagcagacagactgcgaaggacacatcgcacaaagacgagtacaaatcgggaagacgagcacaagcacgtctagtacagatcaggcggacgcgactatcaaatcgatcggaacggtaacaaaatcaaatagcagcgataagtgcgagaaatcactgtagcagtaaagaatcaagagaccaatcaattaatcatattattttcatttagtcatgcatcgagtgn

SEQ ID NO: 630930 - DNA, 162 bp, Homo sapiens
gaatatcatggtaccatagcacccaacagtgatggcacatggtaggcactcaaatactgggtctcttccactttctatggtttattcgtgttcctttttacatgcaaaggctccctttctcttagtttggtttagtttctgagcacaggatctcatctctgt

SEQ ID NO: 630931 - DNA, 214 bp, Homo sapiens
ccaccggtcaggtagtactggagagagtacaaatatatttgaggttgcattgtggatgtcactttgagtgctcttaatttggttattgtgaaaaaaaaaaaaggtcgggagagaaaaggcctttctgggaacggactggataatactatgcctacatcacctagggccccaaacatagctagcagaaatctagataagatatacaaataatcta

SEQ ID NO: 630932 - DNA, 307 bp, Homo sapiens
atccccggctgtaagcatggctcctgcgggtgacagaacttctgggatctggctgcgctattactccctggagcggtagccacagacatgtacctgggaataccgggacctgagcaccgcaggctgctgctcacccagatgctaccgagacatgtgtgcccggcaccgcgcccgagcccactccattcagatcatgaaggttgaggagatcgcggccagcaagtgccggctgtcgggtgtcatgctgtccatgactcccagatcatgttcccgctgcccgaccgggtcctgcgccgtcgcctacgca

SEQ ID NO: 630933 - DNA, 91 bp, Homo sapiens
gttcactttctacacttctcacattaatttgctgtagagaaaagaatttttttccattccttcctggttgccacagtatcttctcccatac

SEQ ID NO: 630934 - DNA, 864 bp, Homo sapiens
ggcgcgggaaggcgcttgtcgtggcggcagccccctctcccgaaaacgcttcctctgacgcggatcgggccgctgggagacttccccaggcgtccgcgactcctggatctggctggagagagggtaacatggcagggagctgagaggttgtcatctttgggaagtggcacggtggcgttactttgggaaaacagcgccttgagggccttgcaggaggcccgacctgggaaggctggcgaacgctaaccggagggtttttcttccagacttgattccgggatgttgagatctttattcgaaatagactagcattcgagtcgcctgtgatggagggagttcctgcaccgtaggcctggcctcatttattctgcaaatgtttattgggtccttgccctttacaagatcctgtgctgtgagcaggatcagggctttcatgtggaaataagtcggcctttggttgaccaactgaaactcctctgaatggaaaatcaagaaattttcggaaaacttagtacaatgttcaatgagttgcatataagtattccttgtctaggtagcctgaactttgtgaacttgagattcctgcaatattgttgacaattctagcttcaattttatcaggcctgtttaaaatctctgatgactgtcagattgtcggtcaattattactccctttgggctctcagtaaatgttcctgaaatccgcggtagaggttatcttcctgaaacatttaccacagagaccaggtcttaccagtgggactccctgggggatcccagtttacaaccaatgttaaatctaataggaatgtgttttcaaattcatccttactatctctcacctgggccactgggtgctgtcct

SEQ ID NO: 630935 - DNA, 437 bp, Homo sapiens
gcattcagttttaagaatggaatcatccaaaggaattcctttttttgaggttggatgttgcagctagtaaaggatattttgctctgttcagattaatgtataggcagttgtatttatggaagaaggagtcattaatcattcagtatgattatgtgaaaatttattaagatttgattagatgttgtaattataagctaatatataggtggacatacagtattatggtagaatagggatcaatgtatgtatagtactatagatatatatttctgttaaagtagtttattctatttaattagattcattctatacatgatacatttagttatgattgttatagattttacatgaatttcaataaaaaaagattttctataatattagtttgataatgttgtattgatattgtatgtactaagaattatagataatggaag

SEQ ID NO: 630936 - DNA, 356 bp, Homo sapiens
tatgcgtgtgactcgcgcggatgtgcccaaggaaaggcagggtggggcgaggaagcgggcctcctctctctgtctgggcccgagctcatgcctctcctatcccttatctccaataccccatggctcttcgtcctcagttcagcctcgtgttgccccatctcccccctctatatccacctctcattctccatggctgtgtctgtttccctagggttctctggtcgacccctatttctcccttgtcacctcagtcgctatatccagctttgggggatccgtctagcagtcgaccctgcacggcgtttgcaagcgttgagcactggcctgatcgttggacaacagtccgtagacctggg

SEQ ID NO: 630937 - DNA, 139 bp, Homo sapiens
taagttgaccgcacatatcaatatactaacgaccccaatgtatgcccatgcagcatgtgacaagggccaggtgcttgtgtttacctgtacttattcaggcactccggtcaacttgtctggagtacggtcaacttgtctt

SEQ ID NO: 630938 - DNA, 364 bp, Homo sapiens
cagttcacttcatcctaaatgatgtcatgtcttaactctaggctaagagaagtttgaaataggtgatggccaggcgcggtcgtcacgcctgtaatcccagcactttggaacgccgaggcaggcagatcacctgaggtcagcagttcgagaccagcctggctaacatggtgaaaccccatctctactaaaaatacaaaaattagccaggcatggtggtgggtgtctgtgatcccagctgcttggaggctgaggcgggagaattgcttgagaattgctgagaattgctgaggcggaggttgcagtgagccgagatttgccactgcactccagcctgggcgacagagtgagaatctgtctcaaaaaa

SEQ ID NO: 630939 - DNA, 1306 bp, Homo sapiens
acacataataaaactacccacttgttctcaggcgtgtttctcgggggggtctcgtcaaatagatcgctggctgaatgacctcttacttatagtaacctaatctgtgaagaaccaatctggcaagaagactatgcatgtaaagttgtagtctggtcactagcaatactggcgactagatgctagtgagtacaacagcagtagatgcacatgttgtgtaagactgaggtcatcatagcaatgctcataagaatgaccattaggcaatgtgacgcattttgattctgcgagagtttaatactttatggattatacctttagtccttcgctccttcctttacaaaagttgtgattcgcgcaattgtggggatctgtggcacctcgcgcgcatattgtatagccagcctcccaagtgtgtaagggagtagcaaaatcgtttaggaatatccagatgttcttagcaatgtgtgacagagacttcccgaagtttggtgggcgagtgtagaacattctatgggcgtccctgagatcaccctaacaaaccttcggaaaaccccccaaagcacgtaccgcagagcgcatatcgggggaaatctggggcacacttgggggccttccgcgaggagaaaagaggtgtccctctttgtccaaagacaccgctcccactttgaagcacatacaagctcgctaacaggggcggtcttcatctcaaagagaagatttctaatttgttgctgggacaatcttcgacgcgccatctgccacgaccatagcgagggcaaaaaaaaacaccagagcgcgggggcaaaccatagcagacgacgaacaccccaaaaattcgggccgaatcgcgcacgacacggggcaggctacacacagaggatacagacaagcacgaagaagaggcgcaagcgaccaacactccgggccacagcgagagcaaccatcagtcggaccagaggccggagtgacaaaacaaacggccgctccagttggcgacaaacagccccaccacttggcgggaacgacgcacaaaaaaagtgggggcaggagcccactaccaacaggaggacgagccaaccctctagacagcgaaagataacacccaataggtaccgaaaacagccgacgatgaacaaccaacaacgcgccgcagatactgatcacaggcaaactatcaacgaatcaactgcgtggccacgaaagacgtcgtcaggcccccaaaacggccgagcggtgcacagacaacacacaacgccaggccgagccgaagcaagcacaccgcacgccacaacgcatggcacacatg

SEQ ID NO: 630940 - DNA, 186 bp, Homo sapiens
tctgtggccgtaacaaggctacgtccgccatggacagcatttctgaggagcggtccatggcggcgattcgacaggttgcgtcagacagcattttgatcatcgtgtcgcataagttgaagacgttggcaacagcggacgagatcatcgtcttggagtccggacagcttactgaacgtggcccactag

SEQ ID NO: 630941 - DNA, 167 bp, Homo sapiens
ggtctacagcaactattagcacaagaacgcgggcaatgtggcctggaacaactccagcttcgcctaagagccgcagggacccacgctgtctgggctggctccacccgggaaccagccgcacgctgtgttctagggccgcccacccaaaccttctggtggggagaaaa

SEQ ID NO: 630942 - DNA, 221 bp, Homo sapiens
catgcagactgtgagtgcgttcgtacattagagtttgctaggcagaatagtaatgaggatgtaagtccgtgggcgattatgagaatgactgcgccggttaaacaacagggggtttggatgagaatggctgttactacgagggctatgtggctgattgaagagtatgcaatgagcgattttaggtctgtttgtcgtaggcagatggagcttgttataattat

SEQ ID NO: 630943 - DNA, 684 bp, Homo sapiens
atttaattctccctggggtatgccaagaagggttgaaatattccaggcgtccttcttttgaccaagaaacccggtggtaccttttccaagccctgcttaaagagaatataagtgaagccacctgcctagttaggccggtatctttagaaattcttaaaggctcatcctctgaatcccaaaaccagccttgatttgttaaagcacacacttgcacaaaaaccagtgatggtggcattaccatttcctgggtcccaaaaaaaaatttccaaaaagcaaggacttcgctttttgccaaagcttttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgcccaagctaatctccaaaatctgaaatgctactccaatatcagaaaaaaagggggaggtggaattatatttcctgtgattttaagagatcatgcacatctctgattagttcatatatgtctagtgtgtaataaaagtcaatgaactctcaa

SEQ ID NO: 630944 - DNA, 781 bp, Homo sapiens
ctaccggcgagcacagctagcacagagggactcggccagttggctacaggccgccccgcggccaacagagaggctctcctccgtgcacatctcagcgcctggggagaagaggaggattgctcacgtacccaacccccgactggctgccgcccccacaggtgccaagagggcgctctctgccagcaggcagccaggcgtcccacggccccgaacctggcagccagccactgaagacacgcacattgtcagggatggcatctaagacaaccaccaccgtcacccccaagcgcatcgcccacagcccatcactccagagtctaaagaagcctgttatcccaaaagaatttggcggcaaggttcccactgtggtccgccagcgctatctcaacctgttcattgaggagtgtctcaagttctgttcgtccaaccaggaggccatcgagaaggccctgaatgaggaaaaggtggcgtatgaccgcagtcccagcaagaacatatacctgaacgtggcgtgaacacccttaagaagctaaggggcctggtccccaacaccgtgcccaacctcagcaaagccagtggccgcagggttgtgtctcatgaggttgtactggggggcaaatttggcagcaaaaccagcttctcattgagccgcccagcagtccgcgggtagaggagctgaaagcactgacacaccagtgccctgcgggactgcctgtacagcgctcagggaatgtcctggttcactcagagcccttaagggatgggttccctttccccacaa

SEQ ID NO: 630945 - DNA, 391 bp, Homo sapiens
aagttccggatcatgttcactggcagcctcacgccctagatccaaaaccacaacaagacagcagaacactgtgtaaccgcattgatggcaactagctagatattaacaaaggaggaaactgatttttttttctttttttcctctgaaatcagttaaagctaattaagggaaagtgaattttgaatgtccaaatagaaagaagctagtgatcattaggctccttcattctctaaatttgccaaagttgatggtaaaaagaaaaagaaattgtagatattctatatccttttactcttagtctcttgggagaatgagagactgagaccctctttatttcactttgcaagattgtttttaacatcctagataggagaatgtttgttctagtaaa

SEQ ID NO: 630946 - DNA, 181 bp, Homo sapiens
ggggcaccctttttccaaaatgggaaaaaaaaccccggtgggcgggggcccctttccccttcccccgggccctcccccccccactttggggccccctttttggggggggttcccccccgccccgggggccaaaaaccttttttttttttaaaaaaaatttttttaaaaatcccgggtttta

SEQ ID NO: 630947 - DNA, 111 bp, Homo sapiens
ccagcggcgcgttgctggttgaagtggtgtattcctggcccggcattggccgtttgatgtatgacgcgctggcccagcgtgactacggcgtgttgatgggtggttttctgg

SEQ ID NO: 630948 - DNA, 184 bp, Homo sapiens
  misc_feature (37)..(37): n is a, c, g, or t
  misc_feature (47)..(48): n is a, c, g, or t
  misc_feature (109)..(109): n is a, c, g, or t
  misc_feature (180)..(180): n is a, c, g, or t
gcgtcatggtccgtctgctccggagccgtgacgcagnactcgttggnntcctgtggttcgtctcagtcactacaggaccctggggggctgttgccacctccgccggggnagcgagtcgcttaagtgcgaggacctcaaagtgggacaatatatttgtaaagatccaaaaataaatgacgntaac

SEQ ID NO: 630949 - DNA, 235 bp, Homo sapiens
tccggaaggggtttttgcttggggccccccccccggggggcccccccccccttttttttttcccccttgggtttaaaagggggaaaagggggggggggggcccttttttggggcccctccccctttcccccttggggggaaaacccccttttagaaaacccccccccccccccccccttttttttttggggttttttttgggggggggccccccaaaaaaaaaaaaaatttccca

SEQ ID NO: 630950 - DNA, 139 bp, Homo sapiens
agaaaccatcttatggttgcagaatggtggcataaatagatacaaaaaaagctactatggaattcatgacaagcagatttcttctgactatagagtattctataaaggcttcccagatatggtagcatttgttctaaga

SEQ ID NO: 630951 - DNA, 1370 bp, Homo sapiens
gcggcacgcgctgggcgcagctattctgtgaaagtttttctaagcacttagtgaacgaactgaacggagtcctgcactctttcttctttctctctatcttgctctctgctcttacacaaacgccacacacttccctcgtgcctctcactagcgctgctccctgcactttgcaggtgctacgctgaacactctttgtgccctgtctcaccgagcactgctaagtgctcttctagctctccctctagcacacatcacgcggcttggcggagcggcggcaacgggtcgttgtcacaacacactacaccatctgtgcacacacttctgtgaaacaccatgccacgcctagcacggtgacggtggaactatcttactatcttctcagctcatattgtgctgtgcgcgtggctatctacaacagacaattcacccccccagtgtgtacactttactgtggctgaaaacagcccctgtggactctgaggatggactcaacgtgtgtagacccacttgatgggaggtgtgtgtggcaacagcgggcagcgcacaacagttacaccaaaatagttcccaccagtgtttccctgtgtgaccactctgtgtcgtctccaaggaagcacagagtgtgtggccaggaaagtgtgtacaacgtgcgcctcctatatgtgcgtagacgcaaaagcgtgtattatagtgcagtcttttatacaaatattacacatcttctacgggttgacagcctattaatctatctgtggcgtggcatccaatatcttcttttttcatcaaagggaccacaaggcctccaaatttttctaaaacacatctgtgtgctggtgctatagaaaattcttctccccccaacaagtcccaaaacaccccccgctataaatcagctaaagacaacacactgtaataaggtttatctaaatatattgttacacaaacggctctccccatcctattgacgttgggagaacacccaaattaataaaaacgggatgggcaaatctatccattgaggatgtgcgacacacattttagatgcgcgataaaacactataaaccttttgtgggccaaaacaagctattttaaacgtatatccatggagcgagaactatccccatcgtgtacacatgggggtgattggggcaagaggcttctaaaaattaggtacctggcgtgcaaacgacaaatgtttcccgagctacaatataaccatatatatttcaaagtgggcttgcagaatataacagtaacgaccgagtggggcggaacatatctagataaggatagtaaagtgatactattctggcacatactaggtcatgtggtcacccccactatactgataatatgtctcacaaccaag

SEQ ID NO: 630952 - DNA, 870 bp, Homo sapiens
cgggggcgctaaagtcgcaggtgcaggccgggaaggaagatccggtgcggggcacaggatccgtgagctggatgcccccagaagtttacccactgtaaaaaaccgagcaagtctggataagtgaggctggctccatgtatccagaatcaacgacgtgtgctcccctggctctgtgctctcgctgctggcagacgggctcccccgggatgatctacagtactcggtatgggagtcccaaaatgacagctccagttttacagtgaacctgtgtgcaatgtcttggcctgctgggtctcctgcctgggacttggaacatgggtgaccttcggaggccagatcaccgatgagatggcagagcagctcatgaccttggcctatgataatggcatcaacctcttcgatacagcagaagtctacgcagccggcaaggctgacagtgtgtactgtggacaacatcacttcacgaccgaaaggatggatgcgcggtccagcctcgtcatcaccaccaagatcttctgggcgcggaaaggctggagactggagacggggcctgtccaggaacgcacataatcgaaggtctgaaagcttccctggagcgactgcagctggagtacgtggatgtggagtaagccaaccgtccggagccacaacaccgccgatgcgacagagaccgtccgcagccatgacccaaagttcatcaaccgacgggacggccatgtacatgcagggcaacatcaacgcatctgaagcaaccaaggaagaaccatgggaggccctaacaccagaaggaccaggcaaccacaaccctgaacccgccccaatatgccaccaaagcaagaagacaacccacatgacccagcgctgagacca

SEQ ID NO: 630953 - DNA, 368 bp, Homo sapiens
tcattttctaagtgtgtcaagttgttttgttttttttatttgcttgtgtgtttgttttttgagactgagtctccctctgtcgccaggctggagtgcagggtgtgagctcggctcactgcaacttccaacttgctggttcaagtgattctcctgcctcagcctcccaagtagctggaattacaggcatgtgcccctacgctcggctaattttttttttttttttgtatttttagtatagaccgagtttcaccacgttggccaggatggtctcctcctgacctcgtgatccacccgcctcggcctcccaaagtgctgggattataggcgtgagccaccatgcacagcaattaaaccattttagagtacac

SEQ ID NO: 630954 - DNA, 338 bp, Homo sapiens
ttgggactcattcaggatactacatacagcaaaggctcaagaatcaagctttgatgggccatcttaaaccatagggggagagcagtaagccagtgggctcagatccaaatcacgggccgggagtggggtgcaccgtctctggaccaagagcggaaggtgggatcccccagggaaatcaggacatttggccggaaggaggaggagcagaggctatggagacagagtcaggtgctcactataccaagaaacgaatcagacccggggtgcggacatcttcggtgggtaggagagatctctctcttcctttctcgagggcccctcgtgccttgaaatgcaac

SEQ ID NO: 630955 - DNA, 466 bp, Homo sapiens
  misc_feature (1)..(1): n is a, c, g, or t
  misc_feature (119)..(119): n is a, c, g, or t
  misc_feature (132)..(132): n is a, c, g, or t
  misc_feature (151)..(151): n is a, c, g, or t
  misc_feature (159)..(159): n is a, c, g, or t
  misc_feature (165)..(165): n is a, c, g, or t
  misc_feature (194)..(194): n is a, c, g, or t
  misc_feature (202)..(202): n is a, c, g, or t
  misc_feature (206)..(206): n is a, c, g, or t
  misc_feature (209)..(209): n is a, c, g, or t
  misc_feature (217)..(217): n is a, c, g, or t
  misc_feature (221)..(221): n is a, c, g, or t
  misc_feature (239)..(240): n is a, c, g, or t
  misc_feature (244)..(244): n is a, c, g, or t
  misc_feature (247)..(247): n is a, c, g, or t
  misc_feature (253)..(253): n is a, c, g, or t
  misc_feature (255)..(255): n is a, c, g, or t
  misc_feature (263)..(263): n is a, c, g, or t
  misc_feature (270)..(270): n is a, c, g, or t
  misc_feature (294)..(294): n is a, c, g, or t
  misc_feature (298)..(298): n is a, c, g, or t
  misc_feature (312)..(312): n is a, c, g, or t
  misc_feature (314)..(315): n is a, c, g, or t
  misc_feature (337)..(337): n is a, c, g, or t
  misc_feature (412)..(412): n is a, c, g, or t
  misc_feature (434)..(434): n is a, c, g, or t
  misc_feature (441)..(441): n is a, c, g, or t
  misc_feature (445)..(445): n is a, c, g, or t
  misc_feature (449)..(450): n is a, c, g, or t
ngtggtgtcacgtgggtaatggctaaatacgttctgcatatgaactgaaaaaaagttacagtctacacacatacaaatgtgaagcacttaaaatgtgattttaactgataataaaaganaatgtccattttngggtatagtgttaaaaacntttctgtnataaantcataagaccacataaaaataagctttancatatgcncaangcngttttgtnaaanctactaggtgcccaagtnntaantantttgcnangttgtgtntaaacanttcctattgttcggcatcattgtnaacntcagcacatgtgtnanntgcagcaaagtctgccattacnttttgttttgccaatttggattccttttatccaaaggcggaccagtggggtacgcggccaccattttggcaggtngggtctttaaaattaggggtancggtgcnggtngggnntgcgaggaattcctag

SEQ ID NO: 630956 - DNA, 1308 bp, Homo sapiens
  misc_feature (1100)..(1100): n is a, c, g, or t
  misc_feature (1102)..(1104): n is a, c, g, or t
caataaatgggacgttgtatgaattagaaagcagttttgagtaggtggaaaaacaataagacagatcaagtataaattaaagaaacagaactgtcagattgcagaagaactgtatacagaatgagaaaagatcaggagtctgaaaaagaatagaagttggataggctggcacttgaagtcttagtgggaaatttatttcttaagtgactgcttgctagggaaggttagaaggagatgaattaagataaaccctgataagaagccattggtggaaaccttaaaaacatgaggattgacaggtatagatcgggattctttgtagaacaaatgaatgctattggttgaggactggttgggaatcatgataaggttaacatccagagaataattcagcattcacttattatagagtcagtgggtaaatgatttgtagaatatttacgatatggcagggcagatattcaaagggagttacaaaaggacatagcagtaagtatgatgttaaattggccaagaagttaagaaataatgttaggattggctgaaagttaagcaactgagaagacctgtgtatataaaaaagaaaaaggaaaagggagaggagaagatgcttggttggaggaaaaaaatgtatgacttagtctgggtttggaatatgcaaggtatgaaacagcaaatattattgagaccagaatgaggaattcagatatcaccagctatctgctcatacagcctaaatacttgttaatatgaaaagatttacattatatatacatctcaccatgtacttagaaaatctggtgcagtgagttagcattcttgtgctaacaaaaacttttagcttgcacccaagcctacttgagatggcatatttttgccgtggttcttgtgctgataggctcattccctatgctgaaggatgttaaatgtgtatgcattattcctgtcatcttctccataatatgagcgggacaattcaagcaactcatcaggtggtaagtaaatatttccaaaaaacttcttgtttttatattttatttaaaaatgtatatgcatttgttatttatattgaaaacattccattgttccttgcagtatanannncaaatgcaattatagtctttattatagtaggagaccgattttgtattacacacaaacacgtctgctaatgaactgatgatatgttaaataattaggtcattaccctttaaaatggtgtatattatgaaaaatacttaaaagttttcttttatcatagtgtttaagtgatgactgagaaaataggtagagtttttttaaagggag

SEQ ID NO: 630957 - DNA, 692 bp, Homo sapiens
aagtaggtggaggagagacgaatcaggccgggtagagctctgcttgcagctgtaggcccctggagagccctcggaagagctgccctcggaatttgatgggagcagtaaacactgaaggatgccaattctgcgcttctcagtaactacgagatggagtctcgctctgtcacccaggctggagtacagtggcaccatccaggctcactgcaacctctgcctcccggattcaagtgattctcctgcctcggcctcctgagtagctgggactacaggtatttcaccttactaactgagtctgaaagagcagcgtacaagaacagtggacgggaatagccacagctgctgggcgcatcagtaacttgagatcatctatcacctatgtagaactgttgtacatacgtatcaacaaagcaccatgcaggcgaccagactcctgaaattgtcagtagaatctctcgacagctttgaaatgccgcaagttgaccaaatgctgagaagctaccagtctgtctgaagccaccggcctgtgagctgctgtgcgcatatccctctgatggtgcgaagagacgctgaagagcggctcacgcgaggagccacatcgacagctcttctccacaccgtcaccaaacattctgcctgcacgagccagacgctgagcccaagaacgactacacaaccgccaactgtgccac

SEQ ID NO: 630958 - DNA, 103 bp, Homo sapiens
  misc_feature (3)..(3): n is a, c, g, or t
agngctgatcatccactttcttctcagtcaccatcattttgagctcctttgtgctggtgagcatcaatttcttcataaatagcttctgtagtgacagcaggag

SEQ ID NO: 630959 - DNA, 116 bp, Homo sapiens
tggatccctcacgtggggtggtgtaaaataggcgtatgtagaagtagaggttaaggagggtgcgtggccacacggtgcgttggccaacacggtgcgttggcccaacacggtgcgtt

SEQ ID NO: 630960 - DNA, 544 bp, Homo sapiens
  misc_feature (128)..(128): n is a, c, g, or t
  misc_feature (145)..(145): n is a, c, g, or t
ctttctatcagggggaattgggaattctccgtttttttttatgaccttacccgggggggggggccagagggcccagattttcaggtttttttaatgcagccccaaaaagggttggaattacaaaaaantggggggggggggggtncaccctcccccatttttgggggccgccccccgggggtttttaaaggggagcaccccttcctttttggggtttggggccaacagcccaagttccctgtttttttgggggggggaaatgccccccgggccttaaccccgcggggtcgggttgggggggggggcccctttccccccccagtttttagttgaagccccggtggggccgggtggggtttgggccccccccccctcctgcctaggggggccgctatcccccaaaaggggcccctggggggtgggggagggggccgggtttttttagcccttttccagggccccgccagggtttccaaccccctttttgggggtttttttggtttaggttcccccgcctttataaaaaaaccccgccggcccctga

SEQ ID NO: 630961 - DNA, 1028 bp, Homo sapiens
  misc_feature (1028)..(1028): n is a, c, g, or t
tcgtgcgatcccaggctttgggtgggtcgcgtcgtggactcgtcccgtctctcttcggtgcttgccggacagctggcgtgggcgcgctactggatagagtggacgaacaacttcacgcggtagagtgtagagactctacatgatgggtcctgcaaaccgggattgcacagctgcgtgtgttctactagccgagggtggaaagtctggaccgtcaatccagcatggccatagtaacagaccgtgatgacttatcgtggcacccgtctgatcggcggagaggtgtgaggaaagctgtgtatgttaaggcgtacaggagcagcgtgtctgctgttcagatggagaatacgcgcgaaattccttgaggatcgaagctagattgctctagtccggaggccgaggactttcactcaggtaggtagaggggccaattgtggcagatcgtcacaaaagcccgaaccttggggtccacctaagactggaaggcgtgcgagagcagggctgagactcctggctcagccggaacctgtacactgagtgtcgtcgagtgaccgaatgtgaccattcggtgtgtggccgttcgacgccaattaggaagtacccggttatgcataggagaggtctcagtacgtctcagactgagaacgagggactgagacgctttaacgtggttggctcgaaggacatgcggcgtaggaggttgataaatggggcccaaagaactttatgtaatttagaacacactgtccgctgcttaaggagtgagttcaagaagacactttatgacaggacgaccagcgactcactggaggagaactgggacgccagcccaccatcaggtccagacacctgctggtgcaccgatgcaacgcagtcgcccaggcgctccgacctcgagagtttgcgacgcgccctcaatcggcaactgcattaccgcccgggggatcgcccctcaccaccgcccccgtcccctgcccctccatcccccacacctccgcacacatggccctcgccccacaactctctcaacn

SEQ ID NO: 630962 - DNA, 982 bp, Homo sapiens
gcctgcgccgccccttccgaggctaaatcggcctgcgttcctctcggaaagcgccgtattaaggggtcctggtgatgagtcccgcgttctctccttgaatccactcgccagcccggcacgcccgtcatgacggacgcagccttgcacaccctgcccctctcactgtgccaggaacttgcgtacttaccagctagctcatgctcctaccaagtatccagcacgtgacgcccggagcagaagaaggagctgtctgacatcgctcaccggaatcgtggcacctggccaagggcatcctgggtgcagatgaagtccatcgtgggagcattgccaagcgggtgctagtccattggcaccgagaacaccgaggagaaccggcgcttctaccgtcagctgcgtggtgacatggtgactgaccggcgttgaacccctgctattggggagtgtcactccgtcttccatgatgaacactctatcagaaggcggatgatgggcgtcctttccgcccaaggttagtcaaataccatagggggccggagtaggagggcagtcaaagggtaggaccaaagggcgtggtcacgccatggcatgggaccagacatgggcgaagactcaccaacccgaaggcgttggtgattggagcctgttctggagcccgcttgttggcccacgatagcccctgaagcgacaggcatgctgagcttcggccaaagctgacggttggtgtcgcattgaaagattgggggaacaggagcccgcggtcagaacgctcggaccagtccagtgggacacatggccattggttctggggcaccggatagtggccaagtgagtctgtccagcagaactggcatttggtgccgccatcgtgggaagcctggagatcactccccttatgggggaccatgactttgaaggcactggcagatatgttgaccgagaaagctgcctgggtgctgttcttacaagggatccgtagtgacca

SEQ ID NO: 630963 - DNA, 237 bp, Homo sapiens
cggtgatccgttgtctttgtacagtcagtgggctcccaggaaatgttccttctctttttgttggcatgggcactgtgggatctggtacattccggtagacactctcttttatttggactgtaaggtctgacctctatgaataattacttcagcccctgattgctcccgtgccaagctccttggccaaactttcaccttagcttctggtaaggtcttgggccaagctaagccgcctct

SEQ ID NO: 630964 - DNA, 92 bp, Homo sapiens
gactgtcgaccaggttggggcatcattggagcttaatatatcatatctaatttacaataatttcactgaaataaactccattgcttttacct

SEQ ID NO: 630965 - DNA, 786 bp, Homo sapiens
cagttcaattcaactttcctactctcctttcatgatattcttctgcgtccttgggcatgatgcacatgaggcatatccggacaaagtgatagcgacgtaatcccatctgcagaatatctcccttgattaccatcgagctatctgtctacctagagtcatacctagtaccattacataatcatacagaggcatgttatcctgctaatcagatcaatggacattgctctatcagtcatatatacaggctagtcagtgtattgaattatacagagtttccgaatgaggaagaatgaacttaagtccacctctcatggagtacaatatagatgtgaaatcagcaccctgtagatacttgctttgcctgaaatttagatagaacgatgcggatcctgcaatacccagtgacatcttcaggcagaagtctctttcagtatctccaggaagttaacgagtctactaccgtataccaactatctccctaattgaaaacattttctcgtggtggcatacctgagaaaaagtttttaaaaccacttcgtttagggtcgccgggcccccagaagggcatcaggaacaccctgtggctcaaacgcggtctcccaaggaaaaactccgggccaacaagacaaaggcgcaaggagatctcccccccagttaaacaacggccccgggtgagagaccgggacgtgtcggagaaaaatctcagagggagatacagaaggcccaaagcggagacacagtcacacgaggaagtacaagcagaagggcgactcaagaaattagacc

SEQ ID NO: 630966 - DNA, 1349 bp, Homo sapiens
actaaaaatcaaaaaatgtagccgggtgtggttggtgcacaccttgtaatccacagctactcagggagcgcctgatggcatgtgagaattggcttgaaacctgggagacatggagatgtgcagtgagctgaagatcgtaccactgcactgcaagtctgggtgacaaagcaatgactctgtctcacaaaaagacaaacaaacaacacaaacttttctgaaattggaattggcaatactgttctgcataacatttgggcatgtgggcctggcacagatttcatcctaaatcaagcaaatgtgcaaggctttcatttgttgttggctaattgggagtaattacatgccattactttaaaccagtgcttagatgcctctcctcttcaattaaggaaagcttgcttgagtaggtctcacataatatatatacaccatgatagctacaggaaggacaaacgcagcgaccacgtggacacagctggggcgaacaccactcagcggcccccatgtgcggacacacggacgacaccaagaggacaacacgctacacagccctccgacgaacactccccacagtgtgactcaaacacaaatcaggcgagggcccacaacaaacgtagcacaaagaacagcacgattgggcggcaacaacaataaattttagtcccacactgatggcagccacaacgcgaacagcaacagaggggcccacaacccagcggaagagccaccaaacaccaccaaagaacagcacatatcacagcaccgaacgggtgcccaaccgaaccttcgtcggagctccgacgacgccacacactagtggtggcccgaccaccccacacttttttgttatcccacttaacccaacaataaatttacacactaatttactagttacacccaccactacttcatcaacgataaaaaacacacaaacataactactcctcacataaccatctatctccatcaccactaattataattagttaaccacaacttatatcatacaaaccactactatcataaacccaacttatctaatataaataatacaaatcgaccagacaatcataacatattataacatacaatcatatgtcctcaccccccaccagcgacaacaatattttatatctaccacacaacataataatatggataatcatcttatcagatacacaaccttcaacgaacaactcacataatcattcatcaactacacacaccttctttcagaccaacacacaatatttccactccacacaaagacacaaaactacatatagtgtctggcacaaaaacattaaataccactacaaataaacagtttctaagacaaagagaacata

SEQ ID NO: 630967 - DNA, 816 bp, Homo sapiens
cacggtggctctcgcctgcaatctcagcactttgggaggccgaggcaggcggatcgcatggtcaggagtttgacaccagcctgaccaacatgatggaacaccgtctctactaaaaatacaaaacttaagccaggcacagtggctcacacctgtaatcctagcactttgggaggccaagcaggtggatcacctgaggtcaggagttcatgaccagcctggccaacatggcgaaaccctgtctctactaaaaatacaaaaattagccagacgtggtggcgacgtggtggcacacgcctgtaatcccagctactcgggaggctgaggaaggagaatcacttaatcgcttgaaactgggaggtggaggttgcagtgagctgagatcacaccactgcactccagcctgcccgacgggagcaagattccatccaaaaaaaaaaattagctggggatggtagcccaacctgtaatcccagccactcgggaggctgaagcaggagaattgcttgattgaacccgggaggcggaggatgcagtgagccaagactgcgccattacactccacagagcaagactctgtctccaaattacccacacgaaaaacaaagatactcaaacccacttcccaatgattgtggaattgccttatctagaatcaaattcttcattaatttttcctttaccaatgggacatatcctctccagctggattcatataacggcatttcaaacatattttcagaaaatttcagaaacaaccatcaggttctttccttcctaagccccaattaaacccaatacactgcttttcaagaatta

SEQ ID NO: 630968 - DNA, 441 bp, Homo sapiens
cagaggtagcccaattgattccaacccaaaactccttcccctttttaaaatgatttttgttttaaagccatagatcaaaggcctcagaaaccattgtgtgtttcctctttgaagcaaagacaagccctttactttcccggtgggttttgtttttttttaatgctgtggaacctcttttggaggacgttaaaggggggttttacctgtttttttaaaagggtgggaagggggttttgtagattttttgacagggctgtaaaacagacggcaatgccatagcctatttaaagaccctacgtgatttgattgagaaggacataggttttttttttaccaaaactgaattattttattttttatgttaacatgagaaatgtatgcccaaagattagttgatggatgttttttaatttaatatttaaataaaaaatttggaaggga

SEQ ID NO: 630969 - DNA, 521 bp, Homo sapiens
  misc_feature (7)..(7): n is a, c, g, or t
  misc_feature (18)..(18): n is a, c, g, or t
  misc_feature (34)..(34): n is a, c, g, or t
  misc_feature (56)..(56): n is a, c, g, or t
  misc_feature (69)..(69): n is a, c, g, or t
  misc_feature (99)..(99): n is a, c, g, or t
  misc_feature (123)..(123): n is a, c, g, or t
  misc_feature (316)..(316): n is a, c, g, or t
cctatanggcaagtcccnggacccaatccccggngaacccccaggggcccagtgtncatcctgaaaacnaaaaacctgaaacctagccccgggtatgcntcaacacgagatatcccaagcaanctgcagtttataccatataacagaagacaattcaacaatgagaaaaaggaataaacctgctgacacacacaataacacagataactctcagaaacaatgctaaattaaagaagccagacacagaaaagtatatactatatgattccatttttatgaagtatagaagaagtcaaagtaatctttactgcaaaanaaaaaaaaaatcagaagaatgactgcctctaatagaagaaaatggtgtgtgaaattagctgaaaaggtgtgaaggagatttctgagttggtaataatggtctgtatttttacaagaatttgcattaaataggtgtgtgcatttgtcaaaactcaccagcggtacacttcagatctgtgcatttcattgcatgcaaatttaatctt

SEQ ID NO: 630970 - DNA, 266 bp, Homo sapiens
gtgaagagaggctcgacgagaggaggaggagaacaggaggaggctgaggatgaggccggaagaagaaggctttgtccaacatgatgcattttgggggtacatccagaagacagaccgaaaagtggaagagcagactgagcggaaaagagaagaagattctgcctagagaggaaggtctgccattgacacctaatgagatcagctaggagaggccagagctgtgcagacatctatacttgatgcagaagtcgacctcagagagtcag

SEQ ID NO: 630971 - DNA, 140 bp, Homo sapiens
tagtgatgtatcccacacatcggagcccacactgtggtgatgaagggccagaagatctagacgtgcagtctatctctcacgcagagcagcctgatgagagctgaagacgctttcagaaacgcctattgggagctgggggg

SEQ ID NO: 630972 - DNA, 186 bp, Homo sapiens
ggggcgggtgagtgaaaaggtggcaatcccgtggtaccttgcctggtggttacacagtttaagcataggccaattttaggggcctcggaagtatctttctacaaagcgcagacacagctccactgacccgctatacctgccgaggatgctcaatgtccacgtgtcacaattccctttcacgcaaac

SEQ ID NO: 630973 - DNA, 342 bp, Homo sapiens
  misc_feature (161)..(161): n is a, c, g, or t
  misc_feature (248)..(248): n is a, c, g, or t
  misc_feature (273)..(273): n is a, c, g, or t
cctcccgggttcaggcgattctccggcctcagcctcccgagtaactgggattacaggccggtgccagccaccacaccgggctaatttggtatcttgggtagagacggggtttcaccatgtgtgggccaggctagtctccatctccggacctcgtgatcggnccgcctcgacctcccaaggttgctgaggttgcaggcgcgagcgacggtgcctggccgacaaaggggggttccttaaagggggtcggnttaacacctacttgtgcctgaggtntttgctaaacacaatcaagggtctggttctctgctttctgttcgattggaaaggggcagttgggtaaac

SEQ ID NO: 630974 - DNA, 221 bp, Homo sapiens
tatacatgcaggagagtggagggacagggaggggagaggctcagaaagcaggagagccaaacatataaatcaagtgggggatgggcacagtggctcacacctgtaatttcagcaatttgggaggccgaggtgggccgatcacttgagtccaggagttcgagaccagcctgggcaacatggcaaaactccatctctactaaaaatacaaaaacttgccaggg

SEQ ID NO: 630975 - DNA, 184 bp, Homo sapiens
gaggattagccggtacgatagaccaatgctgaatagcataacttagtgcggacgacccaatacggatagcgcaatacagacgcagaactcctgaactcaagcgatcctccagaccatcagcctcccgagatagctgggattacaggtgcgtgccaccacactcagactaattttttttattatt

SEQ ID NO: 630976 - DNA, 690 bp, Homo sapiens
ttaggctaggtacgaggccggtggtgaatcggccgagggaaataatcaggtctggaaggactacttccccaaagggcgcacacaggcactacaggcacacacactctggggacagctgcatgaatcaaaggatatatcagccaaaattatcaacaatcacaacttgattttttttttttattttggggatagagtcttgctgtgttgcccaggctggagtgcagtggcacagtctcggctcactgcaacctccgcctccccagttcagacgattctcctgcctcaccctcctgagtagctgggattacagggtgtgagccactgcgcccagagacatatcaccgctttcactgaggtctgtgagtccttgtggcgaattatataaccagagggtagtcttagggttccccaaacttgcaactggtatccaaagtaacggtacgtctgtggactattccctgagtttgggaaatatatatgtaaatacataaagtgtcgcatcacaatattcataactcactgtgagagctggcttgtatggatggggagggcccaacagaactggctagatctacctgcagcaggaacacatgtatcaaaacacaggtgtactttctgaatggcagtccttcaaagacgaataggtttatccaccacgtgaatgcagtccacatgcccccggcaggtgaa

SEQ ID NO: 630977 - DNA, 757 bp, Homo sapiens
ctttgacacgcactataagaccgacttcgacaagaataagatctggttatgagcaccggctcattgatgacattggtggctcaggtcctcaagtcttcgggtggctttgtgtggcgcctgcaagaatctatgacggagatgtgcagctcatgacatcctggaaccacggctttggttcccttggcctgcatgactgtcctgtgccttggtctgccctggatggtgaatgagcggacctgacgcgctgtacgtgccgctcagatgggaccggtcaccctgtccgactatctgcggatgcctccagacagggtccggcccacctgtcaccaacccccatcggccgcgatctttgcctggcccactggtggcctggcagccacccggggcgtcaacgcctgggatggcgcaaccgacagcatctcgatcccagtgctttgccccagcatgctggtcgcaaccgtgtgctcgtggagcacccgtgccgatgagctggcgtccgatgtaccaaaggccacctggcgtggcatgctttccacggctctctagcgacatgttgcccgctgcccgactctcttgcctgagacaccacggactctcctcgatcacccactcaatgagccacctgtgtctcgatgccctggggcaaggcgtcaggggcgtggcgccacccatggctgcagcggaggcggccgcgctgccccggggtctctcctgaacgcgtcagggtgacgcctccgccctcctgcaggcctcctag

SEQ ID NO: 630978 - DNA, 701 bp, Homo sapiens
gcccaggtgacagagtgagattccttctcaaaaaaaaaaaaaaaaatcacacagcaccacagtaagtataataataaggaaaatgttggaaatattgtcagaatggtcaggatgtgagagacaaagtaagcacatgctgtggggaaaaaatggtgttatagatttattcgacatgacattgccacaggacttctacttgtgaaaaatatctgtaaagtgagatgaagcaaagtgaagtaacatgaggtatgtctgtagctgttgctgtagtggtttccaaatggtggttttcttttccttttttttttattcctttatagggtctggctatgggggtcttggctctggttgcctaagggtggtgggagtggcggtggcgccatgatcatggccgtcactaatagcctctgacctcctggggctcaaggcgatcctcccacctggagtctcctggagtacctggggaccccgggcacttcgccataacgcacccactttaattgttttatatcccgataaagccgaggtcctcactagtgtttgcccagacgggtctcaacgcctcatggggctcaagcagttccctccgggcctaaagctcccaaagttgcccggatttaaccgggtgttgagccaccagacccagtcccaaaaaggtgcattttcctaatcccataggtgtctccaaccattccttaacg

SEQ ID NO: 630979 - DNA, 894 bp, Homo sapiens
gggtctgtggtgggcctctgggccctcggcggattcgatccgttcggcccagggaccatccacggatggcttcttccttcatgtagagcaggaccgatgaggacaccgagggaaggttatatgttcgttgtgcaaaaagccccaattcccagcgtattcagagtcgtggactctactctcaggcaggattctggactcgtgatgtggtggacaatagtaggaatgccagagcacgatttcactgaggtgaagggccatccgatgctggttttctaggcaaacagtacttctcgggggatggatagaagtgaggccacctgctgggaaggatcatttacccgctgatggcgaatccctgatgagaacataaagaccgtggcagacggatgggatctcatgcttcgtgtcatggatccttgtggtcctcgagaacttatacgaccgatcaaccatggtgatgtgtgatcagtgctgatgcacagtatacagcggggacgaaggtccactacactacgaggggggggtggaggcttgcgattgtatctactgtcctgggatgtggtacggaacgaggcagatgcgtctgagagctggccagcccctctgacgacgtggagcgcagaagaggggagcagagtgccgaggcagggtggcaacggatcctgacagcctacctgggatcgagagctggtacagctgcacagtgcagctggaggagaagcgcaggggccatcgagggccagaagaagaggatggaggcgctgatcggcaacggaggcggctggaagctcggggaggggagattccctgcatgttggtgggaaaagggcaacgccagggcgtaccaaatctgcagcgagcagaagaaaaggacacctaaggagaagggagccg

SEQ ID NO: 630980 - DNA, 1168 bp, Homo sapiens
gcgggggctgcacgttcgcagtgtgtgtgtgaaacttaccggctgagccatggatacaccgttaacggcgcaagcctgacttggctgggaagtgcctaaaggctccagaatccacccgaggagcctcaccgtcagtttctgcggactgaggacgggccctttgatggacgttcgaagtcggaatcgccagaacgaaactgacgggacgccactgggtcatcactccgatgtgtgcaaggagggacttggccatgagggatcacccacgtaacatggcacgacgatagtgactaagccgcagagagtcacgccctgtcatagcaagcgaggtgtgcgagtgcttgcgagtgcaccccatagggacagccaagagccatggctgcaagcgtccgccccaggcgtcatgcaaggaacgtacatccgtggagctcggacctcaatagaacagcacagcagtacaagtacctgaatccaccacgattgtcagccggaagcctaagtgaggaggcacacaaagatgttctcaggtaccagtggagatacgtaggcctcggcagttggtccagcaataacggaggagcttgacccgtgtgtgtgtgcccaccagcatcagtctagctggcggtcccaggatcacgcagagaccttaccccggtcagcaagctcccggtccggagccctctcaggcactactggagctgacacccagggcacctggtacccaccgagggtcagcatgagccgagtaacgccagctacagatgaggagacggtgacagaggcgttcggggcaaagatgcgaccaggttctcaatccaagacccaagtccaacaactcgcctaaagaaggagtctggtcatcccgagggagaaagccaaattgggagcgagtgttggaacggaccggtctccagaacacattcacagcatgctctcgggcaaagacacccggttggaacaacaacggtacaaggaacagaataacgaaacaaagtgaaagaacagcggggcatgaaaactgaccggacaattatgtctcctaaagtgaatggggcaacagtcgactaaatctacggaatgaaaagaagaaccacggcgaacattaaacaacactacacgaaactacccaccgaaaaggaagaacacgacaactgacactacgtcacgt

SEQ ID NO: 630981 - DNA, 83 bp, Homo sapiens
  misc_feature (58)..(59): n is a, c, g, or t
agagagtgttcagcagtggactgaccacttagaaaatagatcctccctcaccagcttnntgttaacacgctaagctatggtgg

SEQ ID NO: 630982 - DNA, 839 bp, Homo sapiens
catggtggctcacgcctgtaatcccaatactttgggaggccaatggccggcgtccgatgcacttgaggtcaaggagttagagatcagtcctggtcagagatcagcgctggccaagcatgggtgaaaccgcgatctctactaatacattatttcacaacattatctgggtgtggtggtgctcacctgtactcccagctgcttgggagactgaggcatgagaatcacttgaacccaggaggcagaggctgcattgagctgagatcatgccactgcattccagcctaggcgagcagagcgagattccatctcaattaagaaacgaagacatttatggataccttacgatagttgatgtcttcatattacctggtagcacgtactgtgtgagtctctactgtgtttgtccccagggcgtggtggctcgtaagtgtcctggtcctcagagcaatgcgctgctcaccagtagacctcccaaagtggctaggaactatatgggcaagatcctgagcacagccggtccaatttggtccttgtaaaagcatgcttgacatcgagccagtgcgtgcaaattggacatatgtgtaccaattccctgggtactttcgggaggccaaggagagcgcggatacacgtaggtcctgcgagcatttgagaaccatacccttggtcaaaaatgtattgaaatacccgggtctgtaattagaaacttcctgatgttcagtcgcggttgtgtgtgggtgactgcgcttgttgttgcccagcttaatttgggagtgctgtgggcaccgagtgtatcgcttgggaccccccgaggttgaaggttgcagaagtagagatag

SEQ ID NO: 630983 - DNA, 663 bp, Homo sapiens
  misc_feature (75)..(75): n is a, c, g, or t
  misc_feature (132)..(132): n is a, c, g, or t
  misc_feature (152)..(152): n is a, c, g, or t
  misc_feature (178)..(178): n is a, c, g, or t
  misc_feature (180)..(180): n is a, c, g, or t
  misc_feature (222)..(222): n is a, c, g, or t
  misc_feature (295)..(295): n is a, c, g, or t
  misc_feature (320)..(320): n is a, c, g, or t
  misc_feature (338)..(338): n is a, c, g, or t
  misc_feature (348)..(348): n is a, c, g, or t
  misc_feature (360)..(360): n is a, c, g, or t
  misc_feature (370)..(370): n is a, c, g, or t
  misc_feature (373)..(373): n is a, c, g, or t
  misc_feature (414)..(414): n is a, c, g, or t
aggcagcgaactcatctttgccagtacaggagctcgtgccgtggcccacagcccacagcccacagccatgggctnggacctgacggtgaagatgctggcgggcaacgaattccaggtgtccctgagcagctncatgtcggtgtcagagctgnaggcgcagatcacccagaagatcggngntgcacgccttccagcaggttggtgtccaccgagcggtgtggngctgagaagggccccttgcagcagggctgggccggcagcacggtcctgctggtggtggacaaatgcgacgaanctctgaacatcctggtgaggaatancaagggccgcagcagcanctacgaggtncggctgacgcanaccgtggccnacntgaagcagcaagtgagcgggctggagggtgtgcaggacganctgttctggctgaccttcgaggggaagcccctggaggaccagctccctgctggagaggaggtacgtgcgtcaagcgccctgagcaccaggttcatgaagtctgcgcctgcggggaggcggcacagagcctggcgggcggagctaagggcctccaccagacatccgaagcaggatcaagggccggaaataaaggctgttgtacgaggagaaacaagcacaacacaaagacgcacaaacaaaaacagaggg

SEQ ID NO: 630984 - DNA, 525 bp, Homo sapiens
  misc_feature (201)..(201): n is a, c, g, or t
  misc_feature (495)..(495): n is a, c, g, or t
  misc_feature (524)..(524): n is a, c, g, or t
ggcacgagcaatggcgggcgccctcccccagcctcgctgccgccttgcagtttgatctcagactgctgtgctagtaatcaacgagattccgtgggtgtaggaccctccgagccagtgagatgaacccggtacctcagatggaaatgcagaaatcacccgtcttctgcgtcgctcacgctgggagctgtagaccggagtgtntcctatttggccaactttggctcctcctttctgccctgaattttctacagtcaaaaattcatagacgtgactttctcctccttgccttccaccgtgattgtgaggcttccccagccatgtgaaactcttgcaccatgtgtctggaaaagctgcagacactcaacgccagcccaatgaaagcagccaggagggagactgtaccctgcaaagccacaggggcagagctggccaagaccacaggaacccacctcttgcatcagcgtgacccagacatgagacatggagtaaaggagnttattttggagctttagatttgactgccna

SEQ ID NO: 630985 - DNA, 172 bp, Homo sapiens
cacttgggcataagaggaggaagcggctggcaactgagaggctggaacacttgctactggatagtcgtagcttttaatgtggcgcctcttcaggttctgaagggatcctccgtgttgggtcccatttaggtacacgttagggaaaataatctggcagacaacgtagctgtgc

SEQ ID NO: 630986 - DNA, 231 bp, Homo sapiens
ttttttttttttatacaggatctcactctgttgcccaggttggagtgcagtggcataacatagctcattgcagcctcaacctccagggctcaagcggtcctcctgcctcagcctccaagtagctgggaacacaggtacaagcactgtgcctgctaatttgtattttgtagagacaggcttgcatgttgccagctgtctcacactggcctaggaacccactctgattagtta

SEQ ID NO: 630987 - DNA, 317 bp, Homo sapiens
tgggtaaacctggcgttaataaacggccaaagtatccgatgccaaagggcagattttactattcacattcacttccttcccacataagaagaatgtgaagaggagaacattattcacatgctcaaagttttagcaggttagagaaatggttataggggtgattatttataaattattggctatatacgtactgcttaaaatgtatcaaatcaaagtgacttgacaggcagagacaactgcatcaagatacaattaaaaacttatcagtgactcagcctatgttcaatactacaacttggcaaataaagcagttaaac

SEQ ID NO: 630988 - DNA, 877 bp, Homo sapiens
  misc_feature (397)..(397): n is a, c, g, or t
taaaaacccccttcaaaaatgggaaaattaaaaaaattttaaaaccatttttaaaaaaggccttttaagggggggttttaaaacccaagtgtttttgggttttaagggaaaaatttggggggggttagaaaccatcatatggtgggagaaatgttggaccgcaattatatggactttgagaattccgtgggaaacgtggtggttgtttacaaaaatgtgtgttggcgccgaaatattcgccggcgagaataatgggtgaaaaggggaagattcaagaaatacttctggagggtttttgtaggggaggtgtaaattaagaacacccatgaaaatttttgtatataaagcagtggtttgaaaatttagtggggttgcgcggggtggtttccctcataanaacctctgtggtgggtggacacccccgaggagtgaatggaatacactcctctgaagtggcgcagaaaaacacgcggatttgttgttcaacagaagaggggcggcacataccaaggggggatatataacgggcagggggtgaaatcccctggtgggggggggccccaggtgaccccctccataaagtgggggggggcagaagggcaagagcgagtggggtgtggttaaaaggggttccaaaaaaaaatctcttgttggggaaaaagaaaaaacctttttgtcggggggtaataagaacaggaggtattaatcccggagatatttgaagaggggagcttatttgtggggaaacagggtgttgtgtgtatttgtattgtggagccactatagtgaattaatgtatacttaatcagatgaggttattaaaactttcgggaggcccaactctgtttgggtttataattgggcactagagtattat

SEQ ID NO: 630989 - DNA, 1659 bp, Homo sapiens
  misc_feature (692)..(692): n is a, c, g, or t
  misc_feature (1139)..(1139): n is a, c, g, or t
  misc_feature (1145)..(1145): n is a, c, g, or t
  misc_feature (1151)..(1151): n is a, c, g, or t
  misc_feature (1165)..(1165): n is a, c, g, or t
  misc_feature (1192)..(1192): n is a, c, g, or t
  misc_feature (1195)..(1195): n is a, c, g, or t
acttgcgtttagtgaaagactgcgaaaagtgatacaatatgtaagctttcttaatattgaagtttctttgttttgagacagcatggtgatttttaaaattctttaatttgttcttggatattgaaaattcaaattgaagccaagttatttatggcttatccttaaacaaatagcaaggccagtcttttaagactaaaacagatttgtgtctatttgaagacaacaagagtgactttttagggcatttaaatttagcagataaaacacttagaaaatagttttatctgaaaagttttatcagctaagagagcataaatttttacttgttctttgttgtttctaggttagactctgaaggaattgagttgataacaaaatttcttcaggtaagtcagttcttacagtaattgttaaataggttgttaagcctcagcttcttcatgtgtagaatgggctcagtagtacttcctcggtattgttaatgacaaataaaattatctatgcttaaggcacatgtttaagttaaaaaaaaaaaaaacatggtttctcctaatgtgtctgggtctcttgtcacctacaacagtctgaggtagttggttactggcattgatcagctgtgtcaaggccacattctctgcaattgatgctctctatgctctcttatgttctcttttccttatacgtacagcctntggaggatgctctgcctccaaatgccattcatatttccctccaaagcaggaataaggggggacgataagggtagtaccagccacattagtcctcttgaaacttggaagcaaaagctttacagaaacccctacaaggtttctttccaagtcttattggccagaacattaattgtaggaaagactgggaattggggagcagaattgtcataattagccaaaatttaaaacagttatgattcatgattcatctatcagagttgatggacaccttgaacaaacctaggttgtatcatcaaaaaaaaagggaaaggagtatgggataggtcgttaagaatgactgccataaaaatacggggtatatgtccaccagtccttgggtgtccatgaagagaagtaactacacaggtcaaatattttaatttttctttgcttcagaaaatacaagcnatgtanattctngtttaagatccagncttatcttagaaatgtggaactgagangtnattacacaatctcagcagcgactcaaattagagtataactggagtattccgaattgttgattgaaaaatagtcatcatagttaaataatcgagattttttttaagtagctctaaatgctcatttgcccatctcctactttttgcagtaattagagaaaaagctaatgaagcagttctttgctttttcacagtatgaatctaagaaaagggtttcagctgaagaggccatgagacatgtgtactttcgaagtctgggacccagaatacatgctttaccagaaagtaagagaaatcctaaagtgtcttccctgctttatttttatttgtccaaggttagggtctggggtgattggggagatggctattgatttttaagcctaagattctagtcttctctatagttagattagaatttcttgaagggaggtgtgtgtcttatttccctatgattcagttatttcttg

SEQ ID NO: 630990 - DNA, 478 bp, Homo sapiens
aaaaaaagattaggacttgttgtcttacaatgaacgtgcaagaaccatggtatgaacggtctataagatccagatgtttatttcaaaacccaaacccttgtcacctgcaagaatctttacatatttacgtaatacactgtacattatatgcatggcctgtttatactattttcaaaaagagaatatggtgttaaactattaataaaccaaaatttaatttgatagggcagcatcaatctgtattccatccttggtccagggattttccttaaatgatggcatcagtgtcatctatggtccgataccgaatgcctcttcttgagttatacatttggcatccaatgtaaagaatagataaaactcccagcgttaatacaataccaccaacaaagctcccagtatcaaatttggatcctttctttgcttcagaatgcatagttgtggtgatggttactgataaggtgggtcagaacataag

SEQ ID NO: 630991 - DNA, 356 bp, Homo sapiens
  misc_feature (247)..(247): n is a, c, g, or t
gtgttcacatagttctttggatttccgtgttcataattatattctgaaactcattttcaccccagcccataattcacatattatctgtgtaatgcacagttgtatgcatttccgcaaaccagtagtataccctcaggctcttctcacccagagcataggaaacacaggtttggtcacacccattaagaaccaattctatcccacgctatttgccaatgtgtagtctcagtctaaattctcacaatanaatgtatggatatatatctatatctctcatcttgattctcaaaagtagccaaagggagttcttcagagcttagcgttgcctgtctaacgctgaagattgtgtatcttca

SEQ ID NO: 630992 - DNA, 183 bp, Homo sapiens
ggctattgagcctgtgcatacgtcacgaagttctgtgcatggttttcagctccatccaggtcttttaaggtcttctctacactgtttattctagttagccgtggcctaacctttgttcaaggtttttagcttccttgcaatgggttagaacatgctcctttagcccagagaagttagttatta

SEQ ID NO: 630993 - DNA, 537 bp, Homo sapiens
  misc_feature (93)..(93): n is a, c, g, or t
  misc_feature (156)..(157): n is a, c, g, or t
  misc_feature (194)..(194): n is a, c, g, or t
acatgcctgtaatcccagcacttgggaggccaaaacgagtggatcaccaggtcaggagttcaagaacagcctggcccacagagtgaaaccctngtctctactaaaaatacaaaaaaaaattagccggacatggtggcaggtgcctgtagtcccagnnctaccttgggcaggctgaggcaggagaatagcttganacccaggaagtggcgggcgttgcagtagagctgggactgtgtggcccccaacccttgggggcgaatctccaccctgggtgacagggtgaggctccattcaaaaaacagaaaatagagaagaaaagaaacaaagaaaaaccttgtgggcgcgcgcagcgcggacccccccgagaaaacgtttgcaaacacaaacaagtcggggggccgccgggggcccaggaatggtaacagagcgacaccagggggccccaagggggtgcaccccacaagaggggaaaaccggggcgcacagagacccaacaggcgcgggggattaccccacccactaaaaaacgccccgggg

SEQ ID NO: 630994 - DNA, 124 bp, Homo sapiens
  misc_feature (15)..(15): n is a, c, g, or t
  misc_feature (22)..(23): n is a, c, g, or t
  misc_feature (71)..(71): n is a, c, g, or t
  misc_feature (115)..(115): n is a, c, g, or t
acagtgactaaacgngagctgnncagcacagttcataggcgcgaacccaagtagatcgccgcttcggccangctgttagtaatcgccggtcgagctgaagtcggcaagggcaggnacccactcg

SEQ ID NO: 630995 - DNA, 439 bp, Homo sapiens
  misc_feature (381)..(381): n is a, c, g, or t
tgggggaggggctctctgtatcctttatctccggcagggtcaggggcccctccagggcccggtctcgagcgaggacgtgccttccttcaaacttgatcattgagcggtgggtgccctttgttgccaggtgcgccggtgacctttggcagggaagccgcgtgtgttgtgagcaccgccttccacgaagtgcccgccggtgaaagctgtggccgcagatgtgagcggtgcgtggttctcctttgggccacgggagaatgttagggtgtttgatgaagcggcttcgggcttcggagtgaatgttaaaagggtgcgcgcgttcaatcgggtaggcgcctgtgcctccagagctgtgtgctcttgcgcctcctgtgtgcgcggaanagaagcggctcttttccaacagaggggggcgccctgtgtgagacggaaagagaagcaa

SEQ ID NO: 630996 - DNA, 893 bp, Homo sapiens
  misc_feature (512)..(512): n is a, c, g, or t
ggtgttcctgttgtccgccttctatgtctcgttatatcctgtccccttatgagtctcctcgaattcgcctgtaatcccgactgcgtcataagtttccgggggtgcgcagaagagtgggggccaccctcttaggcctcgtgtgccgccctttttttcccccgggtcccccccatatttgtcccctgggctcagagccttatgagtgtttcgaacccccgtagcgatgtccagccccatgggttctatatgggccaccctcgccctggccacggccaggatcaccgggttttcattattatggcccccccccccggggccaataggcgcgataccacaagcccctcgcgacccccatgcccataaagcgattcctctcttggctgaacccttcgtcaccgagtcccccccgcccgaccccgcataggtcccccgaagttcgtcgcctgtgcaactccagaaacctcaaggctccccctcgacggatatttctagaacaaacgaggttacgctgntggtaacgacgattcggggccaaaaagagttgtctcccatcctcgcaaatagtttcaagaggtttctaaggcagcttgcaagaggcgtcgtactatggctgagaaccccctcgagtgtgagcatgcacctcttctgcgccccatccggggtatgtcccccccagatcaaccaaacatgggttcgtggatctctaaaaaggagaaatatacggccgcgatctttaatctgccgttgtctcgcttgccccaggcgatgattgccactagagcaacgacctcctatggctaccactaaaccgcccacgtttttgcacaataaaggacaacctgaagccccttttcgggaaaccctttaacggcccctcccttttcccacaaaaa

SEQ ID NO: 630997 - DNA, 444 bp, Homo sapiens
tcgatcggcggcccctagctagaagtcatagccatctctttctcaaatccaaaaagcagctcttcgaagggctcttatgacatccccaggtccagtggcagggcaagcacagtccttccagcacagataagccatgtcaatgcagtcgtctttctcagcaccatcatcattagccaggtatcccttctccctccctggtcagccttccttccttctctgcaacaggcagcacagtccatcacgttcacagtagcatctcacaactcatttgatatgcacagcgttcacaaaatcttcaaattcatcgcactgtatcagcacacctcatactcaaataagaaaatgcattaaatagtcactggtaattagccactgggtgcaaagctggacggcacagctcaataaccaactaaactcagctatggaacattctaaacatcaggg

SEQ ID NO: 630998 - DNA, 215 bp, Homo sapiens
  misc_feature (29)..(29): n is a, c, g, or t
ccccccttttccggggccctttggattanaatccctccccccccccccggcccccggtttggaatattgggggggggaaggggaaaggggtgggcccccccccccccccccactgaaagggcccccccttttggggccccccccttaaaggggggccggcctggggggggccccaactgttttttcttttgggccataaagctgttttgccccga

SEQ ID NO: 630999 - DNA, 872 bp, Homo sapiens
attgatttcacgtttgaacaaggggttggcatctgcacatccttcctgggcatctcgtgggcactgcgtcgattaccaccaggccttgcacactctgcctcccctccaagcccctcctggtgcctgtgctcctctgtgatctacgtcctgtggaacctgctgctactgtggccccgagctcctagctgtggccctgttctcagccctcttccccagtatgtagccctgcatttcctgggcctgtggctcggtactgctgctctgggttcggcttcacggcacagacttcactgctggaccccagttccgacgtatcctctactttctcctggttcaacgtggctgacggccacgcccgaggccgggtccaccatccacttggctctgcctcctgcaggtgacaggcattctcctgcgtggcctcctgtggtgatcttatagcccctggctgcccgagccggatttccacttgcagcttgtggctgcctgtaggagtgcggatagcttctttctgggcctggcttttagtggctttgtagtgctactgcatggctagcacccgtatgcttggctgctagggtgagctccaagcccgtgaccatgggtggtacatgggacccatggatgttctagctttccgtcaagagccgggttacttctggtctggcccttcatgatgtctcctggtttatcgtgcgtcgaagtaagcctttgttgtgcccccaaaggcgcggtactcggggcttcgctgcgcgttggcgatcccggctcgagctcactcggcggacgaacggggtcggatactctggtcgtatcctcctcctgcagggccttgcgctcccgactctcatgtgccagatcatgaaccaatg

SEQ ID NO: 631000 - DNA, 141 bp, Homo sapiens
actaattcagtaggctgcatctccactttgctcactgagggggtttcttccttgctcactgaggggttttctttcttgacaccaacactaatctcttgtgtcttctgagccatttctttagcatcacccttatactgtgtc

SEQ ID NO: 631001 - DNA, 996 bp, Homo sapiens
cgcggtgcccccggcgggttttttcttgttccgcgggggtattattcttcttgggtcgcctcctcccgggcgccatattttggtccctccggtcgtttcgtcctcccttcgtttttgggggtttcccccaccacggggggccgctccatagcctcgatgcgcacagctttgttcttgcggcctggtcaggcggcaagcaaggactgattgcttctccccccctttttgtgggtcaaaagaccgttggcgagtagatgggcgcccactacattttgtctgtagagatccgtcggtggggattgggtccccccctcttcttgtggaagtattagtggtttcctctgcgccagccacgcccaccacgtgcgggggtttggaggggagactttctctctcacggagcaatttagccacccccctctcttggggtggctccttctttagttgctcgtgttcctggagtgatagtagggaggacaccagaccactctcttcgcgtgggggtgtgtctcatctccataagcccagcactgaggagacaacgaaagagaggtctgtctcggtgaggtctcgtcgacgggtcaccaccacgtgtcttccccccagacaagtggtctagcgagacggggttaaagtgaatattagtctctcaataactctcgccccgccccccctcttgttataacactcgtggtgggagataaaaacgcgtttcacgcaaactctgtgtttttttccacattggcgcccactatgtagggttgtgtatgctaatataaagggaactgggtttatatgaagaaccaacaggcgttcgtcaaccttctcttcagtaaggagaaaggaggaaattttttttggagcccccttgggtttttttttttgggggggcccttttaaatttttttttttttaaaaccactatttttttatggggaccaacgcccccaaaatttttcccgaattttggggcccccttaaaaaatttaatagaga

SEQ ID NO: 631002 - DNA, 719 bp, Homo sapiens
  misc_feature (121)..(121): n is a, c, g, or t
ttttctcttacattcttttttttttcccggtttatactttaaaacaaaataaaattggaaatacttcctgtgcaattatgtggtgcaacttcccaggggtgaacactcaaattagaaaaangtccatctctcgtggttagaagggagtggcttcccgtgtaagtgactatagagttaagaggtggcagcaatcttctccagtgccctttctcagcaggagaggcacagaacagtagcggggacgtgccatctcgtggcaagattcccgaggtaaagacactctctctctttaatttcttaccctatccgtggttctctcgtgaactcagcccatagggtgtttgatgaggtggccactcttaaagagttcacctcagtcatcgagggaatctacgggtctgtgggtccaagggtcaaataaaaacctagtctcctttaattctacttctctattcttagctagaagtgaaactcagcattatatacccttcgggacatacatactatggaatagtaataccttatactagatgcacagaacttttcttatacaacacttaaatcttgtaaaacttcaacaaattcagaatctccgtggaccgtgggtgtcggggtggggcccagggcgatttcacagcaagaacaaaacacatcacgcattcgcggccaacaatagagaatggtaggcggctctaagaacgtttttcccattgggaaat

SEQ ID NO: 631003 - DNA, 726 bp, Homo sapiens
atgagtatccgctgcttacaagttatccccactcatggagtgaacagtgacgcaagcgtcaatagacttcataagtgttcatagaattctacaattctgagtgatcttagaaatcatctctgtgtgttcacaaacaaggaaactgaggtccagaaagagcaagcgacttcgcttaccagctcgcatcagagagctgagggtaagactcaggtgtcctgactcccagctttagtatctttgaattttatttctgtaccatttacaaaacaacataattaaccactatttgtgcaacgtcagtgtttctcgaacacttcagtgctccaataaaaagtggactgcacactacgggaccatcccccagcctgtaagctgtctgtacttactggggcccgtagtatctcggaatctgacggttggaacaatgggagccctgttgagcgtgtcctaaagtgactttacccgcctgcgtgttttgaccacgggaagccacaggacactgcgcacgtttcgaggccctcccattgtgcgtgacatctttgtaaaactccagaggggcgcgtaactgtcacgctgttatcttactcttccaagtccgggagcacaccacacacatcacgtctatcaggaacacgccaattcctcttctgaataatcacatgtctctgactgacaaatatggcccacgtgccctaagcctcgcatttagcccacatcacagctcac

SEQ ID NO: 631004 - DNA, 124 bp, Homo sapiens
acctggaaagacagagcagattgttaatactttggaaaagaagtacatttgtgtggaccttgaaaggggtagatggctcaggtttacacagataattgcaaggtagaaggctctctgttctcgt

SEQ ID NO: 631005 - DNA, 824 bp, Homo sapiens
gaagaaaccaagcggaaggaatcatgaactcctcaagggtctccgagcagagctcaagaaggcccaggagagccagaaggagatgaaactgctgctggatatgtacaagtcatgcgcccaaggagcagcgggataaggtgcatgctcatggcagacggtaacgcaaggctaacggccgaggttgatgagctgcgcgagccgcatccgggaattggaggagagggatcgacagggagagcaagaagatcgcggatgaggatgccctgcggtgcattcggcaggcagaggagcagatagaacacctgcagcgcaagctgggtgccatcaagcaggaggaggaggctctgctctcagagatggactgtgacaggtcacggcttttgaggacttgcaggaacagaacggggcggctgctacagcagttgcgggacacggatgatgccaacctttacacgctaatgtcagagcggatcaaggccaaccagattcacaagctgtctgcgggacggagaagggattgagatttgaggcgagcagggtccgttgaggctcaagttcccaggtggatgcccagcttgctgaccttgtgcagaaggctggaacggacaagggagcgagccttgccagggcagcctcgaggggtgtcgggagacaggacgcttgatcgctgcgccagaccaagccctggagactcaagaaagcggacagggggtagaagccgcccagcttggccgaggacctgaaggtgcagcgtggagcacgtgcaagacttcggctggcgggagatccagccctgctggcacgagagcgggctgccgtgagac

SEQ ID NO: 631006 - DNA, 804 bp, Homo sapiens
gatcgagcaaccctctaaaagcagtttagagtggtaaaaaaaaaaaaaaacacaccaaacgctcgcagccacaaaagggatgaaatttcttctgggacatcctccgggcttctcccgttactgatcgtctgctccctagaagtccttcgtgaagctttttattcctaagaggagaaaatcagtcaccggcggaaatcggtggctggattaacagggagctggggcatgggaattggggagactggactggcctatgaatttggctaaacttaaaagcaagctgggttctctggggatataaataagcatgggactgggaggaaacagctggccaaatgcaagggactggggtgccaagggttcatacctttggtgggtagactggagcaaccgagaagatatttacagctctggcaaagaaggtgaaggcagaaatgggagatgttagtattttagtaaataatggcgggtggtagtctatacatcagattcggtttggctacacaagatcctcagatggaaaagacttttggaagttaatggtactggcacatttctggactacaaaggcatttcttcctggcaatgacgaagaataaccatggcatatgtgtcactgtggcttcggcagctggacatgtctcggtccccttcttactggttactgttcaagcaaagttgctgctgtcggatttcataaacactttgacagatgaactggtgcctttaaaataactgggtcaaaccacatgtctgtgtcctaatttcgtaaccatggtcatcaaatcagtcacgttgggaccc

SEQ ID NO: 631007 - DNA, 204 bp, Homo sapiens
  misc_feature (199)..(199): n is a, c, g, or t
ggaggggctggtgcataatggatgggacgacctgtacgcttctcagtgacatcaccgaggaggacttggaggaggctgggtgtgcaggacccggctcacaagcgcctccgttctggacagccctgcagcgtcagcaagtgatacgcgcgaggcaccacgaactctgctgaacgtcagaggcccgctcctctggataccnaaggt

SEQ ID NO: 631008 - DNA, 1230 bp, Homo sapiens
ggccagaccaggtccactcgttactagccagcaccaccttagcgcaagaccactttaccgcgcaccattaaagtattcgtgcgactaggacacaggttgacaatgcgtgttcgacatgttacgtatatcaggctacgctccacaggtgatacatacttgactacattcataatctgaatgcattaattatggctgagggacttaatgcccgtataccgttcgtgcggtacactcgaagtctcaacgtacggagaagtcaatctgtgtgcaagggagatgccatacagcctatggacccccaaaatgccgagaactgatgcttacacttataggtatgcatgctgtgaagagtagacaagctccgcgcatctcatggtgcgaccaacagatcaaatgagcaagcattgtgatgaaggtgagcagcggcggactaataggctatccgtggccatcgagtgaatgaagctcgtgtgtgattccaactatcagcacatcgttcagggtacattagttgtaacattctgcacactacagtaaaacaccaatcattatattgcccccccattggcttccccgtggtaaattcattggattgaccgttcgcgaaaccaaagagcgagagaccgagagcctcgtgtaaggcgaacaacataatgtgaagccaaagcgttctagtagtgcacgaagacacgtcatattatagactaatgaatttaaaccacaaatttacgtttagggggcccttacacaacggcgggtcccacacgaagattgggatcggacatgaacgagactgattatcccaaccgttactcgaaagccatgcctgaggcataacggccataaaacattatacatttcgcacgaaagggcgtgtttacttgggaaacgtcgtaaccaagcattccacttttccaaacgatgtgccctaaaattgtgtggcatcccgaatatgccataagtccaacccccgtaaagttaagaacgagggaacacctttacaaagttggatgccaagggtaattcacagggtcaaaacccacttgggcaaacagaccctatttccattacccgtcccgggcacattaaaaggaccctttggacgtgtcacgggactttacacaaagaactttgcacaaccgtggaagccaaaggttcaaacccggcaccgaaggtacattggtaccaaaactcaacacggcagccacacgggtcattcagttgaaccct

SEQ ID NO: 631009 - DNA, 676 bp, Homo sapiens
  misc_feature (5)..(5): n is a, c, g, or t
  misc_feature (143)..(143): n is a, c, g, or t
  misc_feature (191)..(191): n is a, c, g, or t
  misc_feature (242)..(242): n is a, c, g, or t
  misc_feature (521)..(521): n is a, c, g, or t
tttcnttttttcccctatccaaaggtttcaagtctcaatgccgcacaatccttctgaacacagaatctggggggcccactgttcaaacagttgggacagacaggtccctgcaaaggctactgcctttttaaaacacatggggngggggtcatggacggcatgggaaggggggggagggtgggggaacgggnggcggggggggaatggggggagggacaggtatgcgctggggggggtggggnggctggggcacacacggtgggttggtgggtttcatttattggtttttgacattttctttctggttctttttttaactcccccctcccccggtccaacaatggtaaaaaaaaccccccggagttgggcggggccttattaggccggccccaggccttccgggccctcctgggtagccaacagtagcatgtggcggagcttctcaaagctctcataggcgggcggatccagctggttaaaactaagggaggaagaaagatcagtttgtggtgagggatganagataaccaaatctgtgtgttcccatggtgcccaccagcccctcccctccctgaagaaaccaactccctgcttcttgatgactcccaatcttgtctcagcccagtatgtccccctttatctggctcccaaactggccatcaggcaccaaaaccaa

SEQ ID NO: 631010 - DNA, 131 bp, Homo sapiens
cgatagcgctcagaggatccctgattactctataaatcaaaggcaaatcggggaggcatttaagctgcgcaggaagtcaaatcacagctctgctactatagtagctctgtacctatacatcaggcaaactg

SEQ ID NO: 631011 - DNA, 175 bp, Homo sapiens
tgattgtgggtttgatggccaggctcctggagcccttaaaacttcccaatttggtgccacttgaactatattcttttatgcactcctttttagttatccccacctgcccagttcccttattaggctgagacattttaaccaaattacctgcttccctaactattcctggactaca

SEQ ID NO: 631012 - DNA, 117 bp, Homo sapiens
gatcacctgggcagagtgggacagactgtccaacagggaaaccccgtctctactaaaaatacaagatcagccaggcttggggggcagggcctgtggcccagctacttgggaggctga

SEQ ID NO: 631013 - DNA, 920 bp, Homo sapiens
ctgtgagttccggaagagcttcagcaacagctccagctttggcgtgcatctccgcaactacacacgtgagtagaccttatgagtgcactgagtgtcgggcggaccttcagcgatatctccctactttggagcactaccagcggacccacagagggcgagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgtacgagaccactaacctattggaggaagatgcttcagcatcttttgcgtgtctaccttggaccgtcaagccgttcatcgccactttggagaatggttttgatatagccgtcatgaagtcaggatctcaggaacgtcctgaggagggactctggcatagagaacccttgcctctttccaggccaatttctcgtgttggaaagtcagaagacccagtcgttggcttgtactttcattggggtgaaagagaaatagggtaggctcagaacatgctcatgttattaaggcagcagtcctccctggacctttgaggaagtaacttactgagactcgcggtgtcaacatgtactgaaggttctccaaatatgtctagtgaactgcttaggtatggagtgacactgcagtttcctgctagttcccacctgttgtgcccgcaactttgcttctagatctcatgggtgtgtggaggagtgaccattctcatatggaagggggcctcctaggtccggagaagagatcgtgaggtcccaccttagaaatgaaagggaaaccgatcagggagccatgagcccagggaccttcacactccccgatgtttaatacttggtgtccctccccca

SEQ ID NO: 631014 - DNA, 114 bp, Homo sapiens
gcaaaccactcaccttactaccagacaacttagcaaaccatttaccaaataaagtataggcgatagaattgaacctgcgcaatagatatagtccggaagggaagtgaaattata

SEQ ID NO: 631015 - DNA, 334 bp, Homo sapiens
ttttaggcagggtatgtaagtacatccttcgtggtagtgccattggtgtttcagcttattttacagaactgtacactcaaataggtttcaaaaaaaactggtattatctcttctaaaggaaatcattttcttctctggtagattttgcaaatgatctatatcctaaccttatttgctggttcaaaatgatgtgtctaaagcagaacattgctagcccaaagtacattttctttaactccttctataaacaggcctaacgtctagacctttttgccaaagttgtagtccaaagcaagccccttctccataataaacacatttaattatattacaa

SEQ ID NO: 631016 - DNA, 265 bp, Homo sapiens
ggtgaagtggaccattctttctttgacagtgactttgaagaaggaaagaaatgtgaaactaactcagtttttgacaagcaaaatgatgacccaaaggaaagaatagataaagattcaagaaatgtgaattcgtacactggtgatgcaaacaattggacaatcttcttactggaacaggaaatgaaagaaacgtgaaatttcccccagaacaccctgtagagaatgatgttacacaaactgtaagttctttttcattgccagcctc

SEQ ID NO: 631017 - DNA, 373 bp, Homo sapiens
gcattccaaagctaagttgctggtggcattccccagttctttgccccgtcttctcagtcacataggaaagtcctcctgaaccagctgcagtatcagtacctccagcaggcactggtgaggtgcttggcctatcatcccctcaacccatctacccccaccgccctcttatagtgggtgagtctggcctgttgacccagagagggttcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctc

SEQ ID NO: 631018 - DNA, 172 bp, Homo sapiens
acagctccggtctacagctcccagcgtgagaacgcagaagacgggtgatttctgcatttccatctgaggtacccggttcatctcactagggagtgccaaacagtgggcgcagccaatgtgttgtcccaccgtgcgcgaccggagcagggcgaggtatttcttaccttgggag

SEQ ID NO: 631019 - DNA, 728 bp, Homo sapiens
gtgcgtctgatcagcggccgcctgtcaacagaccagataaccagggtgaaaagagaaccaagcggatgtgacaagttcgggggatatgtcgtcggcgaagtaaaccggaatcgcaattaactgtacagctggttgttcactcaaagttggttgtctattcgatgacatgcgtatcaaagctaactattaatgtaacatgtaatgttgtgggtcctctcaatgtagaagattcttacatagagatcgattcacagaggggatgttttataatgatcttggtgggtgtgcatactcaagattgattagaatcgcataaggaccatggtcagggttacgtggggtctagagcttatgatagtgttgaattagaagtgatcttgtacacttgtcagtctgttcatgtcgtgaaggtgtgtaaaagtcatacatatactatagtccttatggaagaaaatgcttagaaattcagcatgggacccttgctgtgaattaagcccaattaattcctgtttgtgctacatatgatctgtcgtgtggcaaaagtgtaatcagaggaaattcttgtgcccagtcgtgtcgatttatgccgtcaggcacttgcctgtgctacaattcattgtgttacctgtagattcaggtaatacaaactatatataatccatcaagtaatagaaactaatttagtgaatagccctggggttaagtattattagggcctgggtcgggag

SEQ ID NO: 631020 - DNA, 799 bp, Homo sapiens
tctgctctcggcgccctcgcctcttcctccgctcctccttcgcctcttcctgcctcctcccggttccgcgcgcatccagcctaatcccaacccaggcgaaccgttcttattatttccgttttctcgccatacagcctctgacaaggtgatccgggcgggcccgaagaatataatcccctcaccgtctcacactagtatcgcatgtccatatcagaacctcaaatctttcgacccctttgctgatgcacctaagggtgacgataactcccggcggggccactgacgattaccttccatataagatccagcacgggacggcagaagacactgactatggtcagggcatgcagatgattatgacaaaacagaacttgtgaacgtttccaacaagaattggctgtagttggtactgtggattgaccatccgtgatacggagagggttattcagcttcaagggtgacaaagaaaaaattctgcagttcctattgaaggttggcatggtacgacggaaacagctacgctcatggattcataaactgaccctaaaataggtggagaatttctggaataggtaggtcttcaaccccgggtttgtttgcctgtgaatgattccctgagaacagggacttgtgcatgtattaatcatccaagttccatcattttgctgattaccagaaaccttggggttatgtagactagtacccatagaacaattgcgtagatggtaccaaactcatatgttttaatgtccactggaaactgttgcgtgtattgtacagttaatcgtacatggacatt

SEQ ID NO: 631021 - DNA, 806 bp, Homo sapiens
  misc_feature (659)..(659): n is a, c, g, or t
  misc_feature (671)..(671): n is a, c, g, or t
  misc_feature (683)..(683): n is a, c, g, or t
  misc_feature (725)..(725): n is a, c, g, or t
  misc_feature (744)..(744): n is a, c, g, or t
  misc_feature (781)..(781): n is a, c, g, or t
ggtcccttctaatttgagttatggtgaatggttgcatggatttcgagaaaatagaggcaaacagcaatgtatggctggaacttcagggtcagaggaggttaaggttctagagcacaagttgaaagaagctgatgaaatgcacacattgtcacagctagagtgtgaacacacatacaaatccgtccttgcagaaacagaaggaattttacatgaagctacagagaagtgttgagcaagacgaaacataaatggcaaagttcaaggtcgatgaatcacacaagactattatacagatgcatgtcatcagtttacactcttcagaacaagagctagagcgattaacgaagcgacatgactaaggatattgaaaatctgagaagagaacgagaacatttggaaatggaactagtaaaaggcagtagatggacccgagtctacctatgttacatgaagtcacgcagagttgacaggcacagttaaattgaagacactcacaaaacttagaactgaacaaaatgaacagacagaaggtagctggtgatttgcataatggctctaacagtcactggatgcttatccaagtcaaaaatagtaaaagctgctggagacactactgttacttgaagaatcagtgatgttgtccccagaaacggagtctnctgagaggaganatgtctgtaagnctaaatcagactgtaacacagttacagcagttgcttcaggcngtaaaccaacagctcacanaggagaaagagcactaccaggtgttagagtgaagtanttgggaaactgttcatttgaggata

SEQ ID NO: 631022 - DNA, 811 bp, Homo sapiens
agaaggggcgggctcgcggggtctcgactgcttctcggcttgctcggtggagcaagatggcggacatctccctggacgaactcatcaggaagcgcggggcggccgggaaaggacgtgttaatgccagaccgggagttggaggtgtccgatctcgagttgggatccagccaaggccttctcagccgagtcaacactgcacatgcaccttccagccagagattatgatgcccggcgagaagattggcctctcagatgccctggctcaaactgggcagtccaggatgcccgggagaagctttagcagcaaagatgcccgatttcgaatcacagggaaacgtgcaggatgccagaccagatgttgaactctcgccaagcagccagagcacggatgccccagaagccccgcacaggtatgctgatgcccagggagacagatcagcttgacagacggagttcccctagctgccttccatcaaacaccatcccatttgggaacacagtgacccctgctactgacagctcaccaaaacacatccagaacttttatctgacctggatgacaagattgatgatggtaatagctatccgataccttacttaaacagcatgacagtatggcagactacagtgcagggattataactcacaaaccacaaatgggctcgggacctacaagcaagaatgtcccaacgcctaataccaatgatccaaatgtgaccaatcccgacacatgaacccaaaaagatggataccaagaaaattgagtgcactactcacaggcacccatgcagcatccactatacatagtagt

SEQ ID NO: 631023 - DNA, 267 bp, Homo sapiens
  misc_feature (27)..(27): n is a, c, g, or t
  misc_feature (33)..(33): n is a, c, g, or t
  misc_feature (43)..(43): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (59)..(59): n is a, c, g, or t
  misc_feature (72)..(73): n is a, c, g, or t
  misc_feature (75)..(75): n is a, c, g, or t
  misc_feature (85)..(85): n is a, c, g, or t
  misc_feature (192)..(192): n is a, c, g, or t
  misc_feature (217)..(217): n is a, c, g, or t
  misc_feature (246)..(246): n is a, c, g, or t
  misc_feature (263)..(263): n is a, c, g, or t
aaattcgagctcgatatcctgagtggntggatnaggtgctggngtgtggntgnatnagntgctggtgtgtgnntnaggtgctggngtgtggatggagatatagatgtgtgtgtgtgtgtgtgtgtgcacgtccgtgtgtgcgcaggcatacgcactgttttctcctgatgtgaggaagggtcctcatttggncctcagctaaagctgcatctgagtnaaagtcagtttcctggagaaggctcctcngcaggatgattccgtcncatg

SEQ ID NO: 631024 - DNA, 432 bp, Homo sapiens
  misc_feature (11)..(11): n is a, c, g, or t
  misc_feature (31)..(31): n is a, c, g, or t
  misc_feature (245)..(245): n is a, c, g, or t
  misc_feature (420)..(420): n is a, c, g, or t
tcatccaaagnaaaaggctggccctccattngggggaattcccccccccataggacaggcatggaggcattttggattttaccctgcccctcaaactgacattttggcctcattataatagtagaagacagcccctacatgggagatgtaatatgcctaatgagacatgtgacatatgaacaagcatgtacagctactgtgcatgtgcaccccagaagaccacccggaacatgcttactagcaanacctcttcccaccaccttatgaataatcatgtaagactcccataaagggagtctccctactgccagtctctgctgtctcacccttatgagcagcctgccttgaaccctctctctcacggtatacagtccattctgcatgtaacttccaaaatattctttttcctttgcaataaanaactctatgctg

SEQ ID NO: 631025 - DNA, 419 bp, Homo sapiens
  misc_feature (13)..(13): n is a, c, g, or t
agtagagacgganttcaccatattggccaggctggtctcgaactccaggctggtctagaatcacctgaagtgattataggtgtgaacactgcagccagcctatttatgtatttatttattcaagacagggtcttgctctgttgcccaggctggagttcagtggcttactgcagcctccgcctcctgggttcagtcttatgcctcagcctgccaagtagctgggattacaggcgtctgcaccacacctggctactttttgtattcttagtagagatgggggttcaccactgttggccaggctggactcgaactcctgacctcaagtgatccacctgcctctgcctcccaaagtgctgggattacaggtgtgagccaccgtgcccggcttatttcttggctcacttaaaagcacatcatca

SEQ ID NO: 631026 - DNA, 357 bp, Homo sapiens
tgctaaataacataaaaccagattctgtcgcaaaacctaagaccacagtgatagtttgaaaaatgaaagttttggccgggcacggtggctcacagctgtaatcccagcacttttggaggccgaggcgggcggatcccaaggtcaggagatttaagccatccttgctacatgggtgaaaccccgtctctactaaaaatacaaaaattagccgggcgtggtggcgggcgcctgtagtcccagctacatgggaggctgaggcaggagaatggcgtgaaccctggaggcagagcttgcagtgagccgagatcgcgccacggcactccagcctgggtgacagagcgagactccgtctcggaa

SEQ ID NO: 631027 - DNA, 873 bp, Homo sapiens
gggactacgaagcccaacctggacctgctggagcagcaggcagcccagctcatccaggaggccctcatcttcgacaagcaagcgacaccaactataccatggagcacatccgcgtgggctgggagcagtctgtctcaccatcattgcccgacaccatcaaggaggtggagaaccagatcctcaccgcgcgacagccaaagggcatcacgtcctaggagacagatgctagggagttccgggcgatcgcttcaaccacttcgagcaaggatcatggcggaggcgctggggcccgaggagtgcaatggcctgcctcactcagcctgggctacgatgatgggagaacgaccgggagggttgaggccgatgttcaaccgtaatcatgagcctggtcagacccaatcagtagcggccttgtgaccgttccaagcgcttcaatcgacttcatggtcgcgggagaggcaacgatacgggacgagcggttgaccaggtcaatcgcattcctgtcaagggtcattagcgcaggggagcaagaatcttcattcacagggtgaggaggcatgcggatgagagctgggcccgccgatcgagggcgagtaactggcatcgtccaggatggcagcgagtaccgaggggcccgcctgaaccgggaaccccatcccaacacaagacccgcgggccttaggcgataggtcctgggccctcgacaggtgttcgtccaggagttatatgcttagacgaaatccgaaacaatacaaaagagggagagcaacacataggcgcgaaaaccaactcagacagccgacaaagacacagacaatccatcgacaaacagagcataagcgcattcttgagccagacacaaacgtaatcggc

SEQ ID NO: 631028 - DNA, 774 bp, Homo sapiens
tgagacagagtctcgctctgtcacccaggcttgagtgcagtggcgcgatctcagctcactgcaacctctgtctcccgggttcaggtgattctccagccttagcctcccaagtggctggaattacaggcgtgtaccaccacaccaagctaatttttgtattttttagtagagacagggtttcttcatgttggtcaggctggtctcaaactcctgacctcaggtgatacacctgcctcggcctcccaaagtgatgggattataggtgtgagccactgcacccagccttaattacccctttaaaggccctatatgcaaatacagtcacattctgagctactgggggttagggcttcaacataggaattcaggcagacatgattcagcccataacaagggctttcacttttttttttttgtagaaacagggtctcactatgttgcccaggctactcttgaactcctgggttcaagtgattctccagcctcagcccccaaataagctggggctacaggtgcaccagcacgcccagctaatatttttacttccatttttttagacggagtttagctatctttgcccaggctagagtgcagtggcgtgatcttggctcaccgaaacctctgccttccgggtcgggagtactcctgctcaagctcccagtggcgggatccacggatgcccaccttgaacggtaattgggtttaggggaaaagggttcccctgttggcggtgctcaaatcccacttgatgttggcccctcatcccagggcgga

SEQ ID NO: 631029 - DNA, 286 bp, Homo sapiens
cgggtgacaccgacactgccgagcaggtcatcgcctccttccggatcctggcttctgataagccatacatcctggcggaggagctgcgtcgggagcttgccccggatcaaggccagtacttgatcaagaaggttgcccgcctctccgggccaaggaaggttccttgtgcaattgattaaggttggttcttttccggaatcttcggggagagagaactttgatggtgagattctctaatcactcatcccctcaaaatgtaaaaaaagggggggtcacagagtgggga

SEQ ID NO: 631030 - DNA, 1153 bp, Homo sapiens
gtaaacagatgagtgtgatgggctttcaataaaacctcatttgcgaagaccaggtggaaggccaggatgtgacccatggcagctgtgtgctaattccctttattttcctttttctttctttcttgtctcttctgttactattgtatactttgctttaggcgttgggggagggagcgtcctgtggcccggtgtgggatgtgcccgaggaggaagtatttgaggagtcttacgcaaggaaggtacgcagtggacggcacgggattacacgagtacagatggttccgtagaccaacatgactcgtgaaagttgacgattggaagcctactggcagcaaaagggtgaggcattagtcgctactctagctcggggattagatgagaagggtgttacaagaggcgcacaacggtgggttatgcacgtgtgtatggggccatgactggtttctacttattctctgtgaagccttgcagttttttgtggccctacctcgcggagtttcaagggggttggcgggtcttgacttggctcttgaatctgacacggcgcctcctgtgcaaaaatgccgctttactacacaggggttgtagagggatgcgctgaatcggtgtagagaacacttgggacagcggcgcgcccaatttgtcgtccattgggtccctggcgttatgttgtaacccgacattttacatgagctgcggctggagcgaaaaattcagagaaaaggctctagattcggggaagtggcccaaggatggacacccaactggtctggcgcgaacgcatcacactcgttctcgaacggcgaatatatctcgccccagttgcgcgggggccaccgctgagggggctacatatgttagacctccgcaaaagatctcggaaatccatagaaagtcccaaattgctcaattttttcccccggggggtttaatccacttaattaccagcttatgtttcgagaacgctcaggacttgggggattatgcatcgggaactcaagggggaataccggatatctgtgggcaattgtggcggaagaagcaatctctttcgccctgaaggcccaccacggggtgggaaaaacttcccgtgaatccccacggggagaaccctgtttttttgggaaaccggaaccctttaaaactctccagg

SEQ ID NO: 631031 - DNA, 101 bp, Homo sapiens
tgtcatcgagctcggtcctacttttcacaggggacactgtgggccagcaaactaagtggatgtagcctaccagttgaatccaaaccagaccagcaaatgtt

SEQ ID NO: 631032 - DNA, 119 bp, Homo sapiens
  misc_feature (18)..(19): n is a, c, g, or t
  misc_feature (24)..(24): n is a, c, g, or t
  misc_feature (44)..(44): n is a, c, g, or t
  misc_feature (54)..(54): n is a, c, g, or t
  misc_feature (79)..(79): n is a, c, g, or t
  misc_feature (84)..(84): n is a, c, g, or t
ccacattacaggtctttnntgggnagaaaccgaaagaaatcacnaaagcaattnagagagctcaaataatggggtttangccanttacatacaaggatcctgcatatctcaaggaccct

SEQ ID NO: 631033 - DNA, 323 bp, Homo sapiens
  misc_feature (256)..(256): n is a, c, g, or t
gctcgacttttaaaaggagaatttatagacctagaatgttgggatttttttttcctttcaggacagaaatgtgtacctttttgtgtgtgaaatagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggtttcttttntctttttttttttttaagtaagtggttatttaaaaatctgaaatatgggctgggcgtggtggcttac

SEQ ID NO: 631034 - DNA, 1246 bp, Homo sapiens
  misc_feature (211)..(211): n is a, c, g, or t
  misc_feature (668)..(668): n is a, c, g, or t
tggtctactccgctaggggggtgtccacactggggggtcttttgtgcggaggttttatatgctttgttgtgtccacccaagtgtcgtgttggaggaggagagatgtcttgattgtctgtcggggccgccccacgcgccgaataattttggggtgcgccccgttgttcgcccactgtgtgggattgtctgttggtccggcagccagtggcgnccccgggctttcccttatgtggggacgcgtgctcttataaggggtttcccgataatgtccgacagccccccgcccacgagttttatggcccccacccgcctttggaggaggaactctcccgcgctgcccgcccaagaatgggttatataagcgcatgtatggccccttttaaacggcgctttgtttaccccacagggggggtttgtctcctcttctcctgggagtggaggcagaccgtattgtccgcctggtggcgcgcccacttgagtttgagagttgtgcgcccctcgctgttgtgtggaacggtgaactctggctggaaggccacccccggtaaccaaacagttttgtgtcgggtttctctatagccccccgccgcacgcgtggagagatgggtttcacaaacagcccacgaggccacacccttgtggtttggtaacccacatgtgggtaagcncacgcggttatacactatagcctcggaggttctctgttgggcaccacttggtttttctccacccctcgcctcgagttttctcgtgcgtatttctcgctgttggagattaatacgaaataaaggtgacccacgcggctttcttctcggtgcctcccaagaggaactctggagtttataaaggtggtactgtgaaagggaactcgttttggcccgcgatcacatcactgacattggtagaccccgagctgcacactaccacgctgggtttatatctaatgaactcccgctgaaaggtttaacttcacgaacttcctcgcccctcctcccaccccgcagatgcccgagtctctgagagaagaagccttgggttaacctccagtagttagatccaacgccaatgtggacctgaatcgtgcttgttgatccacgtgttgaagaaaggcgccaaagggaccttttaatataatttgccccgtgtagggaattgtctattcctgatataaattcaccgtagtactcttgctttaaggccagagtttccagatttactgttggaattaacccccactcttccatga

SEQ ID NO: 631035 - DNA, 295 bp, Homo sapiens
ggcgacctagaggatcccctctctccacactggaggggtagaagttcaagactaaggtgttgcagtgttggtttcttctgaagcctctttcctggcttgcaagacgaccatcttccccctctgtgtgtttatatggtattctctctgtgtgtctgggttctgattttttcttcttataaggacaccaaacacactggattcgggcccaacctaataacctcatgaaacccgaattaacttcctaaggatcctgtctccaaacagactcacattctgaggtccagtgtggagagag

SEQ ID NO: 631036 - DNA, 890 bp, Homo sapiens
  misc_feature (785)..(785): n is a, c, g, or t
gcgggcccccagcgtcgcccgccgggaggaccgagcctaagagggcagcgcgcctgaaggaacgcgacggtcgcgcgcccgcacgatagtttttcagtgcgtgtaccaagcgctcttgaattactctggtagcttttcgcagaaagacccatgacttcagccagcattttctcgagttacgatgaaggtcctctgtatgtcagcatgggcagctcacataacctggagaaccagactgcagcagcgcaccagaagaacctcctgttccttcagtgggagcatgccagctggctctaggggctgctctccgagatcaggcggctgcagcaggactgcacagatttactgatatgagctgacagtcaaaagttcggaacagacaggagtacgggacttctaaaagcagtgaattaaatgaaaaagatgtgaagagctgggaagtcccagtggatagtgaaagatgaacgaacacatgcgtggagtggtggagtataagtgtgcagcagagaatggggatgatctacaagtgtgtgggagtaacaaccactcagaggagccgatgagtagctagagtagcctgtgggagctgaaggttgggagcttactggtgggtgatgctcgtatgtcagagtaggaagcgagaggggacagaaaaccatcggtctaactgagcttgcctagatgaagcccgcctagaagaaagctcatgagcctcagtgggatctaagatgccagccgtcaggagccccgtggctggccagtacgatgcagcgcccccaaaaganaagtaccgaatgctgcgtcggttaaaagaggccctagccctgtcccggaatttgcaaggtaagatctggccaagggaacctttggggaccggttattcggccacc

SEQ ID NO: 631037 - DNA, 120 bp, Homo sapiens
ctgcggtgctctgaggtcccactgacatagaggcggtgaattgcttgagtgtggatattgcagtgatgctggatcgcacctctgcactccagcctggagacaaagtgtgactgccatctc

SEQ ID NO: 631038 - DNA, 104 bp, Homo sapiens
cctcaatgtttcggatggccaggtagatctcatgagctcttggactcgttcttgccgtgtcagcactcggggagagccctccgctcgatggcttgaacactatt

SEQ ID NO: 631039 - DNA, 157 bp, Homo sapiens
agtaacctcgttgtcttctactgaagcagatgcagtggtgagctggtcaccttacatccgcggcaggtgctgtgtggagtgaaggccaggttgtgttttagtaagccatctgctgcttctggtttcttcaagctttcatctggaagcttgattttgc

SEQ ID NO: 631040 - DNA, 124 bp, Homo sapiens
cgggattttgcttctgagtagtgcatcttcagccacggtgttggtctacaactcgcacaattcagcagcattgggtcttgtggagattgtgtttgaggaagctgttatcatcttcatcggagtc

SEQ ID NO: 631041 - DNA, 844 bp, Homo sapiens
taccctcaacaaaatgttccgctccttcaaagccccctctttccagccacctcgtcctcccaaggggaaccacctctctctgttctatgacccccttacatgttagtttctcttccccctatgattatcttgcttagcggcgcccccccccgcttcatcactcctcttttaatatccgccgtggcctctctgaaccatctttctacacatgctgaccaaatttctgtcctttgtacggctatccatccatcgagaatactgtctttctgctacttacgcgagcaagtcctccctccgagagtgctcttattatttgttcttgttctctcccaacatcagcatgattttacacccccccccgtggttgaaagatcccctcccacccacacgtataaagaggttctatatatgtagcgcttgtctacaccacacacacacatgtgcgggttcttcgtaatctctcttttttctaataaacacggttgccccaggcttgagtcttcataccctgcaatgcactacgcaacttcgatcactcgctcgcacacccccgctgacattgttaatgattatatataggcagatgccacctctgaactctagtattatcatttctcaatatcgtacaatgtcttctgttgattgacacatcatttcaaaacaagatcctagtataggcttacacgtgagcataaaaggcgaacacttattgccataaccccctccaccatcgtctcgtgtcgaacatgactagatatgagatgctattctcgtgcctgacatgcattcctctcatcaaacaactaccacctacagaacaacaatttccaaaccacaaaacaca

SEQ ID NO: 631042 - DNA, 207 bp, Homo sapiens
tggcccatggatggatgtgcagcggtgtgagcttgtgctcattgcaacctctgcctcttggactcaatgtgatcctcccaccttagcctcgtgagtagcgggggctacaggcttgtgggtgggctaattttttatatttataggggatgaggtttctccatgttgcccaggtgggtctcaaactctcatgctcaagcaatccaccag

SEQ ID NO: 631043 - DNA, 385 bp, Homo sapiens
  misc_feature (34)..(34): n is a, c, g, or t
accacaggctggcacagagcaaactcttctcaanaaaaaaaaacaaggtcatgagtgagtagatatggggtgcttaaaagacccctggataaagtgactgtgtccgggcatactggccagttgttactttgagcttgaccctcattcttcctactttccactttatacgttgttacactgggatatcggtgtaggcttctgtcctcctctactgttgacttccccagcatggtgagacttgtttgtgaacccctccagtccctaagcttatagactctgtggacaggagaaggaggccagaattgaaagtgcatcgagaggtcttgtaagtgaaatggccactgattccccttccctttttaagccggcctggaatttgggagtt

SEQ ID NO: 631044 - DNA, 266 bp, Homo sapiens
  misc_feature (76)..(76): n is a, c, g, or t
  misc_feature (187)..(187): n is a, c, g, or t
  misc_feature (214)..(214): n is a, c, g, or t
  misc_feature (235)..(235): n is a, c, g, or t
gaggatccgcgcaaccatagaactcacaacccagccatatacctcagacacaatggaatgggcggaggtcgaggtngacaaaccctgagtaatgttgggcacttccgcaccggagctgttcttacctttgataaagtggatgttattgctattaatgatctcttaacggacttcaactgtaaaattngcatgatctagtcctatccaccaacgncgaacaatatgctgttgccangattgagcacgagccgtttgggctcaacggc

SEQ ID NO: 631045 - DNA, 903 bp, Homo sapiens
  misc_feature (35)..(35): n is a, c, g, or t
  misc_feature (38)..(38): n is a, c, g, or t
  misc_feature (82)..(82): n is a, c, g, or t
  misc_feature (113)..(113): n is a, c, g, or t
  misc_feature (128)..(128): n is a, c, g, or t
  misc_feature (138)..(138): n is a, c, g, or t
  misc_feature (149)..(149): n is a, c, g, or t
  misc_feature (151)..(151): n is a, c, g, or t
  misc_feature (174)..(174): n is a, c, g, or t
  misc_feature (193)..(193): n is a, c, g, or t
  misc_feature (220)..(220): n is a, c, g, or t
  misc_feature (240)..(240): n is a, c, g, or t
  misc_feature (243)..(243): n is a, c, g, or t
  misc_feature (253)..(253): n is a, c, g, or t
  misc_feature (261)..(261): n is a, c, g, or t
  misc_feature (271)..(271): n is a, c, g, or t
  misc_feature (276)..(276): n is a, c, g, or t
  misc_feature (298)..(299): n is a, c, g, or t
  misc_feature (322)..(322): n is a, c, g, or t
  misc_feature (343)..(343): n is a, c, g, or t
  misc_feature (349)..(349): n is a, c, g, or t
  misc_feature (355)..(355): n is a, c, g, or t
  misc_feature (361)..(361): n is a, c, g, or t
  misc_feature (367)..(367): n is a, c, g, or t
  misc_feature (374)..(374): n is a, c, g, or t
  misc_feature (377)..(377): n is a, c, g, or t
  misc_feature (390)..(390): n is a, c, g, or t
  misc_feature (435)..(435): n is a, c, g, or t
  misc_feature (453)..(453): n is a, c, g, or t
  misc_feature (481)..(481): n is a, c, g, or t
  misc_feature (587)..(587): n is a, c, g, or t
  misc_feature (618)..(620): n is a, c, g, or t
  misc_feature (833)..(833): n is a, c, g, or t
  misc_feature (881)..(881): n is a, c, g, or t
gcaggcggcgggcaaggacggcgggcaaagcgcanacntccccgctcgttggcccgggtatcccagcgcggacccacgcganacgctgacgccccgacgccgatacggccganccaaataaagggganggcccgaganggagaagggananagtgggagtttcccagcccgcanaactttcgaagttgaaaanaaaacccctggaacgtgcgctcagcantgggattttctggactcaangangactctgaanaatgtcancatgcgccanggcantgtgggcatgcagccaaaaaannagcgctggagcatcccagctganggcaggcatctgatggtccanaaaaanccccancagtanagccancgcaacngcnattctgctaaccntgaggaacaatgccgccgaagctggtcctctgactccaaaaaatnagtcatctcctctgagtnagggaaaacctaataccgagtggtgctnataggggaacaggagggtgggcaagtccactctggccaacatctttgcaggtgtgcatgacagcatggacagcgactgcgaggtgctgggagaagatacatatgancgaaccctgatggttgatggggaaagtgcannntatatactcctggatatgtgggaaaataagggggaaaatgaatggctccatgaccactgcatgcaggtcgggggacgcatacctgattgtctactcaatcacagaccgagcgagcttcgagaaggcatctgagctgcgaatccagctccgcaggccccggcagacagaggacattcccataatttttggttggcaacaaaagtgacttagtgnggtgccgagaagtgtctgtatcagaagggagagctgtgcagtggtgtntgactgcaattcatcgagactc

SEQ ID NO: 631046 - DNA, 925 bp, Homo sapiens
  misc_feature (211)..(211): n is a, c, g, or t
cttctctcctcactcacccttcctggtgctttgggctctccttccttctcagacaagatgtcttatcagaaaaagcagcccacccctcagcccccagtggactgcgtgaagacctctggcggcggtggctggtggcggcggcggcggcggtggtggctgctggcttcttcggcggtcggcggctcatggcggctggtagcagctggttctnggctgcaggctactcctggctggctggtggcatactctggcggcggctgctgtgcggtggctcctccggctggcggtggaggctggtggcgcagccaattggaagtgctagcgggaatgcggtagctcacttgatgagagaagcatgtcaaacgatacgtccctgagaatgcgcaggcatggcatcgcatcgcaggacagagagagggcttcatgggcaaggttgacttccacatgccagagatgcagacgtcctgcgcacacagtgacatgcatatcattcgctccaagtgttgggtagagatcgaatcctatccaagcgaatcgcttggcctcccctgcattgcatttcatcgcatggcatggaagtgtgagtggcattgatcacaatccaggtgaagtgaccgggcatgcgggaacattggcgtgcattccattcacaggagaaggaagaggcagggaattatcatcaaagggccacaaaggcagtggtaccaagagatagaaacaacaaagagtaagaaagaaaggccgtaagacaaaacgcagagcaagagatcccatccgagagggagccgcgcacgcaaggaagtagaagaagacacaagaaagagcaggcgacacaccgagacagagcatcgaagaaaattcgcagcgattaacagcaaaggacagagaaggaacaacaagagagagagcagagctccaagggcaa

SEQ ID NO: 631047 - DNA, 110 bp, Homo sapiens
cgcggtaattacatactccagaaagagcctctgctcacactggctagaacaacaacaacaacaaagaaaacccacaaacaaacctggagaaaatatatctaaactctctg

SEQ ID NO: 631048 - DNA, 950 bp, Homo sapiens
cttagcgcctatttgtgatcccgcttttgtccatattgttcttgcccgccaaaatccggtcacaatccccgtggggggccacaactatgctggttaaccgacacagcggcttttcccccctctgccaatttctcgtctcccgcccgctctcatggtggtggcgccgccccccggcgcgccactttaatagggtgttctccggtctgcgccgccctggagattcatgtctcctgttacgcaaaggcgcgcacaactgggcaggtgtgttctccgcgctggtcgtcgatgaacggtgcgtccacacgacacgattgttttctgtgtgcccactctccgcgttgcttccgaccaaagggcgtcgtcattctcccccactataaaaggagcctcctcttccccggggtgtgccccgcttatttttccgcctccccaccctttagggcctaatgcttctcgcccaatcgccttttggctccttgtctcataattctcctctggcgcgtgaaaataacactgtgtcttctcccccacaaccgcatgtttcgcggcttattccctgcgaatgtccccccgcccgttttctcgggggacactccctcggagtcgctgggcgcccccccacgggtaaacacctgctctcttcatctcgtacggacccgatctacatttttggtgtacacccatacaatttccagatctgtccacattaccggataaaacacacgttctcgtttgcatccttagaaatcccttaataatattcgacaagccccccccccatacccctgtccggtccaaatatggaaagccccccccccccttcccccaccttctggtggaccccccaggaaccaattattgtctcctcaccacaaaaagagaatgaatctctagaccccccccctccttcggttctaccccaccccggcgcccccacttctcccacaaac

SEQ ID NO: 631049 - DNA, 890 bp, Homo sapiens
cagagttgtctaagtgccaaacgggtgtgtattcccccagtaagttgttaccccaccttaaggatttccattctctaattatacatttgcacccctaacaaaatcttggggtttagaattccccaactgtttgaacacacgtccttacgaaggtttgatgtccttcttccctaatgagaaattgtcctcgcaagaagttcttgtttcccagaatcccccctcagggcggtatgtatgtcatcatgactacagttctctcccccccaggtgaaaaaatggtccttcactagagatgtctccacgccggaagtactttacatcagacacatacagagtgcagaccttaaacatatataataattgtcgcaacatgaggaatcacccacaattactgtgtatcgccactgcctccggatatatagtacaagacacccttagttctcaatctttctcccgcatgatagagcgctcccatacctccttttaattattatcccgagatatatctctctggactattcactgtgcaagctttttcctcctatttgttagccccctctcgaagcccgagttcctctctctcgcccctatatctgtccccctcttgcgaccacaccacctttttcatgcctatccgccccacataatcatagcaccaatcgattgttctatcagagtacttacttacccccatcccatgaccttcatactgtagcgagtacgtgcgctacccaccagttaccaactccaagggagttctaagcgcacccacccgaataaataatatagagatggggtctggatatggtcaatacaccatactcaatctcgcctctccatcttaaacgcccttcttggaaagatcaacagtattccccccccacaaaaca

SEQ ID NO: 631050 - DNA, 366 bp, Homo sapiens
agtccgggtcgcatttgtattgcgtgcctagacagtctcttacaatacttagtcatttagatattatattattagtatctttcttattgatttgtaactgcttttgatatactaaagaaagcatgggctgggtgcggtggcttacgcctgtaatcccagcattttgggaggccttggtgggcggatcacgaggtcaggagatcaagaccatcctggttaacatggtgaaagcctgtctctactaaaaatacaaaaatattagccgggtgtgatgcagggcgcctatagtcccagatactcggaaggctgaggcaggagattggcgtgaacccgggaggtggagcttgaatgttgagccgagattgc

SEQ ID NO: 631051 - DNA, 394 bp, Homo sapiens
aggctgcgtcttgactgaagtgctaagtgttacagacatcgaccacaatgccaaggcgaatggggacaatgaaatccatggctgagccctaagggcaggtgcagaggatccagcatgttattctgaaaccccagaatactccgcagctaccgggtggacagagcctggatccctgaatgtcttcatggaacagaacattctcctcactccagtctgtttgaaccagaatatgacctgggcaagaaataagccttaattatatttgaccatattatttctggtgatatttctatggctgtaagtccatgttgagggggccccgggattctgtaaagcctcttctattaaaaaaaaatgcccaaggaaaaaaaaaaaaccggcctctctggcctca

SEQ ID NO: 631052 - DNA, 393 bp, Homo sapiens
cagtgctacaaacgcgcacgaattcttgcaggttggcaaaaagcagcctgcatctggatgtactatatgatgttatgaaaagtaaaaaaccatagaacatggcaaaagatacacgaaccaattatgttgacatactaggaaacttagcgtggatcttcgcaagagaccactaggcaaaggaggggttataccagtataagaacatttgtcaacaggtgaacataaaatctctggaggatgttgaaagggcatatttgaaaatggcagaggaaaaaactgaagctgctaaagaagaatctcagcagatggtcttagatatagaggatctagatcatattcaaactcctgagagtgtactcctaagtgctgtaagtggtgaaagacactcaggat

SEQ ID NO: 631053 - DNA, 704 bp, Homo sapiens
  misc_feature (367)..(367): n is a, c, g, or t
  misc_feature (549)..(549): n is a, c, g, or t
  misc_feature (588)..(588): n is a, c, g, or t
ataggatgaatctgaacatctctccatctagagcccaatgaaggaagcttcaaatgagaacatgatggaatcagtaaccattcaatcttttgtcctaggatggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagtttngttattattggtatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtntctttctttctttttttttttttcggaaagggagtctcnctctgtccccaggctggaagtcgcaggggggcaacctcggctcagtgaacctcggctccaaggtccaaggtgatctcctggcctaagctcccagagtagctgggataacaggcgtc

SEQ ID NO: 631054 - DNA, 100 bp, Homo sapiens
ctagtctgactcaatggtaacttgctgtatttgaatttttatagatgtatatacagggtgggggaaatgggcggttctcattaaacgtcaccatttcatg

SEQ ID NO: 631055 - DNA, 262 bp, Homo sapiens
  misc_feature (82)..(82): n is a, c, g, or t
ttccccgtcccgccacagcttctccctcgtcccttcacagcctgctccttcctgttccacgcagcttccactaactgcccgngagtagactgactgcgtccgcccacggcctagtccgcagttgcctgtccttgctgcctagcaccacgtctaccccgtggggccagccctttcccccgctcccgatcagctcgcgccgtcttctagagctttgttaatcacgccccggagggtcttctcagtgaaccttctctgagcctgt

SEQ ID NO: 631056 - DNA, 679 bp, Homo sapiens
gagggaattgggcctgtgccctggtgccagtccatgtgctcgctggctggctccattgccctgtgtcacagtgatgcctgttctgtcccccgggcagctggtgtgcctccacgccctgtgggtgccctggtgaccagtgctggtccagcgaaggagtctactccagcgaaggccagagctttgcgtgtgctccgatgtggcgctgtcctgggtacttgctgtgatggagtgggacatatgatgatgcagcagagtgccaagttacttgagcccaagcatgagagagtgccccgagatgattgagcgagctcccacggtggtacctagaccagagtttcggtggcaatgggattctcagtaagtccctctagaaggctcggagtgacgcatgaggcaagaaagcgttgacatgcatcaatgggtaccagggcttgcctggtatggaccgggagaagaattgaacatttacctatgtcctttggggcatggctccctacggtctttgcgatgagcaaaccgagcgaggggctcctaccccgcagtgggtgttccgagcttctaccggttgcctagggtaagggattgcttcacttacacgaatgaaatctgtgctaacagtgctcttggatcgcgcaaggggcatatgacgaaagggatatgataccttaaaggagggtag

SEQ ID NO: 631057 - DNA, 473 bp, Homo sapiens
gactacgcggctgtgccgtgaacaggtgttctggtctctctttgatgtcagagtggaatgacctgaggctaaggtgtttttgttaacttgaaactgacgtgcaggccgctgatggcttgtggagacctgcacctcgtcatttcccatctggctggggttgattgctgactgctgagggacaccagggggtcagaggtggaggctgtggggcatgtgcttgcctgagttcgtggctgtctcctgtgtcaggaaacaggtgctggtgcttatttttctttcccagggtccacagaggcccaggagagaagcctggttgctgccctctgtctcgtagcccccctttcacagagctgggttatttggggtagagatcctctgtctgtgccggtccacccagcttggtttctttggggtaggagcaccaggaaaggctcccgtggctcttgggagctcctagccgcgtagtcagatcg

SEQ ID NO: 631058 - DNA, 232 bp, Homo sapiens
caactaacctcagggtcaagagattctcctggcctcagcctcccgaggagctggggactacaggcaactggccaccaggcccagctaattttttggtattttaagtagagacgggttttcaccggggtaagccaggagggtctctatctccggacctcgtgatccacccgcctcggcctcccaaggtgcggggattacggggggggggcatcgataaacacggggtaccgag

SEQ ID NO: 631059 - DNA, 867 bp, Homo sapiens
gcgccaggacgtgggcgtgcatgatgcccgagctgggtctgagctcgagccaggcgtcgcccggagagattcggagatgcaggcggctcggatggccgctaggcttggggcgtgcacgctgctgatggttgcggggagcggagatgctcgtcggtctcactggttggctcctgtgggctaaccccggcccggtccctgcccggagagcccatatgcctggtgggatgcctggcatctagacttgagacttcttggacaagtcaatgattccacactcccgtctgacgcatcgtgaaccaagtgaaaaaaacctgagccaagggcggaatctaatgtccttttgctgtgggaatgttcaaaggaccatgctcaccgaacagaatcatggtgttcccatgacccgtccgtgctcaacgaagcacgcagacacagtttcttaaagagctgagtggatgcctgtgtccctgtttcttcgacggaagtgaatctgaatcccgctcctagatgaagtgactgctcttggagatggtgtgacgtgatgagccacttggtagggcctcaaggagctgcggggcctttggtctgcaagtgcccagtgagctgggtggtgtgggcctttgcaacagccagtacgcccgttgtggtggagatcgtgggcatgcatggaccttgcgcgtgtgcattaccctgtggggcccatcagagcattggtttcaaagtgcattctgctcttttggtacaaaggccagaaagaaaaatacctccccaaggctggcatctgggggagactgtggcgcttttctgtctaaccgagcctccaagcgggttcacaatgagctccatcaaactctggtggggccacccctt

SEQ ID NO: 631060 - DNA, 197 bp, Homo sapiens
  misc_feature (69)..(69): n is a, c, g, or t
  misc_feature (75)..(75): n is a, c, g, or t
  misc_feature (119)..(119): n is a, c, g, or t
  misc_feature (162)..(162): n is a, c, g, or t
  misc_feature (189)..(189): n is a, c, g, or t
  misc_feature (192)..(192): n is a, c, g, or t
ggaaggccccccattaacctttaaagttacaaatgttaaaaaaagttatgtgcctctccttcccaaaantgttangtgtgtagctattcttacaaatgaggggaggggagacggtgganctgtggaggctcggagagccagaccagggcatttccctccacnaccagcgggaactgcatggacctctcnccnagacc

SEQ ID NO: 631061 - DNA, 896 bp, Homo sapiens
tcccagttcacaacggttgaacaatcgggaacaaacaatcgtctgccgtgcacacacacaacagccggaattacacaacattttatccctgccccacccgttgaaaaccggtgtccattgaacccgtggtccatcagtgccccttcattacttcctaggaacagagtacgttctttctaactttcattaccccctgctccccactatccatagaccttcctctttgaacaacgctgctcgcctaataatgcccctccttattttcctgtcaactgatgtttcctccgcgccaggcctccccttttcttccccgcacacaggggggttgcaccaccgttcccttccctcccccactagttcaccgtctctcctcaccagttggggaccccaccacacttttaaaaaaagacaagagagggacccatcttccaccttgattgacaaaataactcaaataactttcgtggaacatctcccgtgccccccgcatctgtcaatgtttcgtgacacccactcatttatttgctctcattagtcaccactcactcacacaccataataacagagcgcaggagatagaaaaaaatataatattttcatcccgcctctttgtattactcgacccatcatagaggaattttctagagaatctcatatgcgactaccttctcctcatgattttgagtacaatattgagacttattctatacccactcgtacaaaattaggatcccacctccaacaacacctctttcaccaagcattcccacgatctaatcttttgtcttttaacaaacaccacaaatttttttatattaatatatacctagaagcagagaatttaagaaaaaaaatgctaagaaaattgttgttttaaaaaaacccccaacataaca

SEQ ID NO: 631062 - DNA, 319 bp, Homo sapiens
ccaatgatatgtaagatgttattgtagcttccgggatggaaacttctctgccagcttgtgggttgggcaaggacgacactccgggccctaccggcggaagctctgctcctgtcgtgcgtggaccacgcagcaaatggccttggaggctgctggcagccatcttgtgaccatgaggcaagtcagcgcgggccgaagccgacgacgcgaagacaatgaggagagggagaaagagccgatctttggtgtgtattggctgtgacgtgctgccgcctctctggagaccgggttcattatacttttcctggtatcttaaaaaaaa

SEQ ID NO: 631063 - DNA, 145 bp, Homo sapiens
ccgaaagtacagatcatggcctgagtatcgtactcctcggtttctctcaatcgtgtagtgcaactgaaattcgggcatcaggcctctccaaaaaatagtcatacttcaacgccttcttcactttccacagctacaataggcggct

SEQ ID NO: 631064 - DNA, 183 bp, Homo sapiens
gatcgagcgcgggcccgaattctaattacgatcccggaagcagcccctttccacggagcccagattcctttaatgggagaatggtattgagaaaccaggatctaggggctaggtgttgttttgccgttgttctcagcactcagctgggaaaggtgtgtgttgtgggcatgtgtatagtgtgtg

SEQ ID NO: 631065 - DNA, 252 bp, Homo sapiens
gaggatcccgggtgggagtacaggaataccttaggaaatctagccgtattcctacttaaggaatgaaccccatacaccctacctctcacaccctacctctaaacacaatcattctgcatgttcaggcgacacctcctcagtccatcagagtaccacagtttatcccccctcctagactcactccacgtccaagactttcttccacgggttcgagcctaagctcgtgtggccctgaattaggccttccgtagt

SEQ ID NO: 631066 - DNA, 295 bp, Homo sapiens
  misc_feature (52)..(53): n is a, c, g, or t
tttgggggggggggggggggagggggggccccccccccaattcccccttttnngcccccctttttttaaaaaggggggggttttttttttcccccccccccggcccttccgggagaactttttttaaatttgggggggggggggggggggggggaaaattttccccttttttctccccgggcccggaaaaatttttcccctttttttttcccggggggggggggggggggggggttttttttgggggttgttccccccctttgggggggggggttttttttttttttttttttta

SEQ ID NO: 631067 - DNA, 353 bp, Homo sapiens
actgtgggcataccagaagtgcataaaagcagtagtgaaggaagaaaaggtttaaaaaggaaaccaaaaaagagttggatcaagaaacttaatgtggaaacacaagatgaaaccggaaaatcatgaacaggtacagttcgggcaatctatgctccaaacaaggactggaacgaattgtcgctgcatggacgcagtgtgcttgttctctggccattccataactggcattttatgtggcccaatatttttagtgtaacccgtggttacagaaattaagaccttggacctttttctcattaattgggcactttgtgtattatacaagggactgttcactgctgtactggtttgca

SEQ ID NO: 631068 - DNA, 211 bp, Homo sapiens
  misc_feature (68)..(68): n is a, c, g, or t
  misc_feature (115)..(115): n is a, c, g, or t
  misc_feature (187)..(187): n is a, c, g, or t
caagcatcaaaactaggctcagatatagtagagattttggaattatcagagcagaaacttaaatatgnttaatatgttaagggctttaatggaaaaagtagacaacgtgcaagancagacagagtaatgtaagaagagagaccaaaactctaagaaagaaaagataataccagaaataaatataacngaaatgaatgcctttggtggggtc

SEQ ID NO: 631069 - DNA, 626 bp, Homo sapiens
  misc_feature (29)..(29): n is a, c, g, or t
  misc_feature (86)..(86): n is a, c, g, or t
gtacccacgaacacactcgcgttttgggngcttttcacaagacacacccccccccacagtgagagcgcacttatattttagagagnggcgcaaccccctctacccaccattttggaccccaccaccaggagaaaatatgggcgccccccttttgcacactcgggatataaataggtggcgcccacatctctcgaggagggcggccgggagatttccctctcttctctgtgcgcgcttgggtggagcccacaaagagtgaaaagaatgtcccagaggggacacccaccatttggtgacacatcaccgctccggagagagcactatatgttggcacactacacactccgccacagtatcacacgcgccttttcgaggaaagtcgcccacccaagaacacacatcgtgtctgtaacacacctcgttcccccctgctttacgggaacgtccacgatccggtgacaatcgtcacacacactgggcgagagtgccggcctctctgagccagaccgtgcgcttcaacgtgctcaaggtcaccaaggctgccggcccccagaaccccgttcccgaaattttgaggctggacatcggccccctcccccccatgaaataaagttattttctcattc

SEQ ID NO: 631070 - DNA, 171 bp, Homo sapiens
atggtgagtgccagtgacaggaagctcgtctgaggagcaggagaatgccgtagttccatgcagctctggatggttggggaggtcgaccatgggaccaggataccctcttgtcctggaagaggaagctggggtgttgtaggagtctgtcgtggtagtcggggtttgatcctc

SEQ ID NO: 631071 - DNA, 791 bp, Homo sapiens
ggtgtggcgcccgcggcacggaagctgggttgagcgctgcgtgctttgcgtccgcggaaagtgtgcctgttatggcggggggtgggcaccgtcggctcgcacgtgtttttaggtacgcgcttggggcgcgatccacgcgcctggttgtgtaggcgcgcgtctggcgtgcgcgctcgcatgttcagttccgcgccgcttatggatgtatatagttggcacgtgcgtcgtgttggcggcactacgcagcaccttgtgctggtgtgtcggaggcgtccgcttgacggctctaattgactgcgcacatctatttgagagagggcggcttcctcttcgttgcggcgcccatctgttgacgtcgtccgctgcgactctgcgcttacatgtctgtcgtgttgacgcctttcttggctcactccactgttctgtctcgctcgcattgttgatctctcgcacatgctcgcgcccgaagcgctgcgatatatattttttgtttcccgccctcgtattgtgccctccttctctctctctcgttttgtgtggcgtctgtctcctacgctcgcgcgtgcgcccgctcctctcgcttgtcttatagccacgcgagttcgtggggcggagccagccccactgtaaggtgaaccctctcttttcccactccatttgcgaccacaatatgcacatcccgcttttaaatgttccactcccactctctttttctctcttatactcctcatttattctcgcgctctcattttgaaacccacaaaatattccataatgggcccacatataca

SEQ ID NO: 631072 - DNA, 245 bp, Homo sapiens
  misc_feature (60)..(60): n is a, c, g, or t
  misc_feature (151)..(151): n is a, c, g, or t
  misc_feature (161)..(161): n is a, c, g, or t
  misc_feature (204)..(204): n is a, c, g, or t
  misc_feature (221)..(221): n is a, c, g, or t
  misc_feature (231)..(231): n is a, c, g, or t
aatagcgacgacatacgactaccctactcgtactcactgactatgttcccatccaccaantaacataaaaataaaatgacaattcgaacacacaaaacaaataaaactacttcccacaaataattgtattatcgacactaactcctacctnataacaccangccctctcgtccccttaaactagagaactttagtttaacacangaccaacgagccttcanaagctctaangtaagtacaacagt

SEQ ID NO: 631073 - DNA, 1086 bp, Homo sapiens
ggagggccccacccggggtgggtgggaaggctgatgatctgtctccagccccttccttctgcccacccatcgttcttccctctgggacaactggacaggatctgggagccagcagcgtggatgcttgtgcgctaggacatgagacacctccaggctgttgtgctggaggagcttgggtgggagcccctaggctgacatcgggtccaattaacaaacaacagtggagccaaagaaataataaacaaacacaacaagagggggaccgcggccaaagaagactatcctctcgggggagcgtcaagagccataaacagccgcaccgcgggtaatttatgtagcaacggggcgctcctacatatggggttcgcataaatcagcaaggacctggccggggctgttccccaggctgtgccggggaccccgcggaacgggggcgctccttaggtagaaggagaaactttgattcgcgtgaggggggtggacaattacttttgggcacagcctaacgctcacgtaaatcttaagagagctctatatggtgtaaagaaattaaaatttcttaaccgtgctggttaaaaggggggtctacccttacgatggcctaaattgtatggctatggatagaaaaagtggcggtgaccggaggtctggatttaattgaaccattctttcttaccaccggggacgaaggtggaaaaacgtggtaatcatcaccccgaatgaggggcaagcagacagaaacgcctgaaacgcaggcagcataacatacctgatactacagcccgtaataggctccctatcccatacgccaacggcaggtagctatacgcatcagaaacacataggacgagtaaacattcgacacgcagaccgtacggcgccagaacagactacaaacctgaggccaagcaatgactagctacgccagggttaaaagaaagaaggcgatagggacgacaggaaggaccagccaggagccagagggcacaaggaggcgcgaaccagaaaaggggaagaaaagcgacaagacccagggaggacaagaacagagaaagacggagagagaaacacacaacagaagagaac

SEQ ID NO: 631074 - DNA, 260 bp, Homo sapiens
cccgctagcccgacagaaatggggaggcccaaactgggatcagcctccccgttaccacacactcccacagtgggggtgcccgggctgggtcccactggggaagctcaaggcagccctggcctttccctcattctccacccagtcaggcccctgcgtggttccagctgcggcccccttttcctcttgcacccctgaggcaactgaggaccctctgcgggcacagctgtgatatcccagcgtcctggggatgtggctcctct

SEQ ID NO: 631075 - DNA, 542 bp, Homo sapiens
agatgagaagctggtagctacgagtcacttatcacatttgttgggtgggaacaaatctgtgccccagttattaactgatgtgtggcgcgtttattctctttcaaagttcacatgtgctgatgaccacttgcggacgttattctctcaaccaagacactctgcagagccaatccaaggagtgctgggtctaaggctctgataatcagctgggaaggagtccataggggtcttaactccacaaccactcacagtgatctcgatcctggagctgtcctgggaagggaacctcagggctacatgtgcgctcttcccatgcaggaaaaatcaggctggaaaagaacgggcaattggccagggactgaagctgaacatctcccaactgcacaaattaccgtgtgagttatgtaagctacttaatgttgccctgcctctgcttccacacttgccaaatgagactacctgacagggtgttgtgaggattaaaggagtgacacccaccaaagctcataacacagcactcagaacgttttaaattctccata

SEQ ID NO: 631076 - DNA, 383 bp, Homo sapiens
ctgaggtctgtgcagatgttgcagacaaattcagaatcaatgaagctcgtgaagaatgagctggtgtgggcttggaagagagaagcagcgaagtgttagagctctgtctgagtgctaaccagacacgccgtgacctcgtgacatgcctttcttagaaaactcgttgtctgctcccttccctcgtcccttccctccccgacagttcacataacagctgcatcattgaccgcacagcgccatctctccctgagaataaagccgatagccaccctcctccggctccgagcctgcttctgccacacctcgctctcagttctctccacatttccatagagaccgtgtggtttttgctcacccgggccccccgtcttcctccctgtccc

SEQ ID NO: 631077 - DNA, 820 bp, Homo sapiens
ctggggccgtccgaacaggggccgcccaacaggggacgcccaacatgggcccgccccaactatagatccgtcttcccaggtgtgtggaagcgggaaacacctttatgcgttaattccacccatgcgcccatctggggaacttgggcacgcctattcgtgagtgccctttcctggaaaggtgttttgtatctggaaagactagaatccaagtattggataactcatggttcagccaaatggctatcatgaacgtaggaaacattgatttttcttgtgttagagtcatgggcctctacatgcaccttttccagagtggtcctcttctgcaggccctttgtagtccctttccaaagctgcctcccaccacccctgctcctctggcctcagtgcacagtggccccagcctcggccaggcactgctctgctcagcgctccaccgcccaccacccctcctgcttcccacgagcctgacccatgttccgcccacatggcaatcagggctagcgcacttccctgtcacacggtccccaggcgctgtcctgtcttgtcccattattgatcagtgtatttaactctagggtgttcagctccaacctcgctgagttggtgcagctccaggtcattcctggggtgggaatcggatcatccctgactcagcttcttaccttaattttatttgcagaggattctttgttctcaaaatgctctcgcatttggacacacattcacatgtcgatatttgcataggagtcattttcagtaggaataacatttttaatgtgtggttttacggttcaataactacaggatgattatgaga

SEQ ID NO: 631078 - DNA, 145 bp, Homo sapiens
gtcactatagagagggttcacatgttggcagagctggtccactcctgaccgtcagatgatccacccacctcagcctcctaaagtgctgagattagcggtatgagccaccacgcccagcacctacttaactctgtctggggcatct

SEQ ID NO: 631079 - DNA, 226 bp, Homo sapiens
aggccttttatgatgttgtgggaaaaactgttggaaaaacagactatattcctctcctggatgtttatgaaaaaaccgggaactcaaagtcaaaaaagaaaccgtgctcagaaactagccagattgaagatactcccttttttaaaccaacactcctagccaatggtggtcatggagtaaaagggaacgatactacagggtttcccactgaattccttgaaagaga

SEQ ID NO: 631080 - DNA, 846 bp, Homo sapiens
  misc_feature (602)..(602): n is a, c, g, or t
gcacaaagggatgatttatgattaaggcaggatgcaccaggacagtgggagattcatcatgctatcagaaaagcgcataatttatgaatgtaattaagacttttggtgtcatatgttggattgatcacatgatttgcaaatatttctctcaatggtgggtggtcttataactatctgtggaggtgtcttttgaagaacaaaagtttttcatttggatgtagtccaatttataatatggtataagtggtggctggtacttttggtgccatatccaagaaaccatggctttctccaatatcaagaagatatataaccttggtttgtttcttagaatttgagagcttaagttaaatccatttggagtaaattttatatatgatgtgaaatagggaaaaaatactataaatttggtaatgtgatcatatccgtgtaatctagctaaatttcacttagtagatctatttaatagtaattggggaaaatttcttctaaagtagacagtcaatgttcactgcaagttgattgcagttaatgtttcattggaaatcgtgggggtctcaattacttgcaaggtgcatgggtaggaccctatacatgatggnagagagtgagagggaacactagccggaccgagctaaggggaagatacagctccaagctgagaaggaagggtcgggaacaattatacctcgtacctgagcaccacagccaggaatgggggaatcataagagcacaacgggaaaaaacagacggaaagagggcagcagcgaaaaggacacacacagagacgtggaaaaagacgagtaaaaaacacggcggcgccgccccaaaccacccacacccgc

SEQ ID NO: 631081 - DNA, 418 bp, Homo sapiens
  misc_feature (78)..(79): n is a, c, g, or t
  misc_feature (384)..(384): n is a, c, g, or t
gagtttaatggttagaagttattatgggcctagcatggtggctcaagctataatcccagcactttgggaggcaagccnnagcaggaggattgtttgagcccaggagtttgagataagcctaggcaacacagtgagacctcgcttctgcaaaaatttgaaacattagctgggtgtggtggtgcacgcctgtagtctcagctactctagagactgaggtgggaagatcacttgagcccagaaggtcaagctacagcagtgagctgtatttgcactacttgcacttcagcctcggcaagaagggcaagaccgttttctcaaggaaggaaaaaaaaagttgtttaattgtagtttattttcaagttggacttggaatgtttattagtnccctggattaattatggatggataattgattagc

SEQ ID NO: 631082 - DNA, 1648 bp, Homo sapiens
  misc_feature (492)..(492): n is a, c, g, or t
  misc_feature (1117)..(1118): n is a, c, g, or t
gtcgcttcaacgcgagtggggggttgtcttctgggcggggcgcgcggtgttattttctttgggcgctcccttttcaggtggctggttttgataggagggcagcctgcatgagtggtgtgaggctgcctttctggggtcgctctgtgtagtatgaggggttgtttctacgagataaggagtgtgtccttgtccgctcacggaggggggcttgcctccgcaggactacgcgacacgagaagggggggaggagggattagagaggctgggttgtgttggctgtccgcgggggtgctttgtggtggggctctggttgttcaggatacgagggaggggcaaggataattatttcggtcgttcgtcccacaaggtggaccaccagtgattgagaggggggccccctcgtcgctcttgttccgcccaagcaatgattgataggtcgctcgcgggtataggtgttgtcggtgtccgagagagggtgtcgaccaacaccangtttgatcggttgggggggtgactctgttggacctccgggggggtggccacccaccacggggggtatctccgcgccatcagaggggcatgtgtcgctgtgggcaacagatgggggaatgtcttgcgcaccacggtttgtggggggggttcttccacacaatgtggccgcgcaacagggagcttcgttgcgtgcgcagagggagagcttttgtttttgggcgcacaagtgcccctgtggggttttgtgcaggggcgcacaattcctcacacacacaggggtggttgtgtgccccccccctcccacggggaagagaggtggatacttgtgtgtgcacagcccgcgcttttacacagacggtggcgttgtcgcacacacacgcccctcgggtatttgtccgcggggggtctcacaacccaccggtgacgccaccccgtggtggcccgctgtgggggggtctctctctctcgccacacacgcaatgtgtgtgcccgcagaggaggctacctccccgcttctcacacgcgacatgagatggggcgcacacacgctctctcgctgtggtatattgaagaacccttctctctatatgggggtctcccccacacattgtggggatatctcccnncccgtgtgagaagagagtggaactctctcacacatgtggcaccatgtcgcccccctctccggggagaattcgcgcgcgctctctctctctcccccgctgtggagatagctgagagcgcgccttttctgtgtgagacaccctgtgtgcgcacacacagagagtatatgtgagaagatataggctctctccacagagaggcgcttgggggcggtctgaatgtctctctcacaggggcgccacaggtttgtccaccacagagccctgtgtgttgtgttgttttatatagctcggtgtttcctggagattttcactagggatatgttctggtgtttcccctaacacgggccccctctcccccgcggaatagcgccccccccaggccctcagaccttctcttcttggccctctcctccaggcttccctcgccctcgtttctccctaaagctgttaccataatccctttatttccttttgtgccctatgtaaactgggtttataaataacttttaaaaggcacccttataaattta

SEQ ID NO: 631083 - DNA, 2466 bp, Homo sapiens
gctaggtacgaggctgggtgttggggatggcagcctaccctgtggcaacgcgggagtcgcgttgccgcagggggcgcattggggtccagccgtccccagaacgcagatcagaggtagtcggacctttcccgctggcgcgcagcctcagctagggcacacagagtgaacagaaaaagaggatacctctgcgatcccgggtcatctccagatgctagggttatggtttattctagtgggcccaacctctgagaccatccttgaacatcagtagactgtgagttgtacatgggcgagagcagcttcgccaacccctgcaaagtgactctgaagaagatgacaatacctgcttcagtcacacccggaagctgactggtccacgcatggccaaagcatgagaaaactcattgcgggactcattttccttaaaatttggacttataccatagggacttcaactgaccttcctcagactgaagactattcccagtatatacgtcaagtcactgaggtaggaaaaaagttgctacagtcctattattttatggttattataagtataccaggactctaaaaagaacttgtttgtataatgctattctatacaaggtatgtagcccaggaaatgaccaacctgatgtgtgttatgacccatctgagcctcccatgaccacagtttttaagattaaggactgaaacctggtgggggctcataaacgatatgagtaaagtgttagccaaaacaaaagaaaaaggggtgcccaaacaagtcaccttgaagtttgatgcctgtgttgtcattaatagtaataagttaggaataggatgtggttctcttaattaggaaaaaggctatatggcaaaaaaaaaaaaaagtacatttgtcataaattaggactgtatggaaatgaacgtgcatactggtcttgtgtcatttcggctacttggataaaaaatgaaaaggatcccgtccaccttcagaaagggaaaagtggcccttcctgtacaagtggtcagtgtaaccccttagaactagtaataaccaacccccttgatcctcactggaaaaaaggggagcgtgtaaccctaggaattgagggggctggactggatcctcgagtaaatatcatggcttgaggagaagtttataaacgctctcctgagccagtatctcaacccttctacgattaactgaatgtgtcagtaccagaaattccaggaaaaacaagaaatttgtttttacaattagctgagcatgtagcctagtctctcagtttcacttcatgttatgtatgtggaggaactataatgggagatcaatggccatgggaagcctgagaattagtacctacagacccagttcctgatgaatccccagttcaaaagaatcaccctgataacttctgggtcctaaaagcctcaattattagacaatactgtatagcaagagtggggaaggacttcaaccttcctgtgggaagactcaactgccttgagcaaaaactgtataatattactacaaaaacagccacctagtggagttcaaaccacactaagaaaaatccatttagtaaattcccaaagttgcaaaccatgtgaacccacccagagtcccactgggactgggcagcccccactggattatactggatatgtgggcatagagcttacaccaaattaccctaccagtgggcagatagttgtgttattggcactattaaaccatctttcttcctactgcccataaagacaggcaaactcctgggcttccctgtctatgcttcccacaaaaagagaagcatagctataggaaattggaaagataatgaatggccccctgagagaatcatataatattatgggcccgctacttgggcacaagatggctcgcggtgatatgggacccccatttacatgctgaactgaatcatacggttacaagctgtcttagaaataatcactaataagatcggcagagccttgactattctggcccagcaagaaactcagatgagaaatgctgtctatcaaaatagattggctctcgactacttgctagcagctgaaggaggggtctgtgggaaatttaaccttactaattgctgtcccttttaaggacaggaattgtgttggagatgtgagtcttgccaaagctcccggccgaataaagcccttccttaactcgatgtctgaggggttttgtctgtggcttgtcctgctacaatgttagctgtgagtttgtagtatatggcctttattattttgaggcatgttccttctgtgcttagttctttgagagtttttattatgaagggatgctgaattttatgaaatgttttttctgggtctattgagatcgtcatgtgggttttgttcttgattctcttaatgcaaagtatcgtatttgttgatttgcatatgttgagttgtccttgcatctctggtataaaacctacttgattatggtgt

SEQ ID NO: 631084 - DNA, 683 bp, Homo sapiens
agcggaactgtcgcggccgggttgcgggtaggactggacgccaggcagccgcgcagcgcctgaacccgctgcgggccgccggccgcccttcccaccctcgcctctgtgtgtctccagcctcggctttctccgactttcctgctcctctgctgccttcgtctctggtcctcggcgtctcgccgcccgcccagaggagtccccggcccagccgagtgaagccgctttccgctggccgcagcccgccgcgacttcggcacagtttctccctctggctagtctcccaaacggcgctcctcgccccggggaagaccaggctgcgaccgctgaacggcacgatcctctcccaggagcccgtaacgagcgcccgggggccaagccccgggaccaaccccggcggtctcgggcccagcgcgcctgcgcttcgccgcacgcagtctgctcctcgcccgcgtgccggacgtacgcgaacggccctgttggcttgcaggcggtcggaacccgaaccggatcgcatggacccagatgccatgactgcccgaacggcccgcgtgacttgcctcaggtccccgagcctcggtgtccgaggtgcccctacggactgactgtggggggaaaaagggggacatcaggactctgcttttggtgaatcgttgactgcatgaggtcgcctcactcggggctac

SEQ ID NO: 631085 - DNA, 821 bp, Homo sapiens
cgtgacgcgtgggttccagcgcatcgtggagagcgtgaacgtcatcatctcacacctacggcggagggctgagagcggccccatgggcaacatcatgatcgatccatgtcctcggtaccgtgggcttagggtcttggcctccacgggtgggccttcaccctgaagcagtgtagccagagatgtatgtgagccaagattcgaccgccaagggggagggccacgtcagagggcctgccgagccgggccaagacaagtagaggacatgatgaagaagctgtggggtgacaggtacttggacccagccaacggcaagttcagcaagtcagcacaccagacccgaagggcagaagctgccacgacaccttctgccagctgatcctggaccccatcttcaaggatgactccgctgcgactcatgacattacaagaaagacggcgacagcacaactgaccgacgacaaccgggaacatcaacactgggaccagccgacggacaaggacaacgaaggcaaaccacgtgagtgaaggctagtgatgcagccgcatggctggcctgacggcagacgcctagattgcacgatgactcaccataccagctgccactcccctgatgacgagacccaagaagtaccagcaggcggacgctcccggtaacagaggcggacaccccgggaaagacgaaggctggccaatgcggcacattacacaacgcaggagcacccacaaaggaccatccaaaagcatgactcagaaccacaactggtgacaacataccgaaaaaggccagacataggacaaggaacgacgaacaccgagcatgc

SEQ ID NO: 631086 - DNA, 211 bp, Homo sapiens
actgtacctgtcctgaccgacttctgcgtccttactttgccgaccctgactgttctggtaccgtactcccacgcccgtacccttgacgactctcttccactcccttgaccgtttgttgttgactcttgactgtggtgatacactactactcaccacgtctaccgaccacaccttgggaccttgactcacttacccacgccaccacacgcca

SEQ ID NO: 631087 - DNA, 714 bp, Homo sapiens
cggacgcgtgggtgctcagcagatccaagagatatattggcaactttttctagaaaaggcacatgggtatcattcattacattcttgagttttttgggttttgttgttttttttgggaaagcctgggggtttggcccaggcgggatggggggggcaagccacggctcatggcttccccatatcacccggggccaaatagaaggttcacttcccagcacgtggaatagcggggacttacagcttcacagcacacgtgtggggataacaatttatttttggtgtaggagaagggtttttcctcatagtgtggcccagggcgtggctcatcagggcgtcgggtgggacactcagaatgtggtccctcgcgtgccataagattccgaagaggaagcagggcacaagttgtgttaccttgtgctcgccttgcaatagattgcccaacaaggaggtttcataaatccctttttaaaggaatgtggacgttcgcaataaagtgggctagagtgttggggggggcaaagttgcttaaaagccgggatactgtgggaaactcccctccggaaagggggtataccaggcgggtacccgatgacgattaattactgacacctaacggcgagggccgtggggggcacaacacgaaaaaaaaaggcaacaaagcaaagaagcgcgggggcgacaaaatagagaccccagggggcgcaaaagttaaga

SEQ ID NO: 631088 - DNA, 258 bp, Homo sapiens
ggcactgacacggggcctggagctcacggtcctcagtgcagttgctgccctacaccgcctggtgggctggtgggggagacgccgcttcccatggcactgagtgtggcggcggccatgggttttactaacaaaggctgggcagtcttctcggaggaggtgtggtatcattggtcaggggcaggtctggcccatcaccctcactagctccctggccgtgctgcctgagcactgagtacacgtcgtccacacggctgagtt

SEQ ID NO: 631089 - DNA, 292 bp, Homo sapiens
tccatattggtggatggtggatgggtgatggaatgatgagtggatggtgaaggtagatggaatgctgggtggatggtggatgggtagatggaatgatgggtggatggtagatggtggatggcggttgggtaggtgttatgacgagtgatagtggatggtgtatggtggatgggtgcatagtggactgggggactggtggatggcatgatgacgtgggtgagtggatagtggatgatggactgggtacgactggcactgaccaggtgggtagtggctggtccctctcatgtca

SEQ ID NO: 631090 - DNA, 442 bp, Homo sapiens
ataaattcattctttttaatagctgagtagtactccattgtgtaaatgtaccacattttctgtatccattcctctgttgaggggcatctgggtcctttccagattctggctattataaataaggctgctatgaacatagtggagtatgtgtccttcttaccggttgggacatcttctggatatatgcccaggagaggtattgctggatctccggtagtactatgtctaattttctgaggaaccgccagactgatttccagagtggttgtacaagcttgcaatcccaccaacaatggaggagtgctcctctttctccacatccttgccaacatctgctgtcacctgaatttttcatcttagccattctgactggtgtgaggtagaatctcagggttgttttgatttgcatttccctgatgattaaagatgttgaacatttaaa

SEQ ID NO: 631091 - DNA, 1023 bp, Homo sapiens
ggcgagactgaggcggacagtcgatggctgccgtgcggttcgcgggtagccctggtggagtcggctgctgaatctggggtggtcgtccgtgtaccccgggctgatgcgtgcctggcaggtgtccactgctgcactgactcgtgtatcgaggactgggcttaatttgagttagccatatttgctcaagtgatttgagtgcaacttgacaatttggccgccatagtacactacgatgaacaggactgtactagtctgtccagaagtactatcaatttaaggatgcagtcacgaacattgagtgctcgggcgtgtagcgcagctgactccgaccgatgtgtcgtcaggacggcgtccccgagaagtattgggatgctgcgctcgcaaaatgttgactctgccgtagtggcctgcatagtgtgtgccgtgatggctatggtagatccgcggcgtagcggacggtgctgtgttgtgccacagcaatacgcatgtttgtcgctaggcgtcattgcgaaggagaaagaggcgcttgcaccagagaggcggacaccaaagtctcgtattcgcccaggcctcgttttgaggcaccttgctatgagtggcttctcctcacaaggcggcttggctcctggaagggtgataacagggactacttctgggtggtcagggagtgggaaagattgggtccatcagggaaactggaggccacgtctcctcgtgcaggggaaggtccggcctggccccactggtcagaatcagtcttctgggtccactcggaggactccgacgtgttgaactttcctgaaggaacgttggggacggagtgtcgggcgctggccttagtgcctctggggattagagcgctggacatggctgttggcggagcggcggggaaaaaagtagctcggttgatacccccgtttttccaagaattccggcatttttgggaactatgctcttgcatggcacgcctggggctttcttgcttcggcaaggccgtgggcctgttagggggccccgccgggg

SEQ ID NO: 631092 - DNA, 511 bp, Homo sapiens
  misc_feature (31)..(31): n is a, c, g, or t
  misc_feature (69)..(69): n is a, c, g, or t
  misc_feature (106)..(106): n is a, c, g, or t
  misc_feature (117)..(117): n is a, c, g, or t
  misc_feature (119)..(119): n is a, c, g, or t
  misc_feature (142)..(142): n is a, c, g, or t
  misc_feature (157)..(157): n is a, c, g, or t
  misc_feature (228)..(228): n is a, c, g, or t
  misc_feature (236)..(237): n is a, c, g, or t
  misc_feature (261)..(261): n is a, c, g, or t
  misc_feature (265)..(265): n is a, c, g, or t
  misc_feature (283)..(283): n is a, c, g, or t
  misc_feature (285)..(286): n is a, c, g, or t
  misc_feature (288)..(292): n is a, c, g, or t
  misc_feature (312)..(312): n is a, c, g, or t
  misc_feature (327)..(327): n is a, c, g, or t
  misc_feature (400)..(400): n is a, c, g, or t
  misc_feature (402)..(402): n is a, c, g, or t
  misc_feature (426)..(426): n is a, c, g, or t
  misc_feature (442)..(442): n is a, c, g, or t
  misc_feature (495)..(495): n is a, c, g, or t
aaaaaaatatattttctcctaaataaccccntcttcttattttaaaattctaaccataactctcttaancccacccatctttaaccattaacactctttaacaaanctacacacccntnccttaattctcatctcaccaatnctcccaccctcttgncttacagagttgttagttaactccatcctttgccacacgagtcaagtggctcacaacctcctcagggcacnagagaagnnacacactggttgctgtgatgatanccantccccccccccccccccncnncnnnnnccacatttgactgtagcatngcatctgtgccctgntgacatttatgttaaccttcaggtattacttgctgcatatcttgacatatcttgagattctgcatgtcttgtnangagaggggatgtgcatttgtgtgngatgttggatagtcanccacgcccagtttggaccattggaggaacttagaaaaacgcacaaatggggcnataccaacgcttagaa

SEQ ID NO: 631093 - DNA, 95 bp, Homo sapiens
ctagaagattcagcaaagtacttttgtgctcttgggtcgaatttagggagatctttgtactgggggatacggccgtgtacaccgataaactcact

SEQ ID NO: 631094 - DNA, 458 bp, Homo sapiens
  misc_feature (259)..(259): n is a, c, g, or t
  misc_feature (274)..(274): n is a, c, g, or t
  misc_feature (347)..(347): n is a, c, g, or t
  misc_feature (349)..(349): n is a, c, g, or t
  misc_feature (373)..(373): n is a, c, g, or t
  misc_feature (389)..(389): n is a, c, g, or t
  misc_feature (442)..(442): n is a, c, g, or t
gttaagagaagggagtgtgtcctgaagaagcccttcttctgatggttgctgaccagaacgcttttgagcccaggcattggtgagcattaacaatttgggaccgaacttgagaaccctggcctggggcttaatttaagaatggtggccaccttttggcttttctttaagggcaccagaggactcactcacgtgtgcgctgagaagatatccagtgtccctgtgccctcttatatccacaaacacatttgactgtagcatngcatctgtgccctgntgacatttatgttaaccttcaggtattacttgctgcatatcttgacatatcttgagattctgcatgtcttgtnangagaggggatgtgcatttgtgtgngatgttggatagtcanccacgcccagtttggaccattggaggaacttagaaaaacgcacaaatggggcnataccaacgcttagaa

SEQ ID NO: 631095 - DNA, 196 bp, Homo sapiens
ccgctttggtttgcgcggtgtactcgtccttgtccgcccagttgaggccgtcttcggcgcggtccacttgcatgatcttcatgccggggccgccgacgcggatcacgttcggggcctccgccgtgatggtggccgagagcgcatccgggtgattggcggcgagcgcctgcctcacggtttgtttgtcgttgtcgtt

SEQ ID NO: 631096 - DNA, 328 bp, Homo sapiens
tcacgagactctccttgtaattcaagcagtcggtagtggtaatatgtagagggagtatagggctgtgactagtatgttgatgtcctggtaagtagagagagtagatatttagatcaggtaagacgtggttactagacagcagagagttctcccagataggttaatagattgggggtaaggcggaggttagctgaggcttgctacgaattcatcagaaaacgctattcagtgggagctagagtttgaatgtcctctgagatgacggattatgagtgcgagctgctgtggatgtacataggacgggtagccgaggctcgagattctgcta

SEQ ID NO: 631097 - DNA, 127 bp, Homo sapiens
ctggttagctgggggcagaccctcctatggagaggagggtgatgaattagggtttagtcatgtagcttgttcaggtgcgagatagtagtagggtcgtgtgctggagtttaagttagagtagtcggaa

SEQ ID NO: 631098 - DNA, 808 bp, Homo sapiens
gcagctggggctgggaaggcgggcgctgggtggcgctgcggcctgctgcagcgccagggtccacctggtcggctgcacctgtggaggaggaggtggatttcatgtgcttccctgtagactggaagaatctggctcaaaacctgcttgcctctgcatgtggtgcttgatgcttgtgatgtgcatgctgatggcctgccctgagcgcatgtgcttcctgtgctgatgacatgtgcagtggcaatggatttgcagccctgtgcggcatgggcccggctgatggatgcgcgaacccgcggccgcagttcccaggcgttggggcgcagccgccgtgacctgcgtgctgcctggggcgtgtgggtggcggggcctcgcctgcacaaatatgggactgaaggggggctgtggggctggccacaatttcgcgccaaacttgacctgcgcgttcttgctgtaacgagcgggctcggaagtgtcctcccgctgctgtcatggtttggttcgctaaactgcatcgtcgctgtgtccccagaacatgggcatcggcaagaacgggggaccttgccctggccaccgtcagggaatgaattcagatatttccagagaatgaccacaacctctatcagtagaaaggtaaccagaatctgggtgattatggggtacgaagacttgtttctccattcctgagaagaatcgacctttaagggtagacttaatttagtactcagcagagaattcagggaactcacaaggagctcatttcttccgaagtctaatattcttaactttgaacaacggattcaataagtac

SEQ ID NO: 631099 - DNA, 134 bp, Homo sapiens
gcgtagaaaccacagcctgggctagaaaatatccgttttatgcatttatattggggagacaagatctcagtctgtcactcaggctgtagtacaggtgacataatcatggctcacgtgcagcctatgagtgccca

SEQ ID NO: 631100 - DNA, 746 bp, Homo sapiens
gcatcgatgtggccagcctggagccagcatgatgagaacacacaatgtacacacacatgcatgtagacacatcagatggacatagtactaccaaatgtgcaacaaaggaatggacagaacacatgcagatgccccaacactgcaaaggaccaatctacagagggaagaaagaacgggatacggcatggccagaccatgggaaagaatggagattccaaccatcattccccacactcgacatgacaccgagaccgttccactggaataaccaccagaccaaatccgacaagtcagatcatactgaccaatcacccaacaggacaatccagaggacccttgaagacaaagcccaaacaccacgagggaaaagacagattccaacccgacaaaagaggaatatcacccatcgaacacagatgcatagtcataccacgaaaaaagggagaaacaggccagtgtaaagagcatgctggacggtgacttgcaatcacagtcagaccagaacaaggtatgaacgaagcaaaagaaccatacaatcatatcaacccatactacgggcaacgataccaaacaaacacaagagggaccgcacatttgtaaacacaccacgaagaaatgatggaacaccgcaagaacatcacaccaaaacaggacccacagattattcggaatccaaaaacattcaaaggggacccaacggacttacaccggaagaacaaggaaaactcacacaaagagatcatgcc

SEQ ID NO: 631101 - DNA, 826 bp, Homo sapiens
ccttaaaaaaaatttctccttttttaggggaaaaatacaatttttcttaatttggccccaaactcttgtttacacattttcggcttcttcccccgataatacaaacatttgttcccaaggaatccccctgctctccccaactcgggtgtcctaattccacctacaaacaaggtagattatacacgtaacatggtttccaagaaattaaacgaatccacagtttaggttccaggatgccaagatgcacaatcctaaatattccaagctgtgtgaacaccaaacaattttatcaaagttcattacgttgcggtcaacattatgtacattttatataaccgctcaagtattatttcgcaatacacaccatatttggtctaccttatagactgtactcacctaccttttctccctccgttctaaatattttgtatctacatgtcaccactggttccacacatttattttcaccacacccttatttattttacagaacgaagataaacagcacctcttcttacatgtgctactcgctcttcacaagtgttaccacgccgcgggaacccttacacgctcattacttttctcttttacacgatcacacgaagaagataatctcccttgagtttatatttccatcactccaaccttcatcttattaaaacagaatttatgtacgaaatattgaaaccacggtccccattaccaagtactctactattgtcctccctacctgattcctgaaaaactatcatgttatggccatttaaagaaaaagagaaataaatagtacaaaaacaaaataaaacaaaaacaaaacaacatgcac

SEQ ID NO: 631102 - DNA, 453 bp, Homo sapiens
tctagaggatccccccaatcaacatccaaccccatgagaacaggagcgacatagagcttcttcatctttttgtacgcatagtaggtatcatgcacatagtgggtatctaacaggtaattgttaaatgaatggaatataaagaaggtaaacttctgggtcaaacaaaaccattattcagtttttttctcagtgaagtcctttcccctatgattaccgttgctgtctcacatgtgtagagtgcttctaacttttcagatggctttcccgtcctttgtctgacttcatgcttatgtctgcgcaagcagtgcagtcttatgatcccccttggtaacttactagaattcactcagctagtacctggaagaactagaactaaaatgtgtctcctgagtattctgtccccatgatcaggaatattagaagagtagcagaccattcccaagctgattggat

SEQ ID NO: 631103 - DNA, 222 bp, Homo sapiens
gatccacgcaggattcttggaccttttttccacacttgatggaaatgtttgaaaattgctcataataggccgggtgcggtggctcacacctggtaatccccggtactttgggcgaggccgaggcgcagcggatcatgtcacggagatcgatgaccatcctgtgctaacgtggtagaaacccctatcattacctaaaaaaaatacaagaacactagccaggcg

SEQ ID NO: 631104 - DNA, 346 bp, Homo sapiens
gtcggcccgatgtgaactgtgttcacttccagatcagtctgatactctccaacaaaaccaaatacatttcgtatgaggcaacacaactttttttttttggagatggagtctcgctcggtggtccaggtgggagtgcaggggtttaaatccctctagttttaaatgagcactttccatatatctatggaacaattccctattttggtgatgtgccgtgtaaaagtctttaatctcattagctgcgcgtgggggcactggcctgtaatgccagctactggggaggctaaggcaggaaaggagaatcgctggaaccgggaagggggaggttgcagcaattctccggcag

SEQ ID NO: 631105 - DNA, 248 bp, Homo sapiens
agatctcatatctgagttctctcaggaaaacacaagacaaaagacaaacaagagggaacaaaacacaactgttctagaggtcagataccagtcccacatcgagtgcagataatgggctaagtaaccaaggagcaatggagacaaggatgtaaatggggtggagcacgatggctcacacctgtaatctcagcctccaagcagctgggaccacaggtgtgcaccaccacgcctgggcacacattatggag

SEQ ID NO: 631106 - DNA, 365 bp, Homo sapiens
  misc_feature (91)..(91): n is a, c, g, or t
ggtgcctctacctactgtatcctataattaacccattaaatactggaatacacgacaatatagcagtttcggacacagacgacgcagtacngttatccggtgtttcgtggtggggagttgctagttaagatgaccggagttgcggctatgaactgaaccatgggcacggctgaagtccgtagccggacactcctatttgagaagaaccaaatacacgtaacgcagaatggtcagaaacgaggacagcattatctatagccatttgctctgcatctcagtattgcgtccgggtaaaataaaggaagtgatactggttagtacgtgtgtcaccaccgggaaggatagctgagggtgactaagtatgt

SEQ ID NO: 631107 - DNA, 107 bp, Homo sapiens
attgatctggtataatctggcaagaatatacttatcactaataatagactggtgtgtaatcaaggatcaatcagatctctttgagaatgaaagtatagccaaaagat

SEQ ID NO: 631108 - DNA, 278 bp, Homo sapiens
cggttgatttagaggatccccggtacgagcggtctcacagcagtgacaatactggatcctttaactgctaggcactgggaaactccctttatgttcttcacggcccttaccaccaccagaaatttttttttggccttttttttttttggggtgggagggtctccgggtatttttctgctggaggtgtatttttttttcattttttcgcaattgcaatatggggttggggcgtgggggtggccagacggcttctaccgggggttacggagctcgaattc

SEQ ID NO: 631109 - DNA, 313 bp, Homo sapiens
  misc_feature (38)..(38): n is a, c, g, or t
  misc_feature (141)..(141): n is a, c, g, or t
  misc_feature (145)..(145): n is a, c, g, or t
  misc_feature (217)..(217): n is a, c, g, or t
  misc_feature (277)..(277): n is a, c, g, or t
  misc_feature (297)..(297): n is a, c, g, or t
gggcatccctccaaggcctgactccctttcaatacccngaattttttttttggtccacacgttgcctccaggattattcccgtcaggcaaggaggccctcttcctgattttttacagctttacctggggccaactcagggncctnaaagggcccattcccaacagccctaggtttttttttccccgtgaaaccaaaaatgatttggaaaatgggggngaaggaccctcgggaactagggcaaaaacagggctaaaggtatgtggagctgggactgtntttggaatttttatcccaanaaagtttggcaaggga

SEQ ID NO: 631110 - DNA, 994 bp, Homo sapiens
gctcctccgctccgagcaccagcgcggctctgagctgcccaggtccctcccccgccgcagcagcccatttggagggaggaagtaagggaagaggagcggaaggggagccggaccgacgtacccagacagaggccggtgaatgggttgtggtgacccccgccccaccacagacaccacacgcgccgcaggactcccacccacgccgacacgaaaacagccaagagaaggcaacgcaggggcaactacacgcacacaagaacgccacgagcagcaacaagcagagagacaacaacaccagagcggcacacacccacactggcggcggacaaccgggcaccagcatgacacagccagacacaaccacaccaccgccacgtcagacacacgggaacacgcaaagcaggcaaccggcagcgaccacgcggcaggaaacacgggcgatcgaagcgaacgcgaggaagagacaccccgacagccaccgcacacagcgggacgagacacgagtgaccgcgaaccatggggcgccgcgccacggcacgccgaccaaaacaagcgactcagctaccggcgccgagcaacacgacgcgaggccaccggcgcgaacgccagccccaatagagcgcgccacgcacaacagacgcacggactagcaccacgatgcaccacgcagagcatccaaactcacaccgaccaccgaaaggcggagaacgacgagacgcagaaccggaaacgcagcaagaccaagcacaagcggagcaagaccaagtgaacaaacagatccgagcgagtaacaagacacacagggaggaagaccgcacaggagacgcaccgagggacacagaccaccatcgacacggagaggcctgcacagcgcagaacaccaggcagaccaaacgacagaacagccgcacagcgacgagcggccgtcatgacaaaacggacaccgcagccgccgcctgcaccgcgaatgctgccaacaccacagagcgaaaca

SEQ ID NO: 631111 - DNA, 214 bp, Homo sapiens
cccgtgctatcccccttcgtctctatctgcctcttctctacttcccactctgcctctgttttctattccctcttttttttgtttgtttttttaaaaccttgggcccccccggaggggggacctgaccaaactaaaaaaagggggaatggaaatcccgggggcagccgggctcccgggccctcttttaaaaattggtccccgggaaataaggaaa

SEQ ID NO: 631112 - DNA, 133 bp, Homo sapiens
taccatcatcatagctccttccaacatctcatcccccttccaacatctcatgtccctttccaacatctcatgtctgcttccaacaatctcatggcgtaccgttgcaagcatcgtcagtgcgcccctgtccaga

SEQ ID NO: 631113 - DNA, 695 bp, Homo sapiens
gggaggctgaggcaggagaatcgcttgaaacctgggaggcggaggttgcagtgagcagagatcgtgccattacactccagcctgggctacagagtgagactctgtgtcaaaaaaaaaaaatgaacagaaaaggggcttgtgtggtagccaggtaagaaattggaatctctggtggtacagcagctagctggtactggcatgatccacttcccatttccccagcctgacagtgggctgtcctctggaaactccttaccacagtctcttcaattgggataggccagcccgtggatgccagttgactataatcaatgggacattggaacaatgccacctgtgccttctgttgcgaagcagacaccttaacaagaatctggccagatcgagccgaggctgcggctggctctcagcgcctcataactcgccaacaacctacggaggaagcgtcaaggccaggaggaactcacgaacgggctcagcgagcagtggcagcaccaagtcgcgtggcactcacacacgcgaggaggaaaagcacgcggaccgatcgtacagtaaaaacaaacaacgagtcaaaacaccacttacagagtggggagacgaaagagtgagccgagagacgccgcgtgggtgggataccccagaggaataaccatccacgcggaaggagccaatagaggagccacgagaaacgacag

SEQ ID NO: 631114 - DNA, 545 bp, Homo sapiens
  misc_feature (22)..(22): n is a, c, g, or t
  misc_feature (68)..(68): n is a, c, g, or t
  misc_feature (94)..(94): n is a, c, g, or t
  misc_feature (137)..(137): n is a, c, g, or t
  misc_feature (139)..(139): n is a, c, g, or t
  misc_feature (186)..(186): n is a, c, g, or t
  misc_feature (188)..(188): n is a, c, g, or t
  misc_feature (252)..(252): n is a, c, g, or t
  misc_feature (263)..(264): n is a, c, g, or t
  misc_feature (268)..(268): n is a, c, g, or t
  misc_feature (311)..(312): n is a, c, g, or t
  misc_feature (329)..(329): n is a, c, g, or t
  misc_feature (448)..(448): n is a, c, g, or t
ggggcgcaggaaggagtgaggncgaggggccggggctcccctggaggggtcgccccggccccccgtgncgccaccgttgaaaagtccaggccgncaggcgaaaaggcccgagtagaaaaagcaagaggggcaaaggncnacacaaaaaagtaggagtgaggagatctcagagagtgaaagtggggngnccaatgcgccaaaaaagaccaaaactgagcaggaactccctcggccacagtctccctccgatcnggaaagcttgnncggncggagccttaatgatgatggcagcagcggccttagggatatcnncccggccccccggggcnggtcccccggttctgcgggcccagaaagaaggcgagcgaacctttgtctcttcttctggcctgtcccagggcccagccagcccctaccacccacctccactctttcctccttcccctcnaccgccagacagcacccctcgacagccagaggctagctttgaaccccatccttctgtgacacccactggatatcatgctcccatggagcgccccaaa

SEQ ID NO: 631115 - DNA, 189 bp, Homo sapiens
atacacgaattcacaaacagcaaaagtcccacacacatcctctgcatccatctcaatcagctgcagcaaaacgcatttgacacaagtcaacatccattcatgatcaagaccctcgccaaagtgggtatagagggcacactcctgaacctgatcatagtaacttaggacaacaccacatcaaagatactc

SEQ ID NO: 631116 - DNA, 551 bp, Homo sapiens
  misc_feature (22)..(22): n is a, c, g, or t
  misc_feature (68)..(68): n is a, c, g, or t
  misc_feature (94)..(94): n is a, c, g, or t
  misc_feature (137)..(137): n is a, c, g, or t
  misc_feature (139)..(139): n is a, c, g, or t
  misc_feature (186)..(186): n is a, c, g, or t
  misc_feature (188)..(188): n is a, c, g, or t
  misc_feature (252)..(252): n is a, c, g, or t
  misc_feature (263)..(264): n is a, c, g, or t
  misc_feature (268)..(268): n is a, c, g, or t
  misc_feature (311)..(312): n is a, c, g, or t
  misc_feature (329)..(329): n is a, c, g, or t
  misc_feature (448)..(448): n is a, c, g, or t
ggggcgcaggaaggagtgaggncgaggggccggggctcccctggaggggtcgccccggccccccgtgncgccaccgttgaaaagtccaggccgncaggcgaaaaggcccgagtagaaaaagcaagaggggcaaaggncnacacaaaaaagtaggagtgaggagatctcagagagtgaaagtggggngnccaatgcgccaaaaaagaccaaaactgagcaggaactccctcggccacagtctccctccgatcnggaaagcttgnncggncggagccttaatgatgatggcagcagcggccttagggatatcnncccggccccccggggcnggtcccccggttctgcgggcccagaaagaaggcgagcgaacctttgtctcttcttctggcctgtcccagggcccagccagcccctaccacccacctccactctttcctccttcccctcnaccgccagacagcacccctcgacagccagaggctagctttgatcaccaccatcgagaccacatccccagtactcccagcttggtagtatacggatcctctaga

SEQ ID NO: 631117 - DNA, 506 bp, Homo sapiens
agaagaatcagaaaacaatttactaacctccctgtttgatattaaaaataggaagaattttaatattttctgttagtacaagttgaacttgattgtgccaactgaaacccccgaggtttgtaaatcagtagaaaggcaagaccattgttaaaggtgcttacgatcttttttgttttcctttccactccattgtatcaattttttgagtaacttttaaatggctagaaaatggtctttttgctttgcccttttacagttgtaatcacccgttccattcttttcatgaatagtaagttgatacacctattgatcaggtatctcgcagttgtctccaaaagcagaagttttattaggttggagtgtaactatagatcaatcaccttaatgtaatggggggcttcaagtcatagtagaacttttcacctgttaaagtcatagttaatcattccaatttaagatgtggatatagggcgaactgatatagagtatcccccaaggggcccaaa

SEQ ID NO: 631118 - DNA, 157 bp, Homo sapiens
  misc_feature (7)..(7): n is a, c, g, or t
ccagcgnctccgtaacatgccatgtgacattaggcaacactgatgcatgtgcacaactgctggccaccactgtccacactgctcacacaatgccatgtgcctgcagtgttggaaagaagctagcagttacatccaggcggatgtccttcttcccacc

SEQ ID NO: 631119 - DNA, 230 bp, Homo sapiens
  misc_feature (212)..(212): n is a, c, g, or t
gttggatcctggtatgtctacatcttcctgggcccagagcccatagagcgtggtgcagcagtacctggacgttgtgcggatacccgttcatgccgtccactactggtggcctgggcttccacctgtgccgctgggcgctactacctccaccgtctatcacccgaccaggtgtgtggataacatgaccatgggcccatcgttcgccccgtgtnatcgatccaagtggaacg

SEQ ID NO: 631120 - DNA, 834 bp, Homo sapiens
  misc_feature (387)..(387): n is a, c, g, or t
ggtgcatgaccccataaacaggggccctctcaggcctcctaatgagctccggactagccatgtagatttcacttccactccaataacgctcctcatatgtaggcactacataatccaacacactaaccgagtatacgcaatagatggccgcgatgtgaacaacgagaaagcgacgataccgaaggcctagctagagaccatctgtccaaaacatggccttacgatcactgggataatcctatgtcattgacctccacgaagtctggtgtatcattgctgcaggatttgtgtcatggcagcctttaaccaactcgcagcgctgagcgccctaactcgacccacattacaggacgcggtacgtggcccctctaatgacgtgcgatgcancacacgctgatagagtccactcgtacgtaacgctgcgcagatacgcataagaccatccaatcgcagatttgttaacctcgggccatttcatgggacgtgagtcagcgccaagcgtgaaagctcaaccgatatagtcttaactacgaaggagcaagcccggaaacctgagagtaccctgttcagatggcaacgttgcgtgtactgtcatcaacacttcttagcctcgagggtccatcatattttgtttagcactcatcccttatcgaagacacgtgcaaggaggtgacttgtcgacgctcttcacacttgcgacccagttcacccagaggggcccttctacgggactcaatgctgtatcctgggtaggccacaagagcttcccacaggaaccttcaccgtcgatatagttggcttcaagatgttccgtccacataatctgcttcaatc

SEQ ID NO: 631121 - DNA, 469 bp, Homo sapiens
gggctgcgcacaatctggttgttaccactgagaagttgagggggttccacgccccttgaaaaaacagatgaaatccatagacccgatccccaatgtgtaaacatgaaaccctgtcccagcaggtttcacgagatactcccccgacctggcactatgagccccccctgaacctccagcacctaggtccagtgccccagactcctccagctcaggcaccctacctccgaccagcctccagtccctggctactgcgccccgtaggataatccccgcatgcccgccacagcacagaacagggcacacagttgacattggggggtgtggggacgaaagataacccaaggccttgcctgcgggtatcttggcacagcttcaggggcccgtagggaagagggggcggagagccgagaccccgaagttagtcccaggttcaactcagcccaggtgcttcctgggagcctcactttat

SEQ ID NO: 631122 - DNA, 280 bp, Homo sapiens
atctaggtgttcaactgaatgacagagggaagcaccttccatttctgttggtctttctcagcctcccccttgtggtgacaaacaccataagcaccaaccgctcaaggttcataccctcccagctcctctcccagagtccccacaggagctggcattgccttccaacagctccctcagagcccctgaagtccctcactggctcggcttggggcttgggtcttgagcccacccctgagtgccagccgtgattgaccaggcctgcctgaatatccactgctga

SEQ ID NO: 631123 - DNA, 332 bp, Homo sapiens
  misc_feature (329)..(329): n is a, c, g, or t
gtagaatttcaactcactgcaacctccgcctccttggttcaagcgattctcctgcctcagcctcctgagtagctgggattacaggtgcccaccaccacgcccggcttatttttgtatttttagtagagatggggtttcactatgttggccaggctggtcttgaactcctgacctcaggtgattgcctgcctcggcctcccaaagtgctgggattacaggcgtgagccatcacgcccagccagtacttgtggaaggactagctggacagacagggtgcttgcagacctgacagtggaagccatggccctgcatgtcagaggtgctttttnaaa

SEQ ID NO: 631124 - DNA, 162 bp, Homo sapiens
gtcatagtataggatgtctgccctctgccattgctgtcggacactacttctggtgggcacagagcggaaacttgaggatgacatcagagagctgcatgcacttaaagggcatggcctgtctcctcacttgagtgcaggtccatcgaccaaagccctgttctg

SEQ ID NO: 631125 - DNA, 974 bp, Homo sapiens
ctgcttcgtctcggctggtagtaagtctgtgcacgaatgtcgtctgtgctgcctcagttagagccatgttgaaaaaagatacgggagacaatgccttgttcccctgatgggcaagactagggtggacgtgctcaggtatgcgatgtcaaaggtgtgtgactacgtacgccaggtgcaacggacagaggacaatcatgctaccttctgccagattacgccctgataaggtgcgagaggtgaccgccctgcgggctggaaacctttttactaggacgctgagatgttagtagcgagtggacccataatcgtggagcatgcaccatgggtagagttctcccaaagctctgttgcaatgccgatgcagtcgatggaataagcacgaaggatgtaatctaaggatttccgtcttcttagggaattgcaacgagtttaatgggaatctgatggtagctcgtatgcaccggagtgaaagacctttagccgtgttgttgggcgtagaaaatgcctgaattggcattcgtttgtgagaatgacagggcgttgttcggatggatatagtgggtctgaacctgtgttgcttgtggaggaaatgcctatatgtagtaagatttgccccatctttgtggccattctttttttctggaaaaactacaaaaggtgatggagtccctcctaggcgttaacaagagaaaacgcctgccatacaaacaaaccaacatatgcagttggcgcggccgccacatcggcgctcccgaaaaaaagcttgcaagacgaccagtcggctaggggagccagcagcgacccagacaataacagtgctgcagcgttgtgccacacgcattgacacccgaagagagacccggcccaacgagtgaggacaggcctgcaccaataaaaaaagcccgcgggcctccggctgtaaccaccgacgtgacgtcgagcgcccgcgggcttacaagggccagcgatgatct

SEQ ID NO: 631126 - DNA, 120 bp, Homo sapiens
atatatggttggtaggttggttggttggaatttttggtaaagacgaaatttaaccatgttgctcaggttggtctcaaaattcctatagaaatctcaaggcaatcttgtgcccactttagc

SEQ ID NO: 631127 - DNA, 664 bp, Homo sapiens
  misc_feature (664)..(664): n is a, c, g, or t
ctgatctggcggatatttaatcatttgtgagccagcactgcaaaaaaaaaatttccccctggcgaatcgtactccttaacgtgactagctcgctaagcattgggttatgtgtgtcatattcagtaatattacattaattgattgtcatcaaacaaaggtgtgcctcgtcataagacaacactcaggattgttgctcttatgacttgtaacctggacaaccctttgtcatattagcttggaacacttaaatcattcaggtcctttgctgaacagtggtagtctagtgacttcagtctagttcaagaagcctaatgtgacagcttgggtgaccatactgaccacaggtgcggagaaccgtcattgacaggaaaactgtcggtctggtacctgcgggctggtcaactgcctgtaaagggaacgctttgccggacactaacacgtaactagacgtgactaaactctaacttgagaggatcctgataggtccgacgcaggcacacggagcacttttgcacaccaccaaaggccctaggcctcgcccgggaacttcctcgggcacaagcacaccgacagttacagcgctctagaaccaagggccttagacggagcacaacaggggttccacctacgggggcacaaggcattggcacccgacgctcaattn

SEQ ID NO: 631128 - DNA, 323 bp, Homo sapiens
ggctgcacgccttcaagcgagcaatattggaatcgcgtcgagcccgttggcagacgcgctaggaaatgtggcgtgaccactgggaggtcgccaccgcagcggttgctcgcacccgtggctccggtcaacggccgtcttgctccaaaaggtaggcgacgcgaatggtcctgacgagtagcgacagcaaatgagcgattccttgggcattgttgatgcgctcggcagccaggtagtcgagcacttgcgtccagaaggtctagtcattacattcacaattgatgcagtaccatttagaaaaaggaaacactagcacttttggccat

SEQ ID NO: 631129 - DNA, 385 bp, Homo sapiens
  misc_feature (79)..(80): n is a, c, g, or t
  misc_feature (366)..(366): n is a, c, g, or t
  misc_feature (374)..(374): n is a, c, g, or t
acacaacaaatagcatggtagaatcaattaaacactgcattgtgttgctacagattgctaaagaccagagtaatgcggnngcacgcagatggaattataagtactattaatcctgtagatgcaatataccagcctagtcccttggaacctgtgatcagcacaatgccttcccagactgccttacctccagaacccgctcagttgtgtaagtcagagcagcgtccatcttccttacctgttggacctgtgttagctaccttgggacatcatcagactccaacaccaaatagtacaggcagtgggaactcaccacctagcagcagtctgactccttcccaagccatgtcaactttgtctccaaattcngttccagnggttctcttac

SEQ ID NO: 631130 - DNA, 369 bp, Homo sapiens
tatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgttgtagaagtcggaggatagtaagctgagtgaatggtatagttgaaccatagagataagatgattttaaagagtgtaagaaagcctttagcaagatgtcacaccttgttgtacatgagaaactttgaaaatggatcttcatatagaatcagtggatggaaacaagggtttaaacttgatacaaaaccttttat

SEQ ID NO: 631131 - DNA, 120 bp, Homo sapiens
cacctgtagagcagagggactgtctgtctgactttatgtttccaaagtgtagcaaactgtaggcattcagagcaaatgatacgaatgagaaattgaattttatcttgtatttagaggaat

SEQ ID NO: 631132 - DNA, 509 bp, Homo sapiens
cacaccacctgagtcttcatttggatttatttatttgagtgggattttcatttgctttgactgaaacgagaaaggaagaacaggtgctgaccctgtcatgactgaaggggtaagaataggcattgtggcacctctcaaccagggctgcttccttacaggaagtgctccaaagctgccgagatgggagtgatttaacagctgcctcccccttgattgaccgcatcaggctttaaaaatatcaatggattcatcagcatcaaccctttgcagaactctcttgaagactatcgtaatggaaacatgtgaaagcttttatgagtgcactccaagatatgatttatgggaaatagtcgcaacaagtgtttgcttgaagtctgttaaagacattcctctgaactctaggcactatcagaacatcaataaagcatgaattttgagtaaagaccaaggcagataaataagtattggcgttgggatttctggaaaattttctggaacatttatcaagg

SEQ ID NO: 631133 - DNA, 705 bp, Homo sapiens
  misc_feature (609)..(609): n is a, c, g, or t
  misc_feature (621)..(621): n is a, c, g, or t
  misc_feature (649)..(649): n is a, c, g, or t
ggaattcggcacgagctggtatcttagtcaagtaaatgatagatttacagccaaagaaagggaaaaattccctaccggccagcaagctgtctccagtataggatccccactgggacctcaactcagatcagggccactgcagtcaaaacacaggttgacctgttttctagaaagactaaggagaattaggaaaaagcccatgaattattcaatgatgtccaccataactcagggaaaggaagaaaatccttctgccttccttgagcagctataggaggccttaagaaaatatactcccctgtcacctggctcactcaaggttcaattgatcctaaaagataagtttattacccaatcagctgcagatatcaggagaaagctccaaaagcgagccctaggccctgaacaaaatctggaagaattcttaaacctggcaacctcggtgttctataataaggaccaagaggaacaggcccaaaaggaaaagcaacatcagagaaaggctgcagccttagtcatggccctcagacaaacaaaacctggtggttcagagatgacagaaaatggagccggccaatcacccagtagggctttttatcagtgtggttngcaaggacactntaagaatgtctaatgagcaagccacccnccagtccatgtccactatgccgaggcaatcccttgaaggcacctgcccagagtgct

SEQ ID NO: 631134 - DNA, 1272 bp, Homo sapiens
gccaagatgacggtagctgcaggcttagcttcgcggggtagtgtaggtgcccagcggggcgcggggctcccggagcgcgcgtgcccgggagtctgctggtgcagcgcgcggccccgtggccatgttcccgctacgggacacctccaggcgattggccttgttcgtcgacaggtctgggcctttcccgtaggtcctggtaacacgtgatgctgtcatgcgctgggctatgctggcggcagggtggttgcggggcctggacctgtggggcttcgtgacgatttccgagttgttgagctgtccgagctggaccgtggcagacttgcgatccgcctccccaggatatacccgctgtggtctcgaccgcttgggacttccatctccttcgcttggtgaacccagaactacagtcactctcggtgagtgggcgtcttcccagtgggtactaataaatcgcaagagctggtagcccgcgcgttcacttgcccagcatgccattgggcaccgttctgctgggaccctaacacggcacaaaccccttgaggtgggagcagtttggttgcattagcaagcaggggaaggcgaaatggacagcgccgtacacggtgaaaggcttggtggacttggcggcgaaggcggttgggggaaggggctttcccaatatgggaacccgagtgcaccctcccaaaattggcagaggaaatttggctggcgaaagacaattaggttgtaccaacttagcgcagtggccaccagggcggggcacaagactttggtttatcaggaagccttaatttgattcgccacacaaaatatataccaattatacgacacctctaaaaaaccaaatgtgttggaaccgggctgtttgccaaattcctgaaaaggaccttttgtacgcttagaaaccccaaaaacctgggtagaaggcccaaatatgtgtgcagcgcccccttaccgttgaaagccctattccgaagtaacggataagccagttccgggattggcacggaaacggcatttaggcggtcactagtttgcggtttgagggtcaggacgggggaagcttaaccaaggattcctattccatttcgcgacattttgcgttacagacaggcggagccattaacgatggccggaaagagacgaaaacacgcaaaacccatggtggagggctcgggttcaacctttggcgggcggggaacaaagaggtcccttcgtaaaccttttacgaaacccgcgcccttaaagcgtatttacccattagagggccca

SEQ ID NO: 631135 - DNA, 495 bp, Homo sapiens
ctggacatcttcagtcaagtcttcaccacactgtatattttggtaacaaaccataagcatgcaatagaagccaattgttcctgtccaaagataagaaatcacaaccattatcatggtataaccaaagtacagaattgtgcttgcggttcccgtgttctgccgttatgcccaaaaatagtgtactgcatagattaagaaataaactgcagtaaagccactcgtaaggaatgaacgccattgccaatgataatcctctgcacataggtggaaatagcaaagaagtatagttgcttcagaacaggtaataaccaaaatgataaacaccagaaataggaagccaaacatgtaatacatctggtgtgaccaaatactattcagaatgaagaaaagttgtataaagatgcagccaaagggcaaaatccctcccatgataataccaggcaagggcttcgtgtagaacgactgttcaggaatctgacgtggaatctgattggt

SEQ ID NO: 631136 - DNA, 493 bp, Homo sapiens
atggcggtgaaggctatccccttggctgtgtgttggattgtaatcattgtccatgctccttcctgccagtcttgaggtcatgcctgccctcaattggagcccgtctgcacctgtgttctcagggtcccagaatggtgatcttgtgagttcatgttgtggccacacgacagctcctgaaccatccagggcgacaaagtcacacgccacgagcatcaagacggtcagggccatgctgtctccattggtcctccatgctgtcacaacatgtcccaataggcgcacttgtcttgtcccatgtgatggcacatggccagtgatgtacttcatagggttaaaacacagaccactgatgggcccttcgtgtccagacaaaacatcacggagcctgcctgtctgcatggaccacacgacaatctcaaaggcgtcctgcgccccctgcagatgacgatctcaccgctcgcaatccaaccgacacaacaggagaaactgggtg

SEQ ID NO: 631137 - DNA, 444 bp, Homo sapiens
  misc_feature (203)..(203): n is a, c, g, or t
tgaacccccaaccagattaatttctccacagctggaattccaaggtgcttggggatgaatgatgacctctgaccttttctatccttttgggaaagtactttgaggtgtgcaagctgcatggagagcctcacgcaggagaggagattttgagggtccaacgaacgctagtaccagtaggagacaacggcagggaaaatactacngacatttcaggagtcaaggcccctctgagcgtcgtcatattggagaactggagtgttgtgctaaggcacctagcttacttaagggatcgccagaggggattataagtgagtactcccccagaaacctggggagagatttgaataggggccctcatgagagaagggtgactcatgacacctccaagtggttggggactctcgagatgaaaagttaacaacgaatgctcatggttttgcagag

SEQ ID NO: 631138 - DNA, 104 bp, Homo sapiens
tccccctgtgtactgcgtgtgctgtgtgttgtgtgtgtgtacgctgcggggactgcactaaacgtactgagtgctttttaggatgggacttgcgatgtaagatt

SEQ ID NO: 631139 - DNA, 763 bp, Homo sapiens
  misc_feature (25)..(25): n is a, c, g, or t
  misc_feature (92)..(92): n is a, c, g, or t
  misc_feature (109)..(109): n is a, c, g, or t
  misc_feature (119)..(119): n is a, c, g, or t
  misc_feature (123)..(123): n is a, c, g, or t
  misc_feature (128)..(128): n is a, c, g, or t
  misc_feature (133)..(133): n is a, c, g, or t
  misc_feature (137)..(137): n is a, c, g, or t
  misc_feature (141)..(141): n is a, c, g, or t
  misc_feature (145)..(145): n is a, c, g, or t
  misc_feature (157)..(157): n is a, c, g, or t
  misc_feature (167)..(167): n is a, c, g, or t
  misc_feature (175)..(175): n is a, c, g, or t
  misc_feature (194)..(194): n is a, c, g, or t
  misc_feature (217)..(217): n is a, c, g, or t
  misc_feature (255)..(255): n is a, c, g, or t
  misc_feature (275)..(275): n is a, c, g, or t
  misc_feature (285)..(285): n is a, c, g, or t
  misc_feature (330)..(330): n is a, c, g, or t
  misc_feature (375)..(375): n is a, c, g, or t
  misc_feature (384)..(385): n is a, c, g, or t
  misc_feature (391)..(391): n is a, c, g, or t
  misc_feature (403)..(403): n is a, c, g, or t
  misc_feature (432)..(432): n is a, c, g, or t
  misc_feature (436)..(437): n is a, c, g, or t
  misc_feature (442)..(442): n is a, c, g, or t
  misc_feature (458)..(458): n is a, c, g, or t
  misc_feature (460)..(460): n is a, c, g, or t
  misc_feature (501)..(501): n is a, c, g, or t
  misc_feature (509)..(509): n is a, c, g, or t
  misc_feature (552)..(552): n is a, c, g, or t
  misc_feature (728)..(728): n is a, c, g, or t
atttaattaattttaaacacatgantgactctacaaaatctttttttagcaaagttacattcagaagttactaaagaaggaaaatgtttttntttttccgtcatgcaantcgtcgttantttnttccnttccntacnttcntgantcccgcgttaantaatacaaanaattaatngactgtaaacctcaaagangtcatggtaaaaggcatcttttngcgttcacagaaatcatgacccatagagaaaacaaggnaaaaactaaggaaaactgancattgaactnttttcaaaaaaattacaaaataggatgtataacattatctttggnaaacagacattttctttctactagaaatagcaaaaatcattctanattggttcnnccccantggcatgtacantgagcatacataccaacagtgtgcatganaaannggcgnagccagagggagtggngngagggcgtccgaagtgggtcggctaaggcagtggccaaganactatgangtctatgcgctgactggacagagtaaagaaacaaaacagaaanaattaccaagggataaagctgacaagacccagcaacaatctgtcattacttcagctgttagtcggtcttctccccccacccagccccacaaaaaaagttctgctctgcttaagtgtacaagactccagtgaacttccaacagtttggcttcaagtgaccaaggaatggagtgagtnatctgtaaagcctggagtggtccaaataacacaga

SEQ ID NO: 631140 - DNA, 122 bp, Homo sapiens
gatatataatagtaattcagaatggtatgtagggttgtcggtagaactgctattattcatcctatgtgggtaattgaggagttgctaagatattgcgtagctagggtatggtttactccaca

SEQ ID NO: 631141 - DNA, 138 bp, Homo sapiens
atacttattacttatctattaataattattaatatatattaatatattttatataatatataatataaaatatataataaataagtagtctagtaataaaagaataccagcctggagtagtcacagcacggggatcct

SEQ ID NO: 631142 - DNA, 1280 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgactgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631143 - DNA, 281 bp, Homo sapiens
cagcttcggatcactgtgatttttccggaatgcatcttactgagaatttgccctcgtgaagattacataccacaaagtttcagaacaataactttagagaatgcctcttggccaagacacttcattttggcatactgactaaataaaaggcttggatacctgttaatttaacgggaacccaacaccatagttctccaataagcccagctatgaatcccagttcccatcgtgcgatgatgtccactggtcgtcaacaacggcttcctcattccgttctcccc

SEQ ID NO: 631144 - DNA, 211 bp, Homo sapiens
aagccttggaaaacgtgattttaaaggcaacggcgaaacgccacaagatcgttatatgagtgcagcggcgatggcggatgacttgagttcagtcttgtcagcacgtcgcgggaatgaagaacgctttgcccaatgtcggaaacgtctgatgatacgcgcattattccgatggcacaaatttcaagaccacactcaaaacagggggtgttcg

SEQ ID NO: 631145 - DNA, 479 bp, Homo sapiens
  misc_feature (4)..(4): n is a, c, g, or t
  misc_feature (12)..(12): n is a, c, g, or t
  misc_feature (67)..(67): n is a, c, g, or t
cccntgtagtcntagcttacttcgtgaaagctttaggttgggaggattcacctgaacctgggaagtnggaggctgcaagtgagcccaaaatttgtccagcctgggccaaaagagttgagaccctgtctctcaaatgaatgaatgaatgaatctttcttgtttgcccttggtagagccacataaataagaaattagaggccaggcacggtggcttatacctgtcatcccagcattttgggaggctgaagcaggaggatcacctgaggtcagaagttcaagaccagcctggccaacatagtgaaacctcatctctattaaaaatacaaaaattagccggatgtggtagtgcacacctgtaatcctagccactcgagaggctgaggcacgggaattgcttgaacccaagaggtggaggttgcagtgagccaagatcataccactgcacttcagcctgggtgacagagtaagactctgtctcc

SEQ ID NO: 631146 - DNA, 1682 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtaaaaaaaaaaaaaaaaaaaaaaaaaaaaaaaaagaaaagaaaaaaaaaaaggggggggcgggtaaagaattaccccctgggggggccaattttggggtcccattttttggaaaaaagggggcccccaatgagagggagacgcaaataaaacacgacgaggccagggccggagtcaacacacacggcgcggatgcgcgacaaacggcacgcgtggggaaccctgtggagagaaacccaaaacctgcggggcggggcaccaacgggggccaccacaccccaagaaaattatagcctcaggaaaataaaactcgagggttaacgggtcaacacaggcaatacccgcgggaaatggcccaggaattttgaaatatgaggcaaaagac

SEQ ID NO: 631147 - DNA, 1214 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgacgaggatgatgatgaacgatgatgcatgatgatgacttttgatgatgaaggaagctgaagaaaaagcgccagtgaagaaacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631148 - DNA, 281 bp, Homo sapiens
aagaatttttttataaagggctttgtaaaaaaaaaaaaaatgtattctagcttttgcgggacaaatgtgtgatacctttaatacccctgccagttaagggcaattatttcatccctcaaaaaaggctatttttgggccagttcccgcaggggttttcatgtttttgcaaagtgacccattttaatccctttttgataaagtggtagcccttttgtagctttttaaaaactttgtattcatccggtatcaatgaaaaataaagaaaatgaaagtgtgggtca

SEQ ID NO: 631149 - DNA, 1242 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaagggtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631150 - DNA, 1842 bp, Homo sapiens
  misc_feature (1320)..(1320): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgaaaanaaaaaaaaaaaaaaaaaaaacaaaacaatcaaaaaacaaaaaaaacaaaacaaacactaaaaagaaaggcgggggcgccccaaaagaatatccccacaggaggggcccacacaatcagaggaagtgagcaacagagttattgttgtggccacaaagggtggcccaaaaaagagaaggaagaccaaataagaaaccgcgcacagggaaagcgggggcagcggtactaaaaacagagcgcgtaggcgtaggggacaacaaaccgcgaaaataggagaaaacaagagggggagagcagaacatcaaactaggtggggggggcgaaacaaaaggggggaacacagaaagacccactaagagagaacagaaagaaagcagcacaaagaggagaaaaaaagacaactatgctagggccagcaatataggcgggacataacacaaaaacgcagaaaatagaaagcgagcgcgacgagaaaaatcgacgatcggaagagagaaactaaacaaaagacaaaatacacagag

SEQ ID NO: 631151 - DNA, 241 bp, Homo sapiens
aaataattttccccccttttggctttataagcaaatttgggaactcagaactgggccaaaggggcttttctttttcaaggttgaaactgggggggcgggtcccttatcccccccccctccccctccccttcctaagggaataggggcccacttagggtatttttggttccggatttgaatggaaaacttaaagcccggggttttttttttttgccagacccccggttttccttttgtttta

SEQ ID NO: 631152 - DNA, 1969 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtaaaaaaaaaaaaaaaaaacctcgagtttttttttttttttttctaggaggtgcgctttttatttaaaaatacgttcccgccagcccgttctcaacgcgtcttttttgggggcttaaaacagccccaattgttcccccaggagaattatactttgtcgccaaaactcatgttgtgcgccgggaatattggaacccgtgggcgctacaaactcttcaaaagaccccaccatcaagatttggtgtactttcctcccgggggttggtgccccaaaggacggtctgttgcctccgaatggggaatttttccgcgttccacaaggggccttgagggtttctgttgcggaagcggccaacggtcacgggcacaccgcgcggatcaacaggaaaacgggggcgcgacggttccgacctgcgctggcgaattggcccccatcccaattcagcgggagggcggaagagagggcgcccccggtctgctgaaaaacccccccagctgctcaaaatgtggacgaacagcctttttggggcacgtggagccctcaacggcccacaagagcgggggaagaaccacggccaaacgaccgggctgatcaaacaacagaggggcggtgaccccccaggaaagggcgtgacagcaacaacacccggggccctcgtcggcggcgcacagt

SEQ ID NO: 631153 - DNA, 234 bp, Homo sapiens
gaaattcaattttttttaaaaaaggaaaacccttttttcctccaaaaatgagtattagggttcatgtgtttaaaaaaaaaaaggttacaatgtttggccaaaaaaaaaaatgggaaattaaataaaccagttgttcagcatctttggaacatggggacgagtgccgccaggaggcccccaaggaaatcccctcaaaattaatttgtttccaccaaaaaaaagttttccctccca

SEQ ID NO: 631154 - DNA, 1463 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtaaaacacggtcgcgaggagtaaagaaaagttttgcccgataggagtcgatgtcgacgcgccgaatttactgtagtgtcgaccgggaatccggacggtcccgccgcgtacactttcccatagtggccgtatagcctgggtcatcaggtcaaccgttccgtgtaaa

SEQ ID NO: 631155 - DNA, 807 bp, Homo sapiens
  misc_feature (332)..(333): n is a, c, g, or t
ggcatgacgccgaattcttgttcggccacctatcaggtccaaccatcctgcaccgatggagatttaagagggattctaaggttcttgggtgcatcacgccaggcattctgggaaactaagggccgtgccccacaaatttgccctactctgttggcgtagtcctgctgcccaccaaattgtgagcgacctgggctgtttcaccactttgcgttttatttcccagtcaaggaccaccccggttcattcactcctgggcagttactcttcttttgggtctgtgatattccttgcctttcccagggagaatgtgcttgccaggtctggagcaactnnattccagaatcttaggggaaggggagagatggaaatcaccacacccgcttactggaaaggtgccaaataatatgggttgagctggaggtaggaataccggttattaaggtttctactttaagggaaaaccagatctattgcccatttaaataaggtaactgggatttggttaagttcaaccaagatagccagaagatttatttacaggcgttcacctgtactgtccagggccagagaaagcctggtaaacacagctacagccagtttacacgtgtgatggctgtgacaccagctccccatccacgggtggacaccacacagagggcaactgggctggcctggttcagtgtgaatccaaccgcttaacccccacctggtacaagtgatttttttttgtgagccttacacccagcccaactattgtccaagcatcatttttatagaaataagccttattttgacctgttttattta

SEQ ID NO: 631156 - DNA, 1304 bp, Homo sapiens
  misc_feature (1287)..(1287): n is a, c, g, or t
  misc_feature (1291)..(1291): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcaagntcanacgagctcgtgcc

SEQ ID NO: 631157 - DNA, 382 bp, Homo sapiens
acacgcgattgctatatccagagcagtaacacaggtccgtcagcgaagtcgcctttgtgcctacccaaccctggaacgttgcagaagtggaaggagcagaacgtgagggtgtacttacaaaaaggtaatcaagaacaaagacaccaacataacccccaaatttgccaactagatcgaaaatatatatgtcttacaataacgtctccgaaaccaccgtccagcgtgatcttctagcactccatggcaccgggctgagcgggtaagtaaaaaagataaaaagtgccttttgccccttcgaggaaaccctttcgcaggccaagcaagggctgcaagtgtatgggagctgagaggagaacggaggcttctggagcattgtatctag

SEQ ID NO: 631158 - DNA, 862 bp, Homo sapiens
taatattctaccttgcagtgatggcctattgttatccgcacggtgagagcaccgttattctcgcgcactccggggtgtcaccgggcatatttccagggtgtgccccggaaacacctctccagggtggaatatgcgcctggtaagtctggcttcgccgcttttctgttggcccccggttggcctcgtggctccccgcctcctggtgcctgctgggtctgccaccgggctcttaaaacgttgttcaccaagcaacaaaaagcgttgcccaggggccccaaacggggaggccgcccccagggggtcaccaaatggatgaaaaaatcccggggggaaaaaaacaaggagggggcccccaggaattgtttcctgaaccagggcgggaagccccagagttcggcccccgcgagatacaaagcacaccgggccaaccttgtcagattaagggctacacagaaaacaagaccaggtttcttctccgggaatataaggagcccgcaccacgaagcgagtttcaacgacgccctttcgaacccgggattgcgactcatgcccgaggggattctggcgcaaccatcaaagaaatgtgggagaagccaacacaggtaaaacataaggaggaatcaaccaagggacatccccccggagtctccatggcagagaggagcggacccagcaattctagtggggcgccaaccatggggaacccactctccagaatgcaggtacggcgtccggagaaccccccccgagggggagaatgcctgctccccgctccctacccgctgtggggagactccttattggcagcacacgggcaggcttcttcaaaaaaacaacaaagggggatacccacaaaatgaca

SEQ ID NO: 631159 - DNA, 1265 bp, Homo sapiens
gtgcgggtgatctagaggatcccgctgccgctactactacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631160 - DNA, 484 bp, Homo sapiens
gcgttctagaggatcccgcattactcatggctattgctgggtagcagattatccacaattattatgtagctcaaaaacgtgagtttcctgtttctcttcttttaccattgtcgttattctttccccccataggcaactccctcccttctcataattagcttaagaccttaatgttggctgggtgtggtggctcacacctgtaatcacagcattttgggaggctgaggcaggcagatcgcctgagcccaggagtttgaggccacaagatcagcctgaataacatggcaaaacccaatctctactaaaaatacaaaaatgagtcagatgtggtggcacgcgcctgtagtcgcagctatttgggaggttgaggtggcaggatggcttgaacctgggaggtcaaggccgcagtgagctgtgatcgtgcgactgcactccagcctgggtggcagagggagaccctgtctcaaaacaaacaaacatagct

SEQ ID NO: 631161 - DNA, 1253 bp, Homo sapiens
  misc_feature (1227)..(1227): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacgtagtagtagncgcagcgggatcctctagacgaccag

SEQ ID NO: 631162 - DNA, 327 bp, Homo sapiens
atgcggccaataccgagtttgatgaaatatacgagtaatgcccaattaaacatatttccacaggacattattaatgttgaatcttataaacttattgtaacacccgctgagggagaacatgagggaagtatgcagcaagggttctatactacgtataattttgatagtgcatttacagtaaccattcaatccccagaaggaactgtttataagaacggaaatggtagtaagcatctaaaggcagttatatataacgctgtcggtgaggtaaattcctaccaggaatactatttaattattatgggtatctatataagcaggggcact

SEQ ID NO: 631163 - DNA, 203 bp, Homo sapiens
cataacgtgagcatgtcacattgaaggccaggtagggcttgtgtacagagctccacaggactgggggaaacagagaccccattcttaaaaggtgcacacagaccttcacgaacgcggggtcccagggcaaagcaaagtctccatagcaatctgggtcaaacctgactgcagtacttggaggatatcctgggaaaacaggggtg

SEQ ID NO: 631164 - DNA, 210 bp, Homo sapiens
gcggcccaccttatcttttttggtagagacagagtgttgctatgttgcccaggatggtctcaaactcctggcctcaagcgatgctcctaccagtcggcccaaagtgctaggatacagtagggagatctccctactgtatcctatctctcccagtcctagctgctggcatcactatactactaacagaccgcaacctcaacaccaccttct

SEQ ID NO: 631165 - DNA, 108 bp, Homo sapiens
cagcagatttgtgcaagagtgcgccctctactggaggggtgaagaaacctcatcgttacaggtattaaaaaacaggaaaaaaatggggggtaccgagactcggacatt

SEQ ID NO: 631166 - DNA, 398 bp, Homo sapiens
cctcccaagtagctggaattacaggtgtgcactaccatgcccagctgttttttgtagagatggggtttcaccatggtctctactaaaccctgtctctactaaaaatacaaaaattacccaggcgtggtggcacatgcctgtagtcccagctactcaagaagctgaggcaggagaatcactcgaacctgggaggtggaggtggcagtgacccaaaatcatgcactctggcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttatttt

SEQ ID NO: 631167 - DNA, 183 bp, Homo sapiens
atcggattctgttaacactgcgcacgacgggactcctgtcacattttatcataataacttaaaattttacttttggagttcccactgtggcacaacaggatcatgcagcatagctgcaatgccaggttctatcctccacccagcaatagtgcgtaaaacggtaacacccacagggggtacccg

SEQ ID NO: 631168 - DNA, 291 bp, Homo sapiens
aagatggtcctcagctgtaaaactatggaatggagacacaaactatgtgaaaattcccaacatttagtctccacccataaaggtatctcccttatctgaacctgatttccatatctgatttatttatttatatttatttatcattgttgagatggagtttcgctcttttttacccaggctggattacaatggcgcgatcccggctcactgcaacctccacctcctgggttcaagcaattctcctgcctcagcctcccgagtagctgaggaccatcgttggggtaccgagct

SEQ ID NO: 631169 - DNA, 114 bp, Homo sapiens
gagaatggctcccgcaaagaagtgtggcgagaagaaaaagtcccgttcgccatgcaacgaggtgaaccacgacgatgacacatgaacatgcacacgcgatcctccgcgtcgctg

SEQ ID NO: 631170 - DNA, 230 bp, Homo sapiens
ataaactggaaactttatgggcccaaggacatacagggttttaacagcagagacggactagagcagagcggggactaaaacccagaccttacaggtcaaggggggtttggacatacctctatgactttatataagattatttggtgtctggaaaatttttctatctttaaggtaaacatcctataaggggataatacttaaactagttggaaggcagattcttcagaaag

SEQ ID NO: 631171 - DNA, 333 bp, Homo sapiens
ttacataccccagatcacctttctttctttctttctttctttctttctctctctctcactctctctctttctttcttcctttttgagatagagtctcactctgtcatccaggctggagtgcagtggcatgatctcagctcactgcagcctccgcatcctgggttcaagcgattttcgtgcctcggccttctgagtagctgggattacaggcgtgcgccaccacgcctggctaattttagtatttttagtacagacgaggtttcaccatgttgaccaggctggtcttgaactcctgatcttaagtgatctgcccgccttggcctcccaaagtgc

SEQ ID NO: 631172 - DNA, 426 bp, Homo sapiens
catagcagacaagaattacgagttcaaaacaggtgaaacaattcaatactgtttacaaagctgcatgaccttttttgtaatacactgaggctcgccatgtgttttctaataagcttgtatcttcaggcttgagcttttgtaggagagtctatattaaattatcagacaaaaatatcatcgttctcaaactatgaaaccactctagagtttggagaatcagtactttgccctcattatatttgtgagaagctaccaactaatacaagctcactctgatcagccttatggaccagaggcactacgtgcatccagtgttcactaggacgcacagggctgaaatatccatctctcctagcgtcctccccattggtcgatgtcttttactgttaggaaacgcgctctctagacataatgactctgagagca

SEQ ID NO: 631173 - DNA, 439 bp, Homo sapiens
  misc_feature (125)..(125): n is a, c, g, or t
  misc_feature (388)..(388): n is a, c, g, or t
  misc_feature (398)..(398): n is a, c, g, or t
  misc_feature (424)..(424): n is a, c, g, or t
cagagtttcactctttcacccaggtgcagtgccgcgatcttggctcactgcaacctccaccttctggttttaagcgattcttctgcctcagcctcccaagtagctgggattgcaggcgccacacncacaactggctaatttttgtatttttagtagagacggggtttcaccacgttggccaggctggtcttgaactcctgacctcgtgattcatccacctcagcctcccgaagtgctaggattacaggtgtgaaccactacgccgggccccttattgttattatctttcatctatacctttaaggtaaagtgggaacaggttaaagttcgtgggcataattaacactttcattggaatggcacaatagtattttaacatgtttaaaantttggggttnaaaatatttaccacacttaacctaancttttttaaaatttt

SEQ ID NO: 631174 - DNA, 158 bp, Homo sapiens
ccgagatgtctgagatggaacagttttatccaaagacattccccacatcatggaacagttgtcttccactgaaactggtccctggtgccagaacaggttggggactgctggcttagacaaccaccatttagcgacgagcactttgagttaggtaatgc

SEQ ID NO: 631175 - DNA, 326 bp, Homo sapiens
caccaaggatcgtcatgattaggcgcagtatcgagagatttcatgtactatactacatagtctcataggtgtagatgtccattggtgtatgagtcagtatatgttggatataggagtggtgtgagcttgacgcacttatatgtgctgctttatgctacatggtgtaattttactctctctacagtttttcctatgtcaagactgtctcttgactacagtaaattacagggattagaggtctgtggcaattaaagtgactaagatctatcttgacaacagtatcacatgctcggaggttgtcgctctactataatcttccactattt

SEQ ID NO: 631176 - DNA, 191 bp, Homo sapiens
gtgagagttaagttgatgccaagtaatgacgttaagatccgtgcaagcctgtggctactacaaatgttgcacccgtaaatccgtcggaaatggtgaagggagactcgtaagtactctgaggcttgctacgacggtcaaatagatacccattaaaactgttatacgcagtgcttgaattatttggtctcggt

SEQ ID NO: 631177 - DNA, 854 bp, Homo sapiens
tcagcgtctcgaggcacgtgcccagtttcctttcaaaatgtcgtactgtccagccgaaatcctgtgtcaagtctcaggcattggagggtgaggcactctacgaccaccgcaaggtgcagtatgggctgcgtgtcaagagaccatataactatagctctttgatgctctagcgggatgcttctgcaacattgaaacagccatcaggaccaaaggtgttggcagtgaggtcaccgttgtcaagattttgacgaatcgtagacaatgcatagagacaggatatagcctacgcttaccagagaaggagccaagctgggaagcttgcatcagatagtggccgtcaggccttatctggccacctggagacggtgatccgggcctattgatagaacgacctgctcggatagtgacgcttctgagtctaaaagcttccatgatgggactgagaaccgacgaggatctactcattgcgatcatctgttgcagaaccaagcaggaggtgggggaaattaacggagtctaccgaggcaacgtgtgctgtgagtgatctggagtgaggacttaattcgggagacaatctggtgacttccgtaccgctggtaggttgccctgtgcaaagggtgagaacagcagaggaatggtctgtcatgattatgaccctgttggcacagacggtcgggatctctattgacgctgcacgttaacacaggcaagggactggctgttcacacgtgggtcagcctcatgaccgagaggacgtgcccactccagaaggtgttgacaggacacgagctcccgcctttacattgtgacgctcacgagagtaacggggcgcggaagctccgaaccgctagcac

SEQ ID NO: 631178 - DNA, 208 bp, Homo sapiens
  misc_feature (106)..(106): n is a, c, g, or t
  misc_feature (158)..(158): n is a, c, g, or t
  misc_feature (186)..(186): n is a, c, g, or t
ttatacagacatctattaaaaaaaaccatgtgacacattagagagttagaagtagaacatgaccccgactatacaggcacagtgtgcacacacgctgtaatcccangcactttagggaggccgagagctggtaggatcatgaaggtcaggacgatcgnatagcatctctggccaacaacgttgaanaccccgtgtctactataaaata

SEQ ID NO: 631179 - DNA, 399 bp, Homo sapiens
ccccctctggatgcaagtgtcagcaattttttttttaaagggggaaatcagatgtcacctcccgggcctaaaattctccaaggacttcccatggcacttaaataaaatctaaataaggtcaagcagggtggctctcaccggtaatcccagcacttggggaggccgaggcaggcggatcacgaggtcaggagatcgagaccatccgggctaacacggtgaaaccccgtctctactaaaaatacaaaaaaaattagccgggcgtcgtggcgggtgccggtagtcctagctactcgggaggctgaggcaggagaagggtgtcaacccgggaggcggagctggcagtgagccaagatggtaccacggcactccagccggggcgacagagcaagactccgtctc

SEQ ID NO: 631180 - DNA, 684 bp, Homo sapiens
ggggtcgtggggggggggcgggggtatgtggtagtgtggtgtgggtgggggggtggggtgggggggggggtggtgggggtgggggggtgggggggtggtggtgggtgggggcgggtgggacgcgtcggaggtggggggagggggggggtgtggaggcgaggcgcagtgtgggagcggggtgaggatggcgcgcggcgagcggcgggcccgggccagcttacgggctaggtacgaggcctgggtggaggtaagccgcatatatatatatatgcgtagccagaccgagccacatagctacagtacaccatggggggaaggtagaaggtacggagtaaacgggatatataggtacgtaatatagggggcgcctaggtacacccagggctagctatattaactactgggtaaaagtaggataattagtatgccatacaatagacccctatacatatagacctacaactaacataggtttaaacatagtaaccaataatagataaccacccataggcaaatataccataggcaccgtacaagggctagagaacggggaagctatagtacatacaataggaaatacccatacaccatactataccaggagcgagataccctaccaaaatacaagtaggggcgatagctaggcgctagagtaacgtacgtaggagtaccactaggcgtact

SEQ ID NO: 631181 - DNA, 280 bp, Homo sapiens
gaagtctgtggagttgagtggttacttcaaagtgtcaggagagtgaataaattggccacaaaagagcaagaagctctcttaagaaaagggaattctctttaaagaaaccaccaccaccgacaatgcaaccaaaaaccatgtgttatgtcaaagctgtgtagcacagagaatgtggtgtcacagatacatcgtcgagagagggtgctttctttcattgttgaatgtatgagacagatgtcagggtctgtttctagggcaaggagctaggggaagactccac

SEQ ID NO: 631182 - DNA, 1426 bp, Homo sapiens
gcagagcgcctgttatggcggccggctaagtcccacagtagacgggagtcgggtgggatcccagggtgggcccctgcggcgggctgggattctcttccctggaccaaagtctctgaggatcttctcccatgggctgagtgcaataggctactcggctacccaagcgtgtggaccgttgtgctgcaagtatctccgtctgaggacgctgccagtgctagaaggacgccatctcgtcaccttctgcatggcgactccgtgatcctaggacgtaagcgtggacgaccatggagccattggctatcatgacgtggactctcatgcagagcagtccagtggcacgtatggtgcaccttttagtgagctgacaacatagtgcgttgtcgaagatgtccaacctcttatacgccctgaaccgatagacgatctcgatgggtacagggctgaacaagcgttgggcgcaggcaagatttatccatagtccccaaattcagagctttcgtaagtggaagccgaagaactacttggcacgacggattccagtgcagcacgcaagcggtgggctagtcaacgcagtagcgatgtgtcatacgacacagtgagccttgccttgtctgcctagagaacagggcgcagcgccacacgtggtcccccgtctcaagtgacacgctggggcagttggagtcaatcgattggcgtttgctgccgctcccatgagccaggtgacttgaacacccactggaggctacggacatgtggctagaatgctcatgcgtggcattgagggagtgggccgaacttttgtgaccgttgggatcacaggagaggaacccaacgaagggcccgcccttcatggcacttgcccgaaagccgaagggtaggtggtgctcttcggtggaagcaagcaccgcgacggtggtcactacttcttcacatgcagtttccttaagtccatcatgtgcaagcgcaagggacctcaactgttcccgtgggcgggagcaacgcggaactgccccccagaggggtcctatgcccccagggagttggactgacttccgttgcaggggcaaatttggaaacagggaatagagcgcccagtgtgtgtcgccaccgagcccccccatgaggaaaggggcatgtggttcggcgggccaatgccgcagcggtgtgtcgcgggggaagagatgcacccctggagcccccggtgcgacaagaagcttaagaagattgccagaggtatccccggagaaagggagagccctctttttccgaaaagacacgtgcatcaaacgggcttgagaaccctcttcgcgagggcccgcacacgaggagcatctgcgaagccagcaacgatgcgacacgcaacccaattagagagcacaggacccgcgattttggtgatccagcagctcgtgagaaacaaagcttg

SEQ ID NO: 631183 - DNA, 951 bp, Homo sapiens
ggatgtcttactcttcacacccagaccctgtatactcagtaaataaccttggcaatggttgactaattgattacgttgagaagatgagaaggcggacataatgacaatgatgataacgttccatcgtccagatatacttattagtggttatcgagtgtcgtaagtgtggcaactgggtacaccatgttaacctcctaccaccctgattcgctgtcttctcagaactgtctcgctgttagaattctggattggagaccgtattgacctggtgactttacttctgtgtgagcgcgttagatttccattgtaacttagtgcattcatccctctgtataccaaactgagttgttttaggatacttacccaatgtggcgatttaaaatgtctgtgtgagtccatgtgcctgaactaggccctgttcgtgagggtgtctcatcgaatgctgaatcatgactcaggaaagtgagatccccagacactgtgagatacgtgaagaaggtcagtgattgaatgaattagccaggcgtagttcacaagttctccaggtcccggaggtcagtgttgaatagctgacggcttggttccatgtgccgatacttattgtctgagcagcccatgtggatatggaaaagggatggtcatgatgggatcatatttgccactatgtgagatatggaaacgcgaatgttttagtaggctgatggttgctggactgtactgtatgtgtgggggcttatgtatggggcatggatgtgggaaaggggtggccgtgggcagtgttttcagaattggatgtgggtggcaggtgttgggcagattgtgcccgtttggggcggggtaaaaaaaaggagtgaaaccggcggtgaatggggcacttaacagggggtttaatcgaatcaggagcgtgaaatggtggacaaaagggaggattaaaaaaggcgggacaatcag

SEQ ID NO: 631184 - DNA, 718 bp, Homo sapiens
gtggacgtagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaactatgggaagatacacttctatttcttcttccatgctggcgtgggctgtctctcatctcggacttcctcttctgctcacatacgtttactcttcttagaagcggtggccagagaatccagctcctgtggccaccctgtgtcccagcaagcagctgagtggagctgcatcaggggtgcccatctcctgccggaccagtctctgacatgtccaaaagcatgcagggcctggcttccgtgctctggctattggtcaacttcatcatggcaaggggaaagcaccatgacccttcacgggcacagggctatgctcaccgtattaacattacctcgcggggtgcttagactcggccaatcccccggtgatgaacacacgaagacccctctgaccaatggtttaaccggtgctcgaatgtacgtggcagggttcgaccaactggtcacgatagtccatgcctgggcaacaagaaactcacactcctctgacccatatgctcatccccatcctcctcccaccaagatccaggtgcctacccatatctacagctagatcg

SEQ ID NO: 631185 - DNA, 601 bp, Homo sapiens
aagaatcatataataaagtaatatgaggtcattcttgttcatcacgtttccagtatgcttttctgccaagcagcaactggccgacacaccatcagcatatgaaaatcttcaaccagaagacaatattgtctaggttctgggaaagctcaggcatgcattttaagagagaataccagggagaaccataagcaaatcattcacaaattaccatttcagatgtcagtgttcataattgtttcctgaacctaatagcagcaacttgagggcaggaactagagccggcagggagtactaaggcattcatccaattagcatttctaagttaaccattatcgcatttatagtaagtaagacacagggtcttgctctgtcacccagactaaagtgcagtggtgcaatcacagctcactgcagactcaaactcctggactcaaggattctcccaccttagccttcccaggagcacactatcacggttggctaattttagtatttacagaaaagacagggtttcaccatgttgactaggctggtcttgaagtcctgggctcaagcgatccacctgactcgagctcgcacagtgctgtgattacaggcacga

SEQ ID NO: 631186 - DNA, 152 bp, Homo sapiens
  misc_feature (123)..(123): n is a, c, g, or t
ctgatgtccaatatcaacaataactttgcagagcttgttccggataaagtaaggtaaggttttatggtgagccaaaaggagtttgggcagacagctacggatttccatcttatcctgagatgngaccccaagccacattttattgatcagat

SEQ ID NO: 631187 - DNA, 1541 bp, Homo sapiens
cgcatggaccgagatcctgctcctggcattcctgaagctcatcgactgagggcagacacatggtgatgctggaatgccctgagactggtcaacacagctgctccacgaattcctgctactgggagccctgagccctcgcccaatggctctacctggatgccacatgacacggctgcctaccaggaatgacaatgaaagtatgacctgcttgtgtgcctgtgcgtgtggcaatctgctatgtgttgatgcaccatgcctgaaatgaccacggacgtgatggccctgaagccttgacagccaatggtgtcttgcaatgtctgcaaagaacccaacctttgtgggactgtggcacatggtttacagaataccatgtgattggtggactggtgtgaggccaaacgggtccactggggatgaacttgacaccacacagtggcatttgccattgtggtgacctgggtgacccgttagaggacaatacctggaaagaatggacgaccaacctatatgtctggggaacaagatttacaccgatgctttcaatcactgggacattcatcccgggatcacacctggctagtgtggaggacccaataatactaggcgtctggtatatcacttggggggagtgcccctgacacaaagcaccaggaatcggaacccccatatccacactcgcgcatactgacattggaaccaatattgcttacacaggaaaacggcacacacgataccaccatcaaaccaaattatcccacaacgacgacacaacaagcacacaagcccggacaccgaacaagtgacacacgggaacccagcacaaaaaaagcaacggacaagagcccaaaaccaggatgacaacaaaacaccagaaagcacaagagcaactcacacagggagcacgacacacagagcaagaaccaccaaaaaaagtggtcgaacacaccagacggaaggcgacacccacaaacccaacacggcagacactcaccgcagcaaaccaccacaacgcgcaaaacacaacaccacaaaacaacaaaggagcaggccagtggcaaagcacaaaaacaaaaacgaaacgaaaagaggcaaaagcggacacgaccaacaaacagagcgcaccagagagccacccacaaccacggaccccccgtggacccaccaccgtcaagagcccagagagcaaccaacacacaacaccaaaccagacaaccaacacgacgcgaccacacacgcacacacaaacaaaaaaggacgacagcacaacacaacaagagccgcacgaatcgacaagcgacgccaaccagagcgacgccccgcgccgacgccaccagaagaaagacgcagaagcacacgggtgacaagacaacacggcagcagcagcaagacccaccacccgcccacagacacacgcagacccagacgacccacgcccacaacagcacgacacgaaactcgggagcactgaccgcaccgcaccacgcggacgccacgaccgagcaccgaacaccaaacacgcacaaaagacgcaccgtcaccca

SEQ ID NO: 631188 - DNA, 1299 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631189 - DNA, 839 bp, Homo sapiens
ccacaacacaagacaaggaagcagtgaagagtagctagcatccatggcgtgcatcaataccttgcagagctgctccatgttcaaaggggccaagagtaaggccagaagaggtagagccagtggcgggacctttgagtgccgggcgtccacgttcatggacgggagcgggctccggctcgggctcgacgagaaccccgatgccatcatctccggggagtggcccgagaacttctccctcctcagctacgacgacctccgcgcatacctccagtcacagcagcagcagcagcaacaacaaccatcccatgccggcgatcagcagcgggggcctctcctgcgtgaggccatgtcgacgcccgtgctgatggtcacagcggagcaggcgctggtggaggttgaaggccacttccagctcgtgtcaggcctcccggttgtcgacagtgcccgccgatgtgtcggggtcgtcgtcaagagcgatcacgtgagggcttcacatgggccaaagacgaagattgcagatgtgatgacatctccagcaatcacgctatcatgcgataaaacagtgaccgatgccgcagctctgatgctcaggaagaagatccacagattaccgatagtaaaccaggacaatcaagtaataggtatagttacccgcgatgacgttcttcgcgcgttggaggccatgctgaagttttagaagatgcaggagtccatgcccggtacttgtggatctgtaaatatgtgtgtccgcggtactttgagtagcaggcagatcctatagtctgtaacagtgtttgcagtctgtatcgcaaaaaataagcctgggagcatttaggaga

SEQ ID NO: 631190 - DNA, 1233 bp, Homo sapiens
  misc_feature (1207)..(1207): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgactgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacgtagtagtagncgcagcgggatcctctagacgaccag

SEQ ID NO: 631191 - DNA, 1615 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccagaatggaaataaaactcagtattttaataaaaaaaaaacaacgaaaaagaagaacacatcaaacacgactgaaaagcaccctgaacagcactggaatgggcacgcgaaaacgaataagaccgagcaccacaccgctcgcagcccgtgccaggcacccagccgcgcccacacctcgtagcgttcccacagaggcgcacccacgagcttagcatcaggccaggagaaaagcacgaaccaaagccgccccaatagcagcgcgaagccacccacaaaagggcacatgggaggggagaaccaaagcttgcacgcaacacaagcgaaggagcacccacacctggacaaccaagatccggcgcacactccacggtgcagagaagcaacccgctccgcgcgccaatccggcaccacggcaccaaagcgatgccggacgagtatacaggacggacacagcgaagcagtaaaacacggaagaaaaag

SEQ ID NO: 631192 - DNA, 1176 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggatgatgaagatgatgatgatgatgatttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631193 - DNA, 327 bp, Homo sapiens
gtgtataagcgtcaggaagggaaatagagcagatttttttaggacagtgaaattattctctatgattctataatggtgaatacggtgttgttacacatttgcccaaacctatagaatgtacaccactaagagtcaatcctaatgtaaactatgaactttgaaggagaatgatgtgtctatgtaggtttataaatgtaacaaaggtatcactccgtggggaaaagaaagagagatcagactgttactgtgtctatgtagaaagaagtagacataagaaactccattttgttctgtactaagagaaattcttctgccttgagatgctgt

SEQ ID NO: 631194 - DNA, 429 bp, Homo sapiens
  misc_feature (191)..(191): n is a, c, g, or t
gcggggggacgggggttgtagctaaattgatgtagtgcctagttaacatgtaggagatcctgcattcctccttcagcattgccagaagttattaattaaaaagaaaaccttaagatggctttggtggtgcaccttaatcttagcttgtggaggagggcaggaaggctccagttcaagttcaccgtcattgngtagtgagttagaggccaacctagactccatgagaccacgccacgccacgccaaaaaaaagtgggagaacagaagaatcagcatacaataacatgcatatgtataccgtacacacacacatacaataacatacatgtgtatattgtacacacacgtataataacatacctttgtatattgtacacacacatacaaaaacgtgtgtatattgtacatacacacaacatgcagtcgacgc

SEQ ID NO: 631195 - DNA, 1401 bp, Homo sapiens
  misc_feature (248)..(248): n is a, c, g, or t
  misc_feature (276)..(276): n is a, c, g, or t
  misc_feature (278)..(279): n is a, c, g, or t
  misc_feature (284)..(284): n is a, c, g, or t
  misc_feature (340)..(340): n is a, c, g, or t
  misc_feature (343)..(344): n is a, c, g, or t
  misc_feature (347)..(347): n is a, c, g, or t
  misc_feature (351)..(351): n is a, c, g, or t
  misc_feature (424)..(424): n is a, c, g, or t
  misc_feature (428)..(428): n is a, c, g, or t
  misc_feature (434)..(434): n is a, c, g, or t
  misc_feature (442)..(442): n is a, c, g, or t
gtgcgggtgatctagaggatcccgctgccgctactactacctaagtgcgtgccgccacccgatggaagattcgatggacatggacatgagccccctgaggccccagaactatcttttcggttgtgaactaaaggccgacaaagattatcactttaacggctgcgccgccacctttaaccaacctttggccgaacccccttcgggcccaaccaaccccaccccaccccttggccaacggcccacccagnttactccttctctacacgccacacccgngnntcagntttagcgcggctggtgcaaaggatgagttgcacattgttgacacgggggccccccnaannggnctantggccaatgaattacgaaggcagtccaattaaagtaacactggcaactttgaaaatgtctgtacatgcccaanaaanccgggnggcctctntccccagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631196 - DNA, 188 bp, Homo sapiens
catgcctcttaacgacgcatatgccatatgccaccttttttttaaatttttttatttcactttcccttctttcatgatcatttgcaccattcggatagaacttttttccactatttggatatccgtgaattcgattaagatacaatacccagggtagatgtttaaaatggaaaatatctgaactttag

SEQ ID NO: 631197 - DNA, 1243 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggccgtcttacatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631198 - DNA, 701 bp, Homo sapiens
ggcaaactgagctgacatctaaaagcctttcatagtgataaataagaagtggggcacaccctactctctgcagacaggagatgatgaaccacttcatggacatcctgctgctccatacgctactgatgcgttactccctaaaactcttgaacaagcactgcacctctactagcagataatcattcacggttgaaagggacctgatcacactatcctccgatgcacataagatactgacgccctatcaatatgtcatactcaaaaccaagcaggacaatcaggatatacacaagcatggcatggaggatacagctcacagatgcattgtgactgagtaccaagaaatcatacctcttgggagaactgcgagaaccgagtagatatttacagctatgtatataagcgagaatgcagaaatcttggatgctccaatttcagtagataccgcttgacctgcctataccttaaagatgcacgctgcacacgagtcatatattaagacatacttgaaagttactgtacctcaacattcatgcactacaaagacataactatctgcgctggcgaggataaaccatggccacattgcacatgtcgtcttgtacgatgaacatgtataggcccgttgttactgggtactacccaccaaataggggttgttgccttcagactggacatataaccgtctgcctacattgggt

SEQ ID NO: 631199 - DNA, 450 bp, Homo sapiens
ctcgtagggtaattctatgtttaactttttgaggaactgccaaattattttttacagtgcctgaactgtttggggttcccactagcaatgcacaagagttccagtttctcccacatcctagccaatacttgttactttccatttttaaaagtaaataatagcagccaggcagggtggctcacacctgtattcccagcactttgagtggttgaggcagggaggatggattgaggctgggagttcgagaccagcctgggcaaaatggcaagacctcacctttacaaaaaaatttaaaaatttcctgagcatggtggcatgtgtctgtgatcccagctactccataggctgaggcgggaagatcatttgggcccaagaagtcaaggctgcagtgagccatgacggcaccactgcactccagcttgggctaccttgccccaaaaaaaaccacat

SEQ ID NO: 631200 - DNA, 1743 bp, Homo sapiens
  misc_feature (891)..(892): n is a, c, g, or t
  misc_feature (906)..(906): n is a, c, g, or t
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtgganngccaattcatcatnatgtgaagattgcttccgatgatgaccagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgagaatggaaataaaactcagtattttaataaaaaaaaaacaacgaaaaagaagaacacatcaaacacgactgaaaagcaccctgaacagcactggaatgggcacgcgaaaacgaataagaccgagcaccacaccgctcgcagcccgtgccaggcacccagccgcgcccacacctcgtagcgttcccacagaggcgcacccacgagcttagcatcaggccaggagaaaagcacgaaccaaagccgccccaatagcagcgcgaagccacccacaaaagggcacatgggaggggagaaccaaagcttgcacgcaacacaagcgaaggagcacccacacctggacaaccaagatccggcgcacactccacggtgcagagaagcaacccgctccgcgcgccaatccggcaccacggcaccaaagcgatgccggacgagtatacaggacggacacagcgaagcagtaaaacacggaagaaaaag

SEQ ID NO: 631201 - DNA, 883 bp, Homo sapiens
atggcctataaggatgtctaccactaggtgggcgacaggccagactctatgaagcctttaccttccttaagggtctggagagctgtgatcttggtccatgcagaaaatggagattggatagctcaggaacaaaagcggatcctggagatgggcatcatggggtcccgaaggccatgcggcgagcaacctgaaagctggagcgccgaggcggtgtgccgggccatcaccattgcgggtcggatcaactgtcctgtgtacatcaccaaggtcatgatcacagcagtgcaggcgacatcatctgctctggccaggaagaaacgggcccctagttttaggagagcccattgctcgcatctggggaccgatgggagccattactgggagccagaactgggccaaggcatgcggcgttcgtgacttcccctcccctgagtccggaatctagcaggtcggcgagctacttgacattcctactggcctgtgaaggacttgcaggtcaacaggcagacggaccattgtccctacagagtgcccagaaggcggtgtgcaaggacaactttaacctgatccccgagggtgtcaacgggatagaggagtggatgacggtcgtatggcaccagggatgtggtatggccacttgcatgacgatcgacggatacgggtgacccagcaacgatgcagcaggaccatgatcggtgccaaggacggccgacgtgagaggatcagattccgagggacatctagaacccgaaaggtgaaagccaaagccaaggccagaggaggggacaaacacaagaagaggccgacccagtgacaccacgccagagacagaacacgaaaggagcacaacaaagaccgaacaacacgacaacaaacggacgac

SEQ ID NO: 631202 - DNA, 1223 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgactgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggccgtcttacatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631203 - DNA, 1018 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggtctattcaagatctactggcagaggaggatgtctctttgaagaacatcagagggttctaatctcgtctgaaatat

SEQ ID NO: 631204 - DNA, 311 bp, Homo sapiens
tagtgggggtggcagaggtctctttgcttcattcagccctagctctgtagagaaatgcaaacctcgactctcaaggatgtgaggagcacaagttcatttctgctgccgcgccgaccctgcaggctccattgtgcccaggttgaactctgttgtgttgctcaggttctaggagtccctatcctgaaaatatgcgggttcgtcataggttccttctcaaagtagtaaagcttttccacttttatacgtgcccagtaaatgctctgattctggcaattaagacgaataatttaataaaacacatgttgcttctt

SEQ ID NO: 631205 - DNA, 1373 bp, Homo sapiens
gagtccggtggtgagtccgcggtgcctgacgcagggttagtgcgtctgagtaggctacgactgatgtcttgttttatcctacgcgatgcacgctcttgtgctcatcgcatatcacgttagacgttgcgattgcctgcacacacacgaatgagaacgattcggatgggacaatggagcagttgagcgcacccatgatggaccactagggaagctatcgtgtgtcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgacgaggatgatgatgaacgatgatgcatgatgatgacttttgatgatgaaggaactgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631206 - DNA, 123 bp, Homo sapiens
tcacttggcttaccctaaactggagctaagacacttcatctcacttttgacacccccagcccccaaaatatgtgaagcccagtgagcagccaggcagcactttcatagccagcaggcttcaaa

SEQ ID NO: 631207 - DNA, 276 bp, Homo sapiens
tcagatgcaacatttggtatccattttacctttcatgtactgccaaactagcacaagtgttaaaattacttgtctctacaaaaatttagtcacagcggagtggaatctctccatcttgtaagattacttttaacacgttggcatcctgaggtggttgtgaattattctgaagactgttggtaaggaacatctttctatttactgctatgggaaagaagaggatgaccgcgtgaatatgtgtgcctgtgtatgtgtgtatttgtacggtgtcgctat

SEQ ID NO: 631208 - DNA, 1784 bp, Homo sapiens
gatattaaacagaacggtcagccttcaaaaaaaaaaaaaaaaaaaaaaaaaaaaaaaaaaaaaaaaaaaaaaggggggcaaatataaaaaatttcaccacaaaaaggggagccaaaaatataacaacaataccaagatatttgtgtggacaaaaaggggagtcccacatataaaggaggagtagtgaaattatagagacacatgggccaagtagcacagagttataaaaagctgaaaaaggtgggagcacaagtttggcaacacaggggcacatctgatggtgtaaaggaggcacactattatacatcttgtaggggggtgagacacaactatatgtgagcaaacacaattaacaccataacaaacaaatattttaaaaaacactctaaaaaagaggaacaatagtatacagagaatcttatcaaaaacgagattaattaccacgggagtgcttaaaaaacacacctgaggagcgggacatactagatgtcgctagcaccgccggtgtaccgacaccaactcttattagcccacacactcacagcaacgtacatgtgatcacgattcgactcagcagaaaccactcttagtatactccacacacaaagagagagagagatagcggcgacacaccactgcactcgcgatcacagagacataaaaatatcaaaaaaaataaatatacaacaacaaatacaacacacccaaaaaataaagcaaaacaatcactcacacacgtacatcacgtcaatctaaacagtcaaaaaatataaaaaatacacacattctatcaacaaaaacacgaaaacaaaaaaagaaaaacaacacaaaatcaaaaacaaacataacttaaaacaaacaacaatcatataataaaaaaaataagagagaagacaagacgcagatagagagagacgggagagaaggagacaagacgagagccgacgacacgaacgaggcacgacataggaaggagaaaaggtctaccgaggtgcgaacacccagactcaagatcgaagggaatcaaaacggaccgacagaagaacacagaggcgaccacgacagatacgaagacgaaccgagaacaacaaagagacacaagaacaaacaagaacaacaaaacaaaagcaaaacagccaaggccagacgacacacaccgaaaacatgcgaagaaatcggacacgacaagaagagacagagcacggaagagaagacgagagagcaacagcacaacatcgaagaccagaagacaccagacaagagccgaccagcccagaggcaacccaagtagagcgcgtacgacaggaggatgaccggacgagcgtagcggcagcgagatggaaggccacgacgtcagctgccgcgagtcggcgaacgcaggcagacggtgcacgagcaccagacaacgcgaatcgaagcagacgcgacgaagagcgaacgcagagcagcacagaaaacggcacagataggaaaggagatagagcgagaagaggacaggagcgggagcaggccaggacggagagaaaaaagacacaagaaagagagagacatagagacgaagaagaggaacggtgagacgcagacgagatgagaggcgagatggagaggaggagagggtagatgagctgacgggggatggtcacgaaagaggcgagagtaagctaccacgatcaaccactggtacgaggctagaggatgaatagacagcagaagcagagcgagaaggcacaatagaagcagtagcaagcgatgggtaggtcgctttgccaggtcgtcggtgtgcg

SEQ ID NO: 631209 - DNA, 1008 bp, Homo sapiens
  misc_feature (15)..(15): n is a, c, g, or t
  misc_feature (19)..(19): n is a, c, g, or t
  misc_feature (32)..(32): n is a, c, g, or t
  misc_feature (34)..(35): n is a, c, g, or t
  misc_feature (47)..(47): n is a, c, g, or t
  misc_feature (51)..(52): n is a, c, g, or t
  misc_feature (60)..(61): n is a, c, g, or t
  misc_feature (72)..(75): n is a, c, g, or t
  misc_feature (82)..(82): n is a, c, g, or t
  misc_feature (97)..(97): n is a, c, g, or t
  misc_feature (141)..(141): n is a, c, g, or t
  misc_feature (163)..(163): n is a, c, g, or t
  misc_feature (738)..(738): n is a, c, g, or t
  misc_feature (804)..(804): n is a, c, g, or t
  misc_feature (807)..(807): n is a, c, g, or t
  misc_feature (825)..(825): n is a, c, g, or t
  misc_feature (836)..(836): n is a, c, g, or t
  misc_feature (867)..(867): n is a, c, g, or t
  misc_feature (934)..(934): n is a, c, g, or t
  misc_feature (943)..(943): n is a, c, g, or t
aagtgttacgtccgngtangatatgcgacagngnngggctctttcanaaanncttgatgnntgacacacccnnnntcctttngccgacccaagagtntgggagttgtagtaatcatcaagagaatttggggcttccaagtngttcgggccaaggacctgaganctgaagggttgactttacccatttgggtgggagtgttgagcatctgtccccctttagatctctgaagccacaaataggatgcttgggaagactcctatttgtggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattaccaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgaatttgtaacccnctgagaggacagagagaaataagtgccctctcccaccctcttcctactggtctctctatgcctctnctncagtctcgtctcttttancctggcccctntcccttgggctctgatgaaaaattgctgacntgtagctttggaagtttagctctgagaaccgtagatgatttcagtttctaggaaaatctaaaccgcnttgattacntagaactgaaatcatctacggttctcagagctaggaaaataaaacccgttgattactaaacaaaa

SEQ ID NO: 631210 - DNA, 871 bp, Homo sapiens
  misc_feature (15)..(15): n is a, c, g, or t
  misc_feature (19)..(19): n is a, c, g, or t
  misc_feature (32)..(32): n is a, c, g, or t
  misc_feature (34)..(35): n is a, c, g, or t
  misc_feature (47)..(47): n is a, c, g, or t
  misc_feature (51)..(52): n is a, c, g, or t
  misc_feature (60)..(61): n is a, c, g, or t
  misc_feature (72)..(75): n is a, c, g, or t
  misc_feature (82)..(82): n is a, c, g, or t
  misc_feature (97)..(97): n is a, c, g, or t
  misc_feature (141)..(141): n is a, c, g, or t
  misc_feature (163)..(163): n is a, c, g, or t
  misc_feature (601)..(601): n is a, c, g, or t
  misc_feature (667)..(667): n is a, c, g, or t
  misc_feature (670)..(670): n is a, c, g, or t
  misc_feature (688)..(688): n is a, c, g, or t
  misc_feature (699)..(699): n is a, c, g, or t
  misc_feature (730)..(730): n is a, c, g, or t
  misc_feature (797)..(797): n is a, c, g, or t
  misc_feature (806)..(806): n is a, c, g, or t
aagtgttacgtccgngtangatatgcgacagngnngggctctttcanaaanncttgatgnntgacacacccnnnntcctttngccgacccaagagtntgggagttgtagtaatcatcaagagaatttggggcttccaagtngttcgggccaaggacctgaganctgaagggttgactttacccattgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattaccaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgaatttgtaacccnctgagaggacagagagaaataagtgccctctcccaccctcttcctactggtctctctatgcctctnctncagtctcgtctcttttancctggcccctntcccttgggctctgatgaaaaattgctgacntgtagctttggaagtttagctctgagaaccgtagatgatttcagtttctaggaaaatctaaaccgcnttgattacntagaactgaaatcatctacggttctcagagctaggaaaataaaacccgttgattactaaacaaaa

SEQ ID NO: 631211 - DNA, 222 bp, Homo sapiens
caactctattgccttccatgccattccattcgattacattccatgcgattccattcgaaatcgaatcaattacattgcaatccattactattgagtccgttttattccagtccactgcattctggtccattccatttgattccattccattctattccattccatacagttgcattccattggattccattctatatctataaattcaattcgaggtcgacg

SEQ ID NO: 631212 - DNA, 284 bp, Homo sapiens
tacatagatagaaactgacattactcagatgaaggatgatgagaaaacggcaccagttgagagcagcagatggagaacatgcagcaatgacattgcacagtacaccccctgatagagggctcctatgccccccgcaggagagagttcatgcattgccaaatttgtagatggagaatggtaccgtgcccgcagtagagacagtcgagtctcctgccaaaatacatgtcttctacattgactacggcaaaagagaggtcctgccaatccacccgactgggtcccct

SEQ ID NO: 631213 - DNA, 1287 bp, Homo sapiens
gctcatcgccaggacgtcctcgtggaagtgacatcgtctttaacaccctgacgtggcacatccctgacgcaccgaccgatgatgcccagggaagacagggcgaactggacagtccacactacttccttctgctcatccaactatcggatgattactccgacatgtatcattgtagggagcagacaatgtggagcatccaagcagatgcagcagatcacgcatgtacatatcagcgggaaggctgtggagctgatgaggcaagaacaacatgatgcagcaagagaccatcacgacgggacacactgaaacaacacacacccagacacaggaagcaaccggccgccctcacactccagagggccaccgagccacctacgcagtacaccacacggacaggacctccacccgaacactcccacccaccactgacgaaagggacacaaaaacgagtgccaacaaatgacagacacagaaacaagagaagaacaacaggaaaccaaacgagacacgaccacaggacgacacaaaacaaaaacacaaacggatcaacagagaacaccaaacaaaagacacatcccagacacacacaaaacaggcaaatacaccagcacaacacaaccacaagaaaaaaaagcaccaaagagaaccaacaactcggaacctcccccaacccagcacagcagccagactgcacatcaaagacccgggaagaacaccaccacgaaaagaccaacgacagcaaaaccacacgaacaccccaacggacacaacaaaataatacaacaaatatcacaaagggcagacgagacaatccaaaaacaaagaaacgaaacaaggacacaacacaaaaaacaacaaaaacgaaaagaaaaaccacacacagagaaccaacgaaaaacaagagaacaagacaagagagcacagcaacagacaaacccaaagaaaagacaaaagaaagcaacacaacaaaagatagaccagaaaacacaaaaacaaccccaaagcggagaaacaaccaccgagacaagacataacaacaaaacataccacaaccaaaagccaaaaagaacagacacaagataggagacacaagaaaaagagaaagacacacagccaacaccgaacaacaccaacaacgtacaaacagcacaaaacaagtaacaaacaaacaaaccagcaacaaaaacgcagaagaacaaaaccacagacacacgagtcgaagcacgagacagacaaaaacacgacccaccacactaagcaacaccacgaacgaccaaacagataacc

SEQ ID NO: 631214 - DNA, 348 bp, Homo sapiens
ggacacagaaagtttactgaaaaatattgaattaatagatacactatcattagcatttaccccaacagacaaaaatcttttaataaaggctgaagatttttatttgtctttgggacgaccaattttcaatcctattaattttgaactttacaaaggagaaataatgtccattgaaggcaataacggatcagcgccaactacatcatgtatgacatgtgtcatttgcgagattgcatacacataggcgggatcaaaaaatttctggcatttctactttttcaatggattgtcacattatcttatttccatccttttaatgggtttgggggctaattttactcttaagtt

SEQ ID NO: 631215 - DNA, 463 bp, Homo sapiens
ctgggcaaaatacgcccacgtacggtccctgatcagaactttgccgcacacgctgctcccctgacggacgacgcagggacgcgccgacagcacgaacccgcgcgacgacgtgtagtgcgagcacgagcaccgcgcctcgccgtcgggacgtcgccgcagcacgcgcgcgtgagcgtccacgccgcacacggggcgcacgcaccgcgcgggccgtgctggctgcgcccatagcgcatgtggacgaggtcgtgagcgtgcacgcgcgccagacaagtgcacggccgcgagcttcacgacgtgtgcacctggcgcatccgacgcacccgcgggcgcacgcacgtcctggacggcgacgacggcccgcccccggtcgcagcccggagtgcgtgcccgggagtgggctgacctggcctgctgacgggcatgccgttgcatggtcggcccggcgtctgcccgcacccag

SEQ ID NO: 631216 - DNA, 1810 bp, Homo sapiens
  misc_feature (295)..(295): n is a, c, g, or t
  misc_feature (650)..(650): n is a, c, g, or t
atagactgtaaacacttcgaggcatatttcacctccgctaccataatcatcgctatcgaccactcgagacgatcagaggtatttagtctgctcatcgaccagcgactcgcatcggaagtcaagtatggaaatgagtcgtgcgtggcagtatgactcgtgaggcccatagtgcatatacatcatatatcatttatacaaccggtaaagttaggccatgtacatgaacaatagttattgtaggcaaaaccgtgcatcaccgtagcaccgagtcgatatcttagcggcgtaccaacgntacgctacgctcttgtataggcgtgcgagcgtatctcactcatggttccatagctcgaatgtaggtagtgcgtggtaattctgacacaatcgattagtgcatggtcattttcagttacgatcatggagtcttacggcacgtgagtttgcttcgagtgtcattatcaaacacactttatggacacaagacaatctcttagcggaccccagagagagtacgcgaatatattcaaaccataaatccaagataatatgcgacgtccgagagggtggtacccttccatataacttaatatacgtttactcacatctatatccatctctattatctatccgacagacccttatttacccangtattagttggcacccctgtacacgtgttttaccatacggtagaaaacattaaacacacaccggaagtgggccacgataagccagcgccaatccaattgaaagagaatctacttccccttcactgcaagatgcgttgcccaagagggcctccaattctcccacgtttttttccctccgttaaatctatgggctgaggtgttaaacctaattgcggaacgtgccacctccctatccacttggcacgtgctgtgcacgcaaacatgacaccattattccgccattgtcccggaccagctgccggccacaccagccacgttccctattaacaaataaaggttcacggcacagggaacaaccgcccgcgtgcggccaaataaaacaagtgcccgcttgagcaagtcttggggcagcgataaatacttgacggacttggacccccgcccccaaccacaataatcccaacgaaggcacttcttcggcacagaggaaaaaatcccccgggctgtcagttacccacttacactacacttcctagcgaaccgcacatatataacaggagcgaacgccgtacaatgtccggatacagactcctctctcaaaaaaggtcttggcgctcatatccgaagcgtcccaaaaagcccccgaatatggtgccccttctccctgtgccactttttcgctcacaacagcgcgacacgatgacgaagcaccgccatccgccaccatcacctccgcatctcctacatatcatcctcttccaagcaccaccgcattccatctacatccaactcaagaactactcctatccacctacatacatacataccaccccctacatctacttcttcccaccccccctcctctctctacatcacaaaactcgctccaactaaatactatctgcttactctctactaccatcctccacctccctccctctatatacaccccgtactcccaagccacaccatcactacccccactctcttgaacacgcctcctggcgcacctaccacccacaacccacccacaccaactactaccatccgcctcacaccaccacaacaacctctccgtacccaccacctctctcccaccctctcccacctaatcaccccccctcccaacctcacctcctacctaccacacacccgccaca

SEQ ID NO: 631217 - DNA, 384 bp, Homo sapiens
  misc_feature (10)..(10): n is a, c, g, or t
  misc_feature (268)..(268): n is a, c, g, or t
ccttttgaancccccaagattttctttccccctatcattgcctgagccctgctggagcatataattccctatcccattacccatccctcccttttcctttccttaaaaaaagtatttttggctgggcgcggtggctcacaccctggaatcccagcactttgggaggccaaggcgggcagatcacgcagtcaggagattgagaccatcctggccaacaagggtgaaaccccctctctactaaaaatacaaaaaatcagctgggcatggntgcatgcgcctgtagtcccagctacctggaaggctgaggaaggagaatcgcttgaacccgggaggcagaggttgcagtgagacgagatggcaccactgcactccagcctgggcgac

SEQ ID NO: 631218 - DNA, 328 bp, Homo sapiens
gcgtatataggaggctcggtgtacagaagaggaggggctgatgtaacatctgtcattcaggcggatgacactcccgtacgatgagaggccggcccctcccgcttctgacaggaccgtgaccgggactgtgagcgggagcgcagagagcggagctgggagcgagacaaggagcgagaacggcgacgctcccggctcctgggaccggcggaggggctcacggagtcggtataaggagaaactgccacatgaaaaacaccaaaatcaagcttattgtggcattgcgccgtacattccaagagttggaggaccctcaagatgcccctcctcc

SEQ ID NO: 631219 - DNA, 426 bp, Homo sapiens
ctgcggcttgtgctgacgctgtatgctcgcgcacgtcagctgtcgtgggaactaccctctgtagctgagaacggcttgtttattgctaccgagactctattgacattgcgcagcttcagcggcagcagcttcttacggtataaagctgatgcttgctgaagaggctacaagcatacttccgtaggactggtgtaagctttgagcctctagcaggggacatgccttgatgacggattctgcgccggcgtaatgcgagagccgcagaggagaaccgcagcaatcggagaattcaggcctcagaggcctacgagacccttatggacgcctctgtggtagcgagcacccgtgaagacgaactgagcggacccgagggagacccgagcactccagaggaggcctctaccaacgctgaaggcctcggccctg

SEQ ID NO: 631220 - DNA, 1422 bp, Homo sapiens
  misc_feature (491)..(491): n is a, c, g, or t
agcgggctgagctagcgcgttcaggcttggagaggttagtgtggcccgggtcgtccgctcctcgaagcggatgtggcaggccccgagccatggctctcgccgtccagagatcgtatattgtggcgctatgaaggctacaaagtaccgagtatcttcagcatcacagaatgaaagttatgatagatgaagttccaccagagctcggccgtggtacattcctgctggcgagtggaactcacccgatggcgcaccggcgtttcttctggaacgtggattggggtaagacccgaggaaatggttcgattcagcgtctacatggaaaggatagagtggcgaatgagctagcggtgagacaacagaaagagcaaatgctttcatgacatgtatgcgtcgagcccggcctagtctaacagcacggcacttgcgcctcagggagctgaactgacggctcccgtggaaagggtcaaggatgcttccgaaggggaactctnttgaaacgcaggacgtcctcacttctttcaaggctatgatctgccttctctaatgggagtaggagacacggtacctgaagaaatatggtcctctgttggggagcacctcttggggtacatttcttccgcctgaatagttatccttcggttgacccgttgcattgctttgtgggagcgtccacgcaagggatatggaaccgactcctcgcgggcttcctttgttggcacattcctagaagtcccgcgggaggaagattacgtcgtttgttgattcctagtttgattctttgcccacctggggagattctccaacaatcaatactcactaagacccttgcgtacaatgggtgcactcgggttgggatgtatcccattccaataattcttgccgtatgtagtcgattagccacccaatttgattctttcccgcccgaagttcttgttcaccccccattgggcgagattttctgtgcggggggggaacataactcttcgcaggcgcccttcaagcgtgccaatttcggcttttccttcgagaccgtggtggcgccaaggcccctgagacggaacgcaacgggccagttcaacgacggaatttggggaggtttgtggcgattttcctttggattttgttttggacagaaacggtttgtgggctaagaccccggttgcacaaccagactcttcggaccttagaaattatttcggcggaagttggcaactttgacaacccaaaacagaacacgcgtagacacgacactcgctacttccaaagctctgcgctgggagaattcgcgaggacgcaatcacacaggggcgcactgtggaagaacaccctgtattacgaacaagaaggggagtgagacgcacgagattaacaccacaaggagtttgtggttcccccctgtttacacctagacacgagagtcaa

SEQ ID NO: 631221 - DNA, 541 bp, Homo sapiens
gtaaagaaatcaatccaattaaaaatgggcaaaagatttcaagacacatttcaatgaagaggatttacatatggcaaacaaatggaaagttgtttaacatttctagctaatagggaaatgcaaattaagaccatgagatattataacacatttattagagaaccactaaaataaaaaatggtgacaacattaatgctggcaaagatgcagacaaactgatttctcatacattgcaagtggaaatgcaaaatggtttaaccactctggagaattgtttggaagtttcttaaaaattaaacatgcagctatcatatgatcaaactgttgaactactaggtatttattccagagaaatgaaaacttatgttcacacaaatacatatacacaaatgtccaaagcagctttatctgcaatagccaacaaccaaaaacaatcaaaattgtcatcagtaggtgaatggctaaacaaactatggtcatcagtatgctgaatggctaaacaaactgtggtacattcttactgtggaatattacttagcaa

SEQ ID NO: 631222 - DNA, 237 bp, Homo sapiens
catgaggatcccgagagacacgggggattactgcctgccatcttagcactttgagaggccaagacggacagatcacttgaggtcaggaatttgaaaccagcctgaccaacatggtgaaaccccatctctactaaaaatacaaaaaaaaaagttagccaggcttggtggcaggtgcctgtaatcccagctactaggtaggctgaggcaggaaaactgcttgacgggtacctgagctcg

SEQ ID NO: 631223 - DNA, 174 bp, Homo sapiens
tggataaatctggctagattatttgtcacagaaataagttcgttatggaatgtagcataaaaattgtaaatgcccaaaataagaaagttaacagaaaaaaacacaaatgcctagtgatacatgtgtatattcctacaaatatcgcaagcacacattctgaaggttgatttagca

SEQ ID NO: 631224 - DNA, 413 bp, Homo sapiens
aaaattggtagcgataggcggctgggccgagtgggtgtctaggtgccggcgttatgggctacgggatgttgtttggcgacttgtgcttcaagcggtgtcttgctttttggggcagagttttcatcggaggcatgcagagagttaggcttttctcagcaacttgcttttgcagctcttgtgatcttctcggcacagttcaacctgcgttccagctggatcctgatttgcagaggatgcttgtccaggcaggaagccacaatttgagaagccgaaaaaatgctggtattgcacgtgaagcctcatttctttggcaccgtccttggtgggcttgcacaaatttcgcgggaacgctggttcccctttcaaagttcccaaaggtattgttccgggtgggttcacaaacccctggtatc

SEQ ID NO: 631225 - DNA, 209 bp, Homo sapiens
ggaacccaaccggtgtgcgggacagagccagatcctgtgtctccacaaatcctcaaaccaatccgggtgtgttagcacccacacctgtgcccagatacttgcgaggttgtaacgacaggatttgatgatcgcacgagtctgaggccaccatgtctcatgttgacgccgctgcagtccatgattggcagacgacttagatgcttttacga

SEQ ID NO: 631226 - DNA, 1415 bp, Homo sapiens
ccccctccgcgcgcgtggtcgactatagggggtgtatctgtgctttcggtccggtgtttctgcttgctgtcgcctagttgtcgtggatcgcgttggtactgcgaacggtgtttttgtctttggtctgttgttcgggtggtgctgtctcttcagttgcgtgttgctgctgtttgctgctcccttggtggcttgtggtcttgtgtctcacggtcgtgtccgctgtttgtgtgcctttgtttgcagctctcatgctcttgtgttggcttttgttgtcgtgtatgtgtctctgtgccgcttggtgtgcttgcccttctgtttgtcctaggtgttttagtggtcgtgatagattttgtttgggtggcgctggtacccaccgggcacaccgttgtggcctgtggccccattgtgtgtccccatccggttggtggccccgtattggggttgtccgctgcgctggggtgatgtgtggtcgtctgtggatattctctgttgagatattttttatgctctctatggtggggagtatacttgttggccccccccttcttgtggggttgtcaatgtgtggggccccacttgggtactttaataagggagtcccacaaatgagtgttgaaaatagttgataatcccaaataagtgtttgaatgtggtttttccttgaaccttttcctcccgttgtaaccacattcaccggtatgtgactataaaagagatatatatgtggaaacctgccccccggtatggatggaaactgtggggaaaaatttataagtgcctggcttgacccatagtgttaatttttcacactttaataatcgtttttgttaataggctttcatcccaggccacactgttcttgttaaaattgtggggttcactctaatgaaagattccccacgctatctttgggcacgcctcactaggttggtaggaccccacaatttggtgtccacgggcgctcgttttgggcttgggacactggttagaagccacccacaatacccctcttttatgagggagccccccccccatttcatctcgagtattgagaccaccacgtgttccgaggtgcacgttcacgaggcacttcacgaggccacgtagccactgggcacaataccacatgtggtatgactctcttggagagaatgttccccgggccacaatgttcacacagaataagaaaagcttgtgtaatatactatatgtgttatcttggctcttgaaaacttattgagctttaatgcgttttcccacgccctccgaatcacctgactggggccttttgtgtcccccgcaactgactggccgcactgcgcatatcctgcacgtatcccctttacccatatttaaagccaaatttttaattttctaaaccgaattaaactgttccataaaaaatgctcgtccca

SEQ ID NO: 631227 - DNA, 255 bp, Homo sapiens
tgggccagtacgattggactagcagcttgtgctctgtgagcacagcagcagcagtgtgatagccagctcagtgcccatgctctgcagcagctgaggaagctggaccagtgaggggcaggtgtatggtgcctgcgctgaagttctacgaggctgttcccaagggccagtgtatcagagctgacaggcacggtgcattgggcctgctgagcgccgtggagctggcgttcagtgtgaactggggggcagagctgtgca

SEQ ID NO: 631228 - DNA, 436 bp, Homo sapiens
ggcgggcgacttagaggatcccagctccaacaagagaaggtacacaattacaatgacacttcagttgaatgtacacttcacgtctcttcagtggaagtgtcctaaatggatcaccttggatatctggttggctgaaactgagtagataatatttattattcctcacacccacgtggtgtaataatttgcctaagtctctggtatccactcgtttagccttccaaaatttcttcatccattcatggcaccaaaggataatatattagcctcaataaaaatatcatcaattatcaatttggacatacttctacaaagtaaaactgctacaagcgttagatattaatatgttttacattcacaaatcactccaatattcatggaaaatgaccactttaggagttaattagaattccacatacttttggtttctataata

SEQ ID NO: 631229 - DNA, 119 bp, Homo sapiens
agagacagcaagagaatgaagcatgagactgttggccctgggccgagaagaaggctgttggcaaagtgggactgtccaacgaagagaccacctgtccttcgagcagtgagcaccttcag

SEQ ID NO: 631230 - DNA, 178 bp, Homo sapiens
tcgagccggtaccgtgaacgatgtagcgagcgtgatgagggattcattgcgggttgcgagcaggatctggcggtgaaaattctggtcggctgcgcgtcctccatcgtctggagtccgcagcgccgcatttcctcgagcgcatgacccatgcgtgaaatgtcctgcgtatcacggcgca

SEQ ID NO: 631231 - DNA, 316 bp, Homo sapiens
aaggtcaggatcgtagagaagatatcatcagatagatgtgttgcgaactcgatgagctagggatagagcggatgagatactacattgggtgtgacttaaagtaagacgagaatacaagacatataaacagcagaatatcatcaggcagggcatatcacagtaggatcgaaatagccttggagtagccactaaaggctagaaagtgtcatagtggtagataggctccctgaaagaaactgtatgcggaatatgagaagaagagaaaattgggcctcgcctaataaggctgggcatcactgatgggaggaagactgcg

SEQ ID NO: 631232 - DNA, 559 bp, Homo sapiens
ttaagcctgaggcagagcatggcccacaaggaaagtggagtctgtgtcatgggccaagtcttactcctcaaaacagtgtgatgactctgtatggagagctctgtgtgaatactgaagctccatagctgatagctgtcggtgtaagcctactgtcactgtctaaaaataaccatcactgtctaaaaataccgtcactgtctaaaaataccatcactgtatcgatagctgtctgtaaatactggaactctgtggagcacgctctgtaaatactggaactctattgctagctgtaaacggtgtaactcagtataactataccgtaactctaaaaataccataactatgtgtcgacagctgcctataaatgctataactgtattggtagctatgtataagcagcctactctgtatcaatagctgtctgttagaaagctgacatcacattgttgatctaaagcaagcttgtccaacctgcggcccgtgggccacatgcagcccgggacggctttgaatgctgcccaacaccaattcataaactttcttaaaatgttaaaaaaac

SEQ ID NO: 631233 - DNA, 174 bp, Homo sapiens
aaaaaaaaaaattttttttccctttttttttgggggggggggggggggccccccctttttttttggggggggctttgccccccaaaattttttaaaaggtttttttttcccggtttttttgtttttttttttttttttgggggaaaaaaatggtgggggcccccccccccccca

SEQ ID NO: 631234 - DNA, 510 bp, Homo sapiens
  misc_feature (174)..(174): n is a, c, g, or t
atcgtctcccgtggctgggcccaactggtccaggtatggaacccggctaactccaaacttaagaccaaccccttggccccacaggctatttgaacacgggggctgtctctcccaatggatccctctgtgcttttggaggccaggatggcccggccctgttatggggtttccacnaaggccaaccccctttccccctaaatggtgggggcatcatcaaccccctgtggttcaaccccaacccctactggctgtgttgtgcccccggcccccacctccaaatttggggttttaaagggaaggtcccttgttaatgaacttaagccaaaagttttcaggtcccccagcaaggcagaaccccccccgggcccccccccggcctggtttgtttatggcccaactctgttttctggccacccggaccacctggggcgagtgtggccggtggcccttggccccccctaaaagtttttggccgagcctttccaataaaaaaaaaaccggcttttttta

SEQ ID NO: 631235 - DNA, 100 bp, Homo sapiens
aacctgatccacatacccaggcatacctcatgtcaacattcgcagcaaacgcatattgctgccggtccagaactagtacaacgtagttgtatttgattgg

SEQ ID NO: 631236 - DNA, 158 bp, Homo sapiens
  misc_feature (34)..(34): n is a, c, g, or t
ttgaggaccaggagattcacactttctgtgtatnagtaagcattgatttattctggttcttctgtactgaacgtgtggttaacttataattactcccataatgaattatccaatgttctgaaataatcgaatatcttcaaagactatgatctccaaca

SEQ ID NO: 631237 - DNA, 531 bp, Homo sapiens
acaaatggggtaactcttataaaaaccatcaggtctcatgagtcattcactactgtaaaaacagtatgggaaaaaccactgccctgattcaattatctcccactgggtccctcccacaacacatgggaattatgggagctataattcaaaatgagatttggccgaagacacagccaaaccctatcattccacccctggttcttcccaaatctcatgtcctcacatttcaaaacaaattatgccttcccaacagtcccccaaagtcttaactcatttcaggttgaactcacaagtccacagtcaagtctcattgagagaaagtaagtcccttccacctatgagccagtaaaatcaaaagcaagttagttatttcctagacacaatgggggtgcaggcattgggtaaatacacccataccaagtaagagaaattggccaaaacaaggaagttagaggccccatgcaaggccaaaattcagcaaggcagtcaaatcttaaagctccaaaatgatgtcctttgactccatgtctc

SEQ ID NO: 631238 - DNA, 621 bp, Homo sapiens
tttctggtatcgtatatagatttcttcactgggctttttcttcagcttcctcatcatcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 631239 - DNA, 514 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggagaatatgagcggggtcccgagctcga

SEQ ID NO: 631240 - DNA, 583 bp, Homo sapiens
ccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggagttcagaagatcacctcagtgcatattagtgacagcacttagtagctgtggaggaatatcactgaggggatcttctgaacatcctctgatcttcg

SEQ ID NO: 631241 - DNA, 819 bp, Homo sapiens
gcatggggtgggggattccatcaaaactgttgtttatgccccatgatttttctttggtcagtaggaggctggatggagtggtgattattcccctggagctaagctcaggagcccgaagggagagactgagactgactcccttatctcttcatattctttattccctaccagatggattgtttattttttgtttttgggagacgggagtctcgccctggtcggccgaggctggagtgtaggtgggcatgatctcgactcactgggaaaatcttgcctcccgggttcaagcgattctcctacctcagcctcccgagtaagctgggattacaggcatgtgccaccacgccaagctaattatgggtactacttacacgtaagagagggggattaacaccatgtgggccaggagggatcatcagaatctctggaccctcgcggaaactggccggcactgaggacctcccaaagtgccggggataacaggcgtgacgccaccagtgcccaggaccccaagagtggcattctcacatttgggactactaacggaggtaacccgcgtccacacaggaggtagtccatcaccgtacgccacacagggaggggagggcacattctggaactctggatactgaaatctgtaccaagccacgaaattaggcgggaaataatatcccatagatcgggacaaccgaagcgcaacatggaggaccattctgtacaaccgtgtcccctccgcaaaattccgaaggatcagaaaacacccccgatatcgggcatgacatacagtcccataaccgggggagaagaagctccatggag

SEQ ID NO: 631242 - DNA, 779 bp, Homo sapiens
  misc_feature (27)..(27): n is a, c, g, or t
  misc_feature (69)..(69): n is a, c, g, or t
  misc_feature (87)..(91): n is a, c, g, or t
  misc_feature (93)..(94): n is a, c, g, or t
  misc_feature (192)..(192): n is a, c, g, or t
  misc_feature (237)..(237): n is a, c, g, or t
  misc_feature (307)..(307): n is a, c, g, or t
  misc_feature (340)..(340): n is a, c, g, or t
  misc_feature (343)..(343): n is a, c, g, or t
  misc_feature (346)..(346): n is a, c, g, or t
  misc_feature (350)..(350): n is a, c, g, or t
  misc_feature (352)..(352): n is a, c, g, or t
  misc_feature (368)..(368): n is a, c, g, or t
  misc_feature (370)..(370): n is a, c, g, or t
  misc_feature (377)..(377): n is a, c, g, or t
  misc_feature (385)..(385): n is a, c, g, or t
  misc_feature (393)..(394): n is a, c, g, or t
  misc_feature (400)..(400): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (473)..(473): n is a, c, g, or t
  misc_feature (479)..(479): n is a, c, g, or t
  misc_feature (520)..(520): n is a, c, g, or t
  misc_feature (552)..(552): n is a, c, g, or t
  misc_feature (618)..(618): n is a, c, g, or t
  misc_feature (691)..(691): n is a, c, g, or t
  misc_feature (753)..(753): n is a, c, g, or t
atatccggtgccacctcctcaaaagantactgcagattagacaggcagactgcaaagaacaaagaaagnaaataaaggaattaaaannnnntnnttttttttgagacagagtctcactttgttgcccaggctggagcacagtggcgtgatctcagctcgctgcaacctctgcctcctgtgttcaagcaattntcctgaggaggcagaggttgcagtgagctgagatcttgccatcanactccagcctggaggacaagagcaaactctgtctcaaaaaaaaaaaaaaaaagttgtcagcttaaaaaanaccttcaaagagagctttcttatgctctaaaanctntcncttnantttaaaactgtctgcngngtttgangggaaganagataatnngcaaanttacctcgcaatataaggatttgagctggactcctgggattaaagantgtggtttngntcaaaaaaaaaaaanactgcngatgtgaggtaatatggtttttttagttaaaagaggtgttnggaatgtatgcccactcacatttaataaaagnttatgtagcacacaactctgcagcataataccaacaacaggagtgttttaaagcaggatggagaanaaagtagacaatacaacttaaggtttcctttgtcctttcccctgttttcaccatgagaattcagctgaaaaanaactctccagaatgcccacccatattgtcctttgacccaccacattccaaacttctgacttntgatcccaagctcttggagccttagc

SEQ ID NO: 631243 - DNA, 1512 bp, Homo sapiens
caggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgcgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtgtgtgcgcgcatgtgtgcgtgcgtgcacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatgtata

SEQ ID NO: 631244 - DNA, 275 bp, Homo sapiens
aaatccagatcaaatctactcaagggcaaaatgtcatccccaacaacaatgcaattcggttcagagctatgttgaccactttcctataaatggccttgaagccagtgttatctactgtcagagctatagtaacactttctgctgtgtatttccacatctctaagcaaaaggggaactatgcctggtcaatataaaagttgtatctatgaattccagtgggcgtcatgtagatgtaaagcactggttctcatggcgggggtggggcaatttccctc

SEQ ID NO: 631245 - DNA, 1724 bp, Homo sapiens
caggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgcgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtgtgtgcgcgcatgtgtgcgtgcgtgcacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatgtatatatgggtactatataagggctggcaccctgcctctctgtgcccaggcccagccctggagacatggccccggtcagcagtgctgtcactgtaagcatggactcccagtagacagtgtgggaatcgctcctgctttaactccccgagaaacggctcttcgtgcctgggggcaggagggcaggggcctccaccgtttttttctgttactgcacaa

SEQ ID NO: 631246 - DNA, 949 bp, Homo sapiens
tacggccggacgggagttccccgaaagaagtgatcctgcagcccgagtcccgtcctcaggcttccccaatccaggggactcggccgccgggacgctgctatggacgacattttcactcagtgccgggagggcaacgcagtcgccgttcgcctgtggctggacaacacggagaacgacctcaaccagggggacgatcatggctttctcccccttgcactgggccttgcctgagagggccgctctgctgatggtctgagatgtagatcatgcatgggggcacggactcaatgtaatgaaaccgtggggattgacaagccccactgacacttcttggcagccaggtcaatgggaacaaccgtgcatacttgtacagacagctattgcagtacacaggcacagacatcatatgcagtgcaatgaacatgggaattgttgccccttgcgcatagtgcctgtctaatatgagggccaagcatcaacgtggcaagaaggaccctggtgtgcacacactggagggcccctatggtcaacgcactcgtgtaacacaacgtattggagaagactgcctgttgggaacacaagccaaacggcaccccgtgaagcagacgcattcttcacgaagacgcaggagcgcagagacagactggggccacagaatcctcaggccggtattaccagtacacgggcacagcatttcttggaaagggggaccaacgcatgcacatcgagccccggaacatggaacccttgagccagacagtctgggccgttcgaccttgcaaacgcagccttcacactttccttgacgaaagcctccaagcgagaaaatcacgtctgagaccagcctaatgcgcaagggccgcctggcccagggccagggcacattggtccgtgcacggtgcctgaagggttccgccaactgggacgttcacaggcacgacgcacggac

SEQ ID NO: 631247 - DNA, 849 bp, Homo sapiens
ggcgcccacggcctgtgaccccggcgagcggctcgccagatgacgagagagcggggccgggcgctgctccggcctgacctgcgaagggacctcggtccagtcccctgttgcgccgcgcccccgtccgtccgtgcgcgggccagtcaggggccacgtgtctcgatgcggtctaggtctgcagacctacgatggtcgcccgcacatgccggccgtgtgtgcgctgggagctgcctggctgcgggccgggtggggatgcctctgcgacgtgaagtggccgttccccgcaggtgccgcgctcacctggaccctggtcagcagcggtcgtcatgggcttggtgggcacctacagctgcgttctggaccaagtacatgaaccacctgaccgtgcacaacagggaggtgctgtacgagctcatcgagaagcgaggcccgggcacgcccctcatcaccgtgtccaatcaccagtcctgcatggacgagcctcatctctgggggatcctgaaactccgccacatctggaacctgaagttgatgcgttggacccctgcaagcttgcagacatctgcttcaccaaggagctacatcccactttcttcaggcttgggcaagtgtgtgcctgtgtgccgaggagcagaattttccacgcagagcaatgaggggaaaggtgtctagacacaggcaggcacatgcccaggttgctgcgcaaaccggaagcagagcaaacgaccatggcgctctaccggaacgggggatcgaccacccaagcgacgacgcataacaaggggccacagaacacgtatgataccccaagcggacgagccaacccgtacgagtccgcccgcctgccgg

SEQ ID NO: 631248 - DNA, 324 bp, Homo sapiens
ttaacaatcactggcatattattacccaaaatctataatgtacgttagtggccactctttctgttgtacattttatgtgtttcagcagatgtataatgtcatgtatccatcattacagtattagacagaatagtttcactgccctatatggtcccctgtgctccaccaactctattcctccccaccacaatctcttggcagctgctgatctttttactgactccactagttttgccttttccagaatgtcatatagttggagtcagacagtatgtggccttgtcagactggcttctttcacttagcaatatgaatgtaaggttt

SEQ ID NO: 631249 - DNA, 333 bp, Homo sapiens
agtacaagtcgattgctattggctctcagccacgctcactgttgggaaacccacatatccaaatgacgatacaatcataaagagttcttagtgtcttacgttcgtggggtgtcggtggtggaatatgaatctgctatggcaactgtcataatacctgaggacaggtagtgggaaaacctcgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaa

SEQ ID NO: 631250 - DNA, 465 bp, Homo sapiens
tttccaattcctaaagcccgccgcaaaaacaaagggaagttagggcagtttagtggctttaccttgtggggcgagcccatcaccccaccccgcaatttcgcaaaagccaagaaaaagcccccggaaaccaccttgtgccccaaattatggatttattgtacaaaaatcattttcccattttgggggggggtcaccccgcaccctttaggccccctttttacggggaaaatggacccttgggggattttttttttttttttttaataaatcaaaaacagggtccattcccccagggtttttttttgcctgcaccttcggtgatttttaacaggattttggggccaaggtttcagtttagggcaacggcaggccagtttttggttttccacccgtgtttggcctcaggggtggcaaccggtttttggggcaacccatttgttttttttaataaaggtcaaagttgga

SEQ ID NO: 631251 - DNA, 402 bp, Homo sapiens
acagacagtacagtcctatccttcctatgccacaaccggttgtctcgcctccttttttaaggaagtggtgaggagatggtattctgaaaagcccagtatcagcatgacttgtggcttctttttggatttgtttgccatacctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctcttaggatctacagttaaagcc

SEQ ID NO: 631252 - DNA, 405 bp, Homo sapiens
tacgtaacccttccccagtttttttttatactttaaaccccgctcctcattgcctggcgcttactgaagctgcttcctcttataaaatagctttggccgaaacatcgtttttttttagcagatcccaaaatataatgaaggggagggtgggatattggtgtctgtgtgcttataatatattcattcattcttcctgggttctcagaaaaatcagcataaatatatttttttccaggcaaatcagtgtggtgtatccagttggcatgtggctgggtggttgagtgagtgaatttccatgtggcggggtgggttttggcctttaactctgtgccttgttcttggtgccttctgatggggctggcaatatggagggggatggttctaccctttctggcttctgtaggg

SEQ ID NO: 631253 - DNA, 182 bp, Homo sapiens
ggcttgttcaaagttcattggtagggaaacgcccatcacgttaattggttgtgaacaggaattagtgagttaacccgccaaatccaaagaacaatttcaagtccgttaggcatacatcaccggtatttgaaccaccaagttccaccctagtaggtagtcgtccatcatcatgtcagtctttg

SEQ ID NO: 631254 - DNA, 730 bp, Homo sapiens
  misc_feature (5)..(5): n is a, c, g, or t
  misc_feature (83)..(83): n is a, c, g, or t
  misc_feature (119)..(119): n is a, c, g, or t
  misc_feature (166)..(166): n is a, c, g, or t
  misc_feature (168)..(168): n is a, c, g, or t
  misc_feature (170)..(170): n is a, c, g, or t
  misc_feature (175)..(175): n is a, c, g, or t
  misc_feature (179)..(179): n is a, c, g, or t
  misc_feature (200)..(202): n is a, c, g, or t
  misc_feature (204)..(204): n is a, c, g, or t
  misc_feature (208)..(208): n is a, c, g, or t
  misc_feature (222)..(222): n is a, c, g, or t
  misc_feature (224)..(225): n is a, c, g, or t
  misc_feature (231)..(231): n is a, c, g, or t
  misc_feature (239)..(239): n is a, c, g, or t
  misc_feature (252)..(252): n is a, c, g, or t
  misc_feature (268)..(269): n is a, c, g, or t
  misc_feature (294)..(294): n is a, c, g, or t
  misc_feature (299)..(300): n is a, c, g, or t
  misc_feature (304)..(304): n is a, c, g, or t
  misc_feature (308)..(308): n is a, c, g, or t
  misc_feature (312)..(312): n is a, c, g, or t
  misc_feature (317)..(317): n is a, c, g, or t
  misc_feature (374)..(374): n is a, c, g, or t
  misc_feature (412)..(412): n is a, c, g, or t
  misc_feature (461)..(461): n is a, c, g, or t
  misc_feature (513)..(513): n is a, c, g, or t
  misc_feature (663)..(663): n is a, c, g, or t
  misc_feature (685)..(685): n is a, c, g, or t
aatanactgattaaggattcatggaacaaacatatataaacaaaggccaataatattccaccccatgcagaatcctatcaaancaatccattaattaattaaagcaataaaaaaaaaanatccacctcaaaaaagcaacaaatccaaccaaaaaaaaataaaaaanantntacantaanctcaaccatgcactgaaaaannnantaantaaaaactttttananntcagtntcaaacangttatccttatcnccatcaaggcaatccnntcactctcatgaagcagtcaaatantcaannccancccncttnagcanccacacaaaacacacacggaaaccaatcacacaaaatccatcccgtaatcccactcnccaggccccacactctcgctgaatacagacctcctccnttactgtccagaactctcccgcttcactgtccagaaactggaagcagantccaaataagaatcccatagcttgattccactctcaccaaaagctgactccntttttcttaggaatgtctatagccttgggaggtaaaaataaaataaaataaaatcaatgggtgtaaagttcatagcatcatccattgattttatgaactttacacccagtctggaattccaaaaatattcctccattgctcaggagtgtngctgaatcctacccagccaggnttgctgtactgcagggaatgaatgtccagatctatggatcgccag

SEQ ID NO: 631255 - DNA, 339 bp, Homo sapiens
gcttaaaaacaagtgtgagcccaaaacaagcccatgttattctcccacagggtcctctataaaaggggtgggtgtctgtttggccaggatgttaaaaagtccttataagacgcatgctcagtgttgccaaaaggtttttagaaagtatgccaaaaatgttgttttggctatgaggggaccataaaaaagccagcccccttttaaagggttttttttgtccggggttaagggttttaaaaaaaaaaaaccctgttttttgcctagttaaaaaagggttttaaaaagggttttgaagccaattaggttatgtttttgggccaaaaaaccccccttgcccta

SEQ ID NO: 631256 - DNA, 727 bp, Homo sapiens
caagacatggatgtgccccagctggtgtgccctccgagttcattcgtgagatctagacttgctcagccctagtcagagcttccgtgtatcgagcctagaagcgacagcaggttgccttcggtgatcatcgcgacaagtgacggggtatcacagcatctcaacccttgtaccagccttgctcatgctacagagcaacgaccacagaaggaaccaatgatcagattcaggcagagcaatctctttaagatacagaccagactacagcatcatcatcccgttcctgctgcgtctcagcgcgtcaagtatttcaggctgggacaagcaaacctttacatagcacgggaatcaatgtaaatgcagctccattccaatccatgcaaacggtgttcaatatgaatgcccccgagttcctccgtgtcgagagtgaaccagaaactttaagagcgagcaaaatcagtaccaggccagttataaccgagagcttgggctagtcagccgtcaccaagtagaacaaacagagcttcagcaagaacagcttcaaacagtggtcggcacttaccatggttcccctagaccagtcccatcaagtgactggtaaccaccagcagctcctcagcagaacactggatttccacgtagcaatcagccctattacatagtcgtggagtgtctcgtggaggctcccgtggagctagaggctgatgaatggatacggggcctgcaatgc

SEQ ID NO: 631257 - DNA, 85 bp, Homo sapiens
gggtccaccttactacctcttccttcgtggcgggctcaactgaaagatgtggggttctaaggacaggcttcccgctggggaagga

SEQ ID NO: 631258 - DNA, 85 bp, Homo sapiens
aattcggaacgagggtacgctcccagcgccgtgaggttggcccagagctgccaggaccatgaagccaggacagaggccaggagcc

SEQ ID NO: 631259 - DNA, 170 bp, Homo sapiens
  misc_feature (11)..(11): n is a, c, g, or t
  misc_feature (151)..(151): n is a, c, g, or t
  misc_feature (166)..(166): n is a, c, g, or t
tttaaggccanagagggtcaaggaaatttacctgttcgaggcacaattcctgatatgattgcagttttatatatttgcctgaatctgcaatcatatcaggaattgtgcctcgaacaggtaaattccctgaataatgattgcagattcaggnaatatatataactcnatga

SEQ ID NO: 631260 - DNA, 211 bp, Homo sapiens
atcagctactgaataggtgaatattcctgacagagaatgctatctaaccatagttcacgttagggggaagcattttccatcagtttctttaaacttggattgtccggtgagttttgatattaaaccttctgtagctaagtttataatatagcattacttaataattaatcaatctatatacacaggcccatacttcagacagtccaatcat

SEQ ID NO: 631261 - DNA, 92 bp, Homo sapiens
gtcagtcgcttcgcctgttcattccgctcacatttatctagcacccattctgtgccaagcattgtctctacctcagtttgccacaaatatga

SEQ ID NO: 631262 - DNA, 395 bp, Homo sapiens
  misc_feature (391)..(391): n is a, c, g, or t
ttagaacccttgcactgggtttcaactttccccttgaaccctagtgatcttcgtttttatcccatattcccatattgtatttctgttattgtagccctggttaagaaccatgttggccgggcccagtggctcatgcctgtaattctagcactttgggaggatgaggcgggcagatcgcctgaggtcaggagtttcataccagcctagccaacatggtgaaaccctgtctctactgaaaatacaaaattagccaagcatggtgcgtgcgccgttaatcccagccactcaggagtctgagacaggaaaatcacttgaacctgggaggctgcaataagccgagatcacgccattgcactccagcgtgagcaacaagacggaaactccatccatnatat

SEQ ID NO: 631263 - DNA, 279 bp, Homo sapiens
cccccttttttttccccccaggtttgggcccccccccccccccctttttggggggggggtttttttttttgggggttttaaatttcccccctggggccccccccttttttaggtccaagggggggggggggtttttgggcccttccccttttccccccccaaaattgggggcccccccctctttttttgttttgggacttgggggggggaaggaaatgtggtttttttttttttcccctttcccggggggaaaaaaaaaggaggggggttcgcccccca

SEQ ID NO: 631264 - DNA, 184 bp, Homo sapiens
aggctatccactcctcctactttgactggggctggcattgccctcaacgaccactttgtcaagctcatttcctggtatgacaacgaatttgtgctacagcaacagggtgtgtgtgacctcatgtgcccacattgcctccaaggagtaagacccctgtgaccaccatgccccagcaatgagcaca

SEQ ID NO: 631265 - DNA, 374 bp, Homo sapiens
  misc_feature (40)..(40): n is a, c, g, or t
caatgtttttcctttttttggggcggtttgcatttggttncttcactcccttccctgtcatcggatttttttttaggttctgtagccagagtgtatgtgttttacgcgctctggctttttttgcgcttcttacttaatggatgttttacagttcggtatcagaccaggccagctggttgctgtcgcttggaggcagcccatccatgaggttctgggcttgccccagatctgccagctcatcacctgttttgtcggcatcggggtgttggccagccttgctcgtgttccatcgtgagatagatagacagagagtgatagacatatagagagagagagagagacacagtgagtgagatagtgagagagatagagag

SEQ ID NO: 631266 - DNA, 208 bp, Homo sapiens
aggtctgatctagcaggatcccctttccaaacgcggcagatcggaggacatgaccacaggtacagaatcagaaaccaatgggccttcatggctgtgtgcattgacgaccagccaagcgctacaatctggatgactacctggacccctggtgttcatccttccgagcaggctcttgcagccatccatttatccttgcaggagcaatgca

SEQ ID NO: 631267 - DNA, 185 bp, Homo sapiens
  misc_feature (48)..(48): n is a, c, g, or t
gtgatttctaagatgtcaagagaggctacatcacagcttttcttgctnaggctaccaagatcttgtatcctcaccaagctagtcttcagataagtgagcatgcagagtatagtctgaaatgttttgaagtggcacagtgcaccgcaaagacccaagatgtcagatatctaaaagaagttaaagga

SEQ ID NO: 631268 - DNA, 565 bp, Homo sapiens
tgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagtt

SEQ ID NO: 631269 - DNA, 132 bp, Homo sapiens
  misc_feature (109)..(109): n is a, c, g, or t
cttggaccacaaccgagcaaaatctcaaattgctcttaaactcggtgtaaccgcttgatgatgtaaagaatgtcattatctggggaaatcattcatccgacccagtatncaggatgtcaatccttgccaagg

SEQ ID NO: 631270 - DNA, 405 bp, Homo sapiens
caagattccattccttggaatctgtgaggccaagaaccccaggttagagaacctgaggcttgccaccatcttagaagcggcttgccaccatcttggaagtggctcgccaccattttggcaaccaggaagggacctccaaagcggctcatcaaaaactcagaagaatgaaattatttgcctcttatctacctatgacctggaagccccctccccacttcaagttgtctgacctttctggactgaaccaatgtacatcttgcatgtattgatcgatgtcttatgcttccctaaaatgtataaaccaggtgtgccccagccaccttggacacttgtgagaagctcctgaagctgtgtcacagggacgcacccttaactttggcaaaataaagttcccaaattgactaa

SEQ ID NO: 631271 - DNA, 196 bp, Homo sapiens
ggagatctcatagaggatccccgtatctaaaaaatgcctaaaatataaatatacaccttaaataaattattatactgtgaacactcactgtatcactactcagatcaagaaatagttgctggtatctctagcaagcccatagtcctcttcccaagttacaatcctaccttttcccctgccataaaattgtgcagcg

SEQ ID NO: 631272 - DNA, 770 bp, Homo sapiens
tgccctcatttacataaatatatactagcatttaccatctcacttctaggaatactagtatatcgtcacacctaaatatcctccctaattatgcctagaaggaataatactatcgctgtccataatagctactctcaataactctcaaaacccattccctcttagccaatatggtgcctatggccatactagtcttggccgcctggaaagcagcggtggccctacgccttaatagtctcaattctccaacaaaatatggcctaagaacttactgtacaataaaccctaaaatcctactcccatgtggctaaacacttaattcggtcccaaaaaattattattaactaaccaagtggacaattgacttttcccaaaaaaacacgcaccattattctggaatcaaacaaaaaacaaccccaacaaggctctaaaataataaggcattcatccctcttattaatttttaaacccaattcaaacaaccaaaactaattaaggttggtacccccaaatcttttttcctgccggactccccatataaaaaaaccccgctttccttaatatactaaactaacgttggatatcttaacccctttcaagatgtcagtggaaaggcaaacggccactttttattccgggtgaacccattaattactggagaacaacaaccatacagtgacacaccaatattgtgtggggcgccatcgccccaaaacagttttcaaacacaatgtgttggcgggcggcccatagcagtagactggcaaact

SEQ ID NO: 631273 - DNA, 1019 bp, Homo sapiens
  misc_feature (210)..(210): n is a, c, g, or t
  misc_feature (309)..(309): n is a, c, g, or t
  misc_feature (328)..(328): n is a, c, g, or t
  misc_feature (396)..(396): n is a, c, g, or t
  misc_feature (399)..(399): n is a, c, g, or t
  misc_feature (408)..(408): n is a, c, g, or t
  misc_feature (468)..(468): n is a, c, g, or t
  misc_feature (539)..(539): n is a, c, g, or t
  misc_feature (542)..(542): n is a, c, g, or t
  misc_feature (545)..(545): n is a, c, g, or t
  misc_feature (548)..(548): n is a, c, g, or t
  misc_feature (582)..(583): n is a, c, g, or t
  misc_feature (671)..(671): n is a, c, g, or t
gctgttactggtccgacattcgcggtactgcagagaagacaacgtgcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgtncagctgtacctggcgctgccccctggagctgagcactggaccaaggagcattgtggggctgtgtgcttcgtgaaggataacccccagaagtcctacttnatccgcctttacggccttnaggctggtcggctgctctgggaacaggagctgtactcacagcttgtctactccacccccacccccttnttncacaccttngctggagatgactgccaagcggggctgaactttgcagacgaggacgaggcccaggccttncgggccctcgtgcaggagaagatacaaaaaaggaatcagaggcaaagtggagacagacgccagctaccccnacnacnaanaccagccaatgaagagagaagaggagggctcccnnccctgcccctgcatccaggtggagaccaaggaggccctccagtgggtccgctctccctggggctggcgacagtggacatccagaaccntgacatcacgagttcacgataccgtgggctcccagcacctggactagcccagctgataagaaacgctcagggaagaagaagatcagcaaagctgatattggtgcacccagtggattcacgctttctagccagtgggtctggaccccacgaatgggctttgtgcgtgtacaaccctcaacgcagaagcatgggaagcttggcctaccggccggtatcagggaggaccgatacaccaagccgtagaccttaacttattacgactcatgagccagtgttcatgtggcagcacgcgcaatagctctcggccaatagcggcgcgcgcatatgcggtacacgtgcccggcctat

SEQ ID NO: 631274 - DNA, 381 bp, Homo sapiens
tctggcctcccaaagtgctgggatcaagggaggagaccacccctcatattgtcttatgcccaatttctgcctccaaagaaagaagaagtaaaaactaaaaggcagaggtggacagcccagcgctgccgcaccctggtcctggttaaagatcgagccctgacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactccctagttgtaagcccttaaaaaggtcaggaattgctcactcggggagctcagtttttggagacg

SEQ ID NO: 631275 - DNA, 424 bp, Homo sapiens
  misc_feature (67)..(67): n is a, c, g, or t
  misc_feature (169)..(169): n is a, c, g, or t
  misc_feature (353)..(353): n is a, c, g, or t
  misc_feature (361)..(361): n is a, c, g, or t
  misc_feature (385)..(385): n is a, c, g, or t
cacacgttgaaatggtaatattgtggatatagtagggtaaataaaacgtgctattaaaactcatgtnttttttaaacattgctactggaagtttacaattacataggaagcttatatttctactggacagcacttttcaaacattctaaactaaaaggaaatatataangagattaatttatgcaaaggaaaagagagaaataaattacgtattaaaaagtaaaatatggctgggtgtggtagctcacgcctgtaaatccccgcactttgggaggccaaggctggcagatcacttgaggccaggagttcgagaccagcctggccaacatggtgaaccccgtctctactaaaantacaaaanttagctggctgtggtggctcacgnctgtagtcccagctactcgagagggatgaggcaccaaga

SEQ ID NO: 631276 - DNA, 115 bp, Homo sapiens
tgctggaagggggaacactgcataacaggagagcacagcagtcttctccgtgcgggaactgaggtaccgctgcacctaagcctggttcaccccgtataaggagagcatcatgaag

SEQ ID NO: 631277 - DNA, 214 bp, Homo sapiens
ctttaggcatgttgagcgaggtggtctcgaactcctgacctcggatgatccacccacctcagtctcccaaaatgctgggattacaggtgtaagccaccgcggccggccttgactaccatattttaaatttactggaggacttttttgttctcttctgggggctttttttaatagcatcccgctcttatttcagaataaaaaaatttttaaggta

SEQ ID NO: 631278 - DNA, 457 bp, Homo sapiens
gaactctagtagctgaaattggtggataggtaggatcccaggatggggaatgtacctttgaatggtcgtggttctaatctggctttgccatctgctgctgttctcttgactagaggtctcatcctccctggtcgtgcttggctgatgattgagtgttgggtctatgaagacgcctttccagctgtcacacggtgtttggagcaagcaagctgggggtaactcccagctcccatttcttgttcctgtgaccttcgactagatgcttcacctcacctgtcaaatggagctcatgatagtgcccacttccttaagttgttcagaggagccagcactaaagctctcggtcacaggcctgatgcatagcaagctctcggtatctggtggtgttgcaaccaaggtgtttctgtacttcaagccactttgaaaccaagcctataaacgcctagttgctgcccgg

SEQ ID NO: 631279 - DNA, 156 bp, Homo sapiens
agtgtagacgagtcatctggtttgcgttgcggctggtgtacgggacagctctcggcctttcgcacgggccgctcgtccagagtggactcctccggtgcttattcgacggctgctgctgtcaggcggcggttcatccacgtcttccacttctcgggc

SEQ ID NO: 631280 - DNA, 406 bp, Homo sapiens
gaccaggtgggactctgactggtccctctgaacctcaagtttctgttctttctcccatcctcctgtgccctccacccatccttccatccatgtgcctcacatattcctcagcacttcctcattgaacatagaatcatcctgtgacccctcaaacaaatactttacattaatgtgcataacagcttcattcacaatagccaaaggtggaaacagcccgagtgtccgtcggtggatgggtgggtaaacaaaatatggtctatccatacgagcgaatattattcaatcacaaaaaggataagataagtagtgtttgatagcacaacagggtgactacagttaactataattaattgaacatttaaaaataaaggattcctttcaaatgctgagaaaagaaaatatcaaa

SEQ ID NO: 631281 - DNA, 323 bp, Homo sapiens
atttttcctgttttaaaaaaactgggcctttaaaggttatatgtccggtccccgtatgttttaagtcggggttaatgccaacagtgttgaaaacaaaatttcatgagatctaattgtggttgcccccatagggagcaggaaagtaaagttgcatttccccctcgccccttttacccccaagggcctaaaaaatctccttgtaagtgggtagtgttcccggaaacccttgtgttcccccgggggaaaacccgtatatatttttccccaaaaattaacgtttaaactttcatgtttgaaaatttaattaaaaaaattttttttca

SEQ ID NO: 631282 - DNA, 242 bp, Homo sapiens
tcccctcgagagcagaagcgtcgccatcatgttccgcttctgacgctcgcgaagcatgacaatggacgggtcgtcgctcggtccttcgacgccgaagttagagctgtaattcgcatcggttccgtcggcattgccttccttgttgtccagattgtgtttggcctcatagctgacgaggtcttcgagcgtgaagccgtcatgtgcggtaatgtagttcaagctggcggtcggccggcggccgc

SEQ ID NO: 631283 - DNA, 832 bp, Homo sapiens
  misc_feature (508)..(508): n is a, c, g, or t
  misc_feature (649)..(649): n is a, c, g, or t
  misc_feature (664)..(664): n is a, c, g, or t
  misc_feature (666)..(666): n is a, c, g, or t
  misc_feature (671)..(671): n is a, c, g, or t
  misc_feature (707)..(707): n is a, c, g, or t
  misc_feature (717)..(717): n is a, c, g, or t
  misc_feature (746)..(746): n is a, c, g, or t
  misc_feature (754)..(754): n is a, c, g, or t
  misc_feature (762)..(762): n is a, c, g, or t
  misc_feature (769)..(769): n is a, c, g, or t
  misc_feature (782)..(782): n is a, c, g, or t
  misc_feature (788)..(788): n is a, c, g, or t
aacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgnattgctattttttccttttggccagatagctaggtttctggttccccccacagtaggtgttttcacataagattagggtccttttcggaaagaatagttcccagtgtttgataggataagttgtggtgaagaatctagttnattttgcatttggcnantgggnctgtctgcatgggtaaaaaaccccggggtattggtnaaaagccccngaggcatccctgggaaggggaaccttccnttaaacangcctggtnacaagcnctggccccttaancccttncccaaccccatttaaaaaggcctggggaaaaccaccaaaaccct

SEQ ID NO: 631284 - DNA, 982 bp, Homo sapiens
cggacagagggctggaaagaagacgctccagaatcaggagcttcccctcaggaaatagcatcctgtgtccccgcactgcaggttgtctggtctctccagtcatgttaggtactatccggctgctgcaatgcgtgtggtggtgattggagcaggagtcatcgggctgtccacgcgcgcctctgcatccatgagcgctaccactcagtcctgctagccacttggacagtaaaggtcgtacagcggaccgcttcacacccgactcaccatgcaccgacgtggtctgccgggctctggccagtccctgtaccttgtctgactcccaacaaccctacaggaggcggtaccgtggtagccagactagaagctgtggatcgtattctcctgaagccatggtccaagttctccgcaacagtctagtaaaaccttgggcctggattccctaatcctcgtggctacgaatcatctttcccatgaagcgctattccgggacctcttcgcttggcacagggacgaccagtatcgtgggaatgtgctggagagctgagcccgcccagagcacgctggagtagtgtttcgccatgagtttaacaggcttagtgtgcctgggtttcggcacgacggaaggccctatatttacgtggcacgggggacatagaagcttagtctaacaagttgggcattgaacgttgacacacggttagaccttggacgcatgcgccggagctggaaaagcgttcgtttgcccgaagcgctagacaacggtgcgaagctccatcaccggaggcgcaggtgggccaacggaggaaatggggcgccaagaaccggtggaacttggtcaaagcaagcccacgtgagagcggtaaatcgcggcctagaggcgccggctaaccaaggcgaacgtacgccccccctaggcatggccaggcccaagggcccgcgagcgcgcgcacaagccatccgttgaacgggtgggaaccgcccc

SEQ ID NO: 631285 - DNA, 432 bp, Homo sapiens
tggatcatttgaggtcaggagttcaagaccagccgtctgaactattagtagagaccagccgtctctactaataatacagaaaaattagccagacgtggtggcacacgcctgtaatcccagatactcaggaggctgaggcaagagaatcgcttgagcccaggaggcggaggctgcagtgagccgagattgtgccactgcactccagcctgggcaacagagtgagactctgtctcaaaaaaaaaaaaaaaaagagactctgccaccaagattggtgagacgtgggatgggatggctgggagctaaaagaaaccccggggtaacggggggataggcgcgccgggggtaaggagcggctcccattctgagcctggcctctatgtcaggtaccggggtaccggagctcagattccggtaatcaggggtcataggctg

SEQ ID NO: 631286 - DNA, 788 bp, Homo sapiens
  misc_feature (508)..(508): n is a, c, g, or t
  misc_feature (649)..(649): n is a, c, g, or t
  misc_feature (664)..(664): n is a, c, g, or t
  misc_feature (666)..(666): n is a, c, g, or t
  misc_feature (671)..(671): n is a, c, g, or t
aacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgnattgctattttttccttttggccagatagctaggtttctggttccccccacagtaggtgttttcacataagattagggtccttttcggaaagaatagttcccagtgtttgataggataagttgtggtgaagaatctagttnattttgcatttggcnantgggnctgtctgcatggttatatacgtcctggattcatcgattgaccagtctctgttagacgttcgtctgtgaagagcaagctatcattagccatggtctgcttatccagcagaaccaaaag

SEQ ID NO: 631287 - DNA, 752 bp, Homo sapiens
  misc_feature (434)..(434): n is a, c, g, or t
  misc_feature (444)..(444): n is a, c, g, or t
  misc_feature (530)..(530): n is a, c, g, or t
  misc_feature (537)..(537): n is a, c, g, or t
  misc_feature (547)..(547): n is a, c, g, or t
  misc_feature (578)..(578): n is a, c, g, or t
  misc_feature (595)..(595): n is a, c, g, or t
  misc_feature (599)..(599): n is a, c, g, or t
  misc_feature (613)..(613): n is a, c, g, or t
  misc_feature (620)..(620): n is a, c, g, or t
  misc_feature (656)..(656): n is a, c, g, or t
  misc_feature (683)..(683): n is a, c, g, or t
  misc_feature (743)..(743): n is a, c, g, or t
aacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcaggcaggcaggcaggcagcgctggcgcggcaggcaggcanagcaggcagncaagcaagcaggcaggcaagcaagcaggcaggcaagcaggcaggcagcagtgaaagggggcattacattgtgcctggcttttgcanccaattnaaaccactgnaattggctcattttttttgccttttttgggncagcataagactagggntttnctgggtttcccccncaacagntagggtgtttttacaacatacagcatataggggttnctttttgcgcaaaagaaatagctctgncagctgcttttattaggcatagcttgctgcgtaaagcaatactcagtttttattttttgncattttgcg

SEQ ID NO: 631288 - DNA, 239 bp, Homo sapiens
caagtattagaaaaaaaagaaaaaaaaaagctttcttcactaaaaattctgatttctgtacatctgagttggcttgaatatcaatatgttgtatttttaccaaaatgtgtttttattcacatcctaattttgacaaagaataaccgtgttcccattatgcacatccaccatctttacattaaatttcatttattgggcaccctttttccattttgtcagatcctcttccctgtaaatgt

SEQ ID NO: 631289 - DNA, 174 bp, Homo sapiens
  misc_feature (123)..(123): n is a, c, g, or t
gtgatgtatccccaacactcatcatactgttgtctagcattgcctggctagtctcatgtgcttatttttcccattaacatttagaatcattttgagcaagtttttaaaaaaatgacttcatanagtacaatgagcgaaaatttttacctatttacaatagaggtatctttgaat

SEQ ID NO: 631290 - DNA, 643 bp, Homo sapiens
  misc_feature (319)..(319): n is a, c, g, or t
  misc_feature (460)..(460): n is a, c, g, or t
  misc_feature (475)..(475): n is a, c, g, or t
  misc_feature (477)..(477): n is a, c, g, or t
  misc_feature (482)..(482): n is a, c, g, or t
  misc_feature (518)..(518): n is a, c, g, or t
  misc_feature (528)..(528): n is a, c, g, or t
  misc_feature (557)..(557): n is a, c, g, or t
  misc_feature (565)..(565): n is a, c, g, or t
  misc_feature (573)..(573): n is a, c, g, or t
  misc_feature (580)..(580): n is a, c, g, or t
  misc_feature (593)..(593): n is a, c, g, or t
  misc_feature (599)..(599): n is a, c, g, or t
aacttccggctctcactgctaggggcttaagcggagggagtcgagccagcgtcgccgcgatggtgttgttggagagcgagcagttcctgacggagctgaccagacttttccagaagtgccggacgtcgggcagcgtctatatcaccttgatgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgnattgctattttttccttttggccagatagctaggtttctggttccccccacagtaggtgttttcacataagattagggtccttttcggaaagaatagttcccagtgtttgataggataagttgtggtgaagaatctagttnattttgcatttggcnantgggnctgtctgcatgggtaaaaaaccccggggtattggtnaaaagccccngaggcatccctgggaaggggaaccttccnttaaacangcctggtnacaagcnctggccccttaancccttncccaaccccatttaaaaaggcctggggaaaaccaccaaaaccct

SEQ ID NO: 631291 - DNA, 161 bp, Homo sapiens
taaattatttcaggggaagagaagacaaaacgagtcgttcatacggtgtgaacctttctcagtaatgttatctgaaaaaacaccttgtgtgatttaatgaaatgataaagaatgtgatgtgggatttcctttgcacagaaataaaatatctccaaatgtta

SEQ ID NO: 631292 - DNA, 331 bp, Homo sapiens
ttttttttggatatggagtctcactctgttgcccaggctggagtgctgtggtacgatttcagctcaatgcaagctctgcctcctgggtttaagcaattctcctgcgtcacgctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacaggcataagccactgtgcccagctgcattgttgctgttttttattgttagttaagagaggtcgac

SEQ ID NO: 631293 - DNA, 345 bp, Homo sapiens
gactctagacgatcccgtccacggtagattttttctatttcttcatttgtacatttattattatcattttttgagataaggtcttactttgtcacccaggctgagtgcagtgatgtgatctcggctcactgcagcctccacttcccggggtcaagcaatcctccaacctcagcctcccaagtagctgggacaacatgcgtgtgccaccacacccagctaattttttgtagacatggggttttgccatgttgctcaggctggtcttgaactcctgggctcaagtgatccacctgccttagcctcccaaagtgctgggattacaggcctgagcaccgcgcccgcgcc

SEQ ID NO: 631294 - DNA, 187 bp, Homo sapiens
cagctgttccagaggatccctctactaacaaatacaaaaaatatagccggagcatggtggcaggcacctgtagtcccagctactcgggagctttgagacctgctccgtttaccgacctgggccggtatacacccgctaccttaagtgcaacctggtaggtaccccgcgctacccgtgtgaggtacac

SEQ ID NO: 631295 - DNA, 109 bp, Homo sapiens
gtagagtatcccttacttttctgattatcaagttttttgttgagactcaaagcatccccaaaacattggagatccagcttgagacactgcgactgggtacctgagctcg

SEQ ID NO: 631296 - DNA, 126 bp, Homo sapiens
agccaaggacagctcaggcaggaatctagacaaacaatgacaggttaaaacacagaaaatacagccaactactatgtaataccttgcccgcattgcagatggcacaaaatgtgggttttttagctc

SEQ ID NO: 631297 - DNA, 330 bp, Homo sapiens
gtgcacaagggtatgggtatcacaagtgcacaggtaacagatcctgtacgcgaggcatctaccatagagacagatagagcattcagatgaggaggacacattctagagatagtatagcatagatttcccataacaggaggcaggtgatagacactcatatcagaaaagtagtgttgagaaaaacacaggcagagcctggccatttgcctcctagcataggcactatacatgatggtggccacgtgccaggggaccacaccctatgtacaaagcaggagaatgaatgctcccagctagagctgcaggactgggcgtgcagtgaggggactc

SEQ ID NO: 631298 - DNA, 239 bp, Homo sapiens
gcgaataccgggaaacatggctgaagccggtttcgcgcatgtttccctccaacctacctcccattcagtcctgttgagccactgtgttaatccacagaagtatttcttgccaacaatagtatgatcaccagacagcaattcccatgctatagcttcagagactatgaatgttcacatatgtgactttctaccaccattcataattggtttacttgcctaattccattcctcctgtaaca

SEQ ID NO: 631299 - DNA, 555 bp, Homo sapiens
  misc_feature (277)..(277): n is a, c, g, or t
ccatgcagttggaaatcatggacactggatgttctaaatctctggtttttaaaaaagtgataaattggtgttaggtccttggagctttcttctttcccagcccgggatcccttcctccttcagctcttgtctgcacccccactgcccccacccctcaggaccgattaaggaaggaaatagcaaactgacaaaagcctagcctccactagcaaaatagaaaaatagacgtctggaagtaggaggtcgcctcaaggttttcctttgttactgtggaaantctgcccacagagcaggttagcctacttgggagactgctgctctaaagcgggtacccagaccagtgagggtttgccaaagcgccatctgctggacataaaggggaagtgcatcttgtccctagctccctgagaaacctccaattctgtggccactgttccttgtacaaacctgacacaaagactgtcagaaaacactgtggctagaaacccaaagggccacctctcccattgtcctacatcctaaggtcagagcaagactaacaccatgcacaaatag

SEQ ID NO: 631300 - DNA, 343 bp, Homo sapiens
ttgcctggcagagcacgaggccaagatgagctcgccaagtcagagcatgagaaaggtgcaggatagcaaagctgaaaggggggcccacgacagaaaaggccaagaagagattgtgacactgcatgccgaaattaaagcccagaagaaggagctcgacacaatacaagaatgcattaagggaaaacatgccccaactgtcagctttgaggagcgcgagagaaaacataaagcagcagagaaagaactaaaagaccagctagcagagcagacacagaagctgtagtgtcacgagaagaagaaggcaagaaaaacaaggaaaagctgagtacatcagcctggcaga

SEQ ID NO: 631301 - DNA, 119 bp, Homo sapiens
  misc_feature (38)..(38): n is a, c, g, or t
  misc_feature (47)..(47): n is a, c, g, or t
  misc_feature (89)..(89): n is a, c, g, or t
aaattatacaaaactagaagcagcagattgcaggaganttgcttgantccgggaggcagaggttgcagtgagccgagatcatgccactnttctccagcgacagagtgagattccgtctc

SEQ ID NO: 631302 - DNA, 453 bp, Homo sapiens
cttcccacctctcttttctcttcccttttccacatgcctctctgctggcccacagccagtcccggctctgcagccctctccgcagcctgttcagttctctccaagctcctgtccccaagtccttctgccagtctctccgccccagcagtacaacatggtataaactccattccccctttttgtcttgttcatgtgtggcctgtatctgtaggtatgtctgggtcagtctgtgatggccttgtaagcatgttgtgcttttggagggcatattgaaagctatttcttcttgagggaccagcacaggctgaactatactccatgctaatggcctcatcacagcacatcaaaagatgcttaaatgtaagacagaggaacactgtgttcccccaagtttcaggacagagaatgaaattggatgttggtataacctaggctcctcatctctacgatgta

SEQ ID NO: 631303 - DNA, 108 bp, Homo sapiens
cccctgtttgactaatttctcccatttggacatggctatatgtaccctatacctgtaccccgcgattgtatctaggaagtaacatagcttgcttatgttctcttatct

SEQ ID NO: 631304 - DNA, 107 bp, Homo sapiens
tactgtgcgacttcgcattgatggctgctgactgcttagggtggtggttgctgaaggttgggtgacagtggtaatttcagtgattttggttttgttttgtttcttta

SEQ ID NO: 631305 - DNA, 139 bp, Homo sapiens
ttatttctggggatttttttcttttgctaaatctggcaaccccaacccggggcctggtgcaactttggggtgatcagaattttttaccctggtttgcagtggttgcctttgtcaaaactcccttaattataccccaaag

SEQ ID NO: 631306 - DNA, 210 bp, Homo sapiens
gctggtccccatcggcgaacggggctgacggctggttgcggacaggatctggcccgaagtcggcgacagcaggccggcgatggcgcggccagcgtggtcttgccggaacccgagccgcccaccaccgccaccacttcgcgcggcttgacgtgcaggtcgatgccattgagcgcgcgcttggcgccggtgcgcgagaacaggcgctggtgg

SEQ ID NO: 631307 - DNA, 289 bp, Homo sapiens
ttattctccaccattcctcaggtatgtttgatcaccccagcctgctttcagcaagaatcctattatgtcagtttggccagaatccccacttagccctaatgtttgcttttagtacttttccatccattgatcccccccctgctccttggctataaattcccacttgcccatgctatatgtggagttaagcccaatcacttttccctaccgcaaaatcccattgcagtggtcctgtatacctatggaggtagttcccacatacaccccttaaataaaggatgcctcatca

SEQ ID NO: 631308 - DNA, 1075 bp, Homo sapiens
  misc_feature (396)..(396): n is a, c, g, or t
attaaggatgatgtgattgaaaaatgtaataaacatggaggagttatttcatagttgtactggtttgacattgaaatctcagctcagggcaatgctgtaatgtgaagtgcccagtcaattgctgcatgctattgctcgcttgtcaatgcacttgtcatggccagggtgggtgtggtctggttataactgatatacagcacgtctactatgtacctactataccatgctgtaaccaacaatccctggtctccgtgcattctatgcatcagtacaacaacaggctaactggctaccaatgttagacgcactgacaggaatagattattagatcccttatgatatatactcttaattttctcttttcttgagaagaattcagtcttgagtagattcttnttaattttcaggattagctagataagaatgaggtcatagggtatgtctaatcttgtgcattatgtatgggcaatattaccgtcgtatacactatgcagaaaattataggaatcgtttaacgagtgagcaaagaaaaagaacaaaaaaaaagaaaaaaacaaaaattgtgacgcggacagaacacagagagagacacaccgcacgaacaaagagggcattcgaacacagacacacagatcagaccgaagaggacggacatccctggtaggcaccaacacagaagaggcgagaaaaggaagaacaatgggggccaaaaaaagagagggacacccacacatagggggaaaaccacggggcgaccaactaagacaatagcatgcgtgcgtaggagagacacagcgacaacgcccacacatgaaacaaacaacatccgccaccacactcgacagagggagtaaccacagagcccgaggaacgggatcagtacgataaacgaagcaaacttctcacgtaagaagtgcaaaggattacagagagagagggaacgaccaccagaacaagcgcgaggcgagagtagccagaaagcaagccacgaggggggacacatcccaccacagagcgagccacctcgcagaaatccatagaaaagcagaacgcacgccgaagccgcgggggcacc

SEQ ID NO: 631309 - DNA, 854 bp, Homo sapiens
ggaaaaggggaagtacttaaggaacattggtcaagtggaggtagtcagcgaggttctcgtggtcctttacacagattttacagctttgggtttcatattaggtattaagctaaagtcatggggaccaaactcttcaaattttacggaactttaagatttggcaatttattaaaaattgattgtgattattaacagttgagataagcttccttaatcttgggtttgaacaggtggttcatttgagtcaaaggttaaagcgttggaaacacaatttttaacaagggttgggttagagaaatcttatccccaaccaatagaacgaggatattaagatattggtaagaagactacacaaacgtttatggatgcttgaaccaattcttgggacacaggttaaccaaaaccaagggcgtcacacgcaatgtggcgaaaaccaacaacctgggacatacctcaaaatttggtgaggcccaacgcttacggggactttatgcatattatagattgcagtaggcaaaatttaggtgcatcgaaatttataatggcacccattggccgattataaaacaaccatatcacgccaccaggatacacttcttgggaggataaaaaccgaaaaagataatagcaagaaggatttctaaatttctgtacacttctaatgggtgaaggtgaacctttatgtaaaacgcacctacaagttataagcttgctctacaacagtggtgtatcccttcccgaagcaacagtgtggaaacaaacagccatagtgaagcactttctgtacagcgacttcggtgtactcgggcgaacatatatcacgacacagggtgaaaaagctgctttacaggcct

SEQ ID NO: 631310 - DNA, 1442 bp, Homo sapiens
ccgtgccactctgctcctccatagtataactagacaacgatggcttggacacagatgtgatgcacatgaccatggtggtgaggatgaacgggtccgtggctcctggagaggttggcgtgcatcgtaagttgcggcgacgtatgtccaagtgctcgactggctggaggtattcgcctaggtagggagtcataagtgttctcatgcgatcgcacacgcactatctctcggaagacatcaagctaaggactcgccgttggagcggtcgcttgcgcgaagtaccgtataacgctgcctattttgaaataccctgtagctcttcactgttggagagtctgctgaatcaggaggaatctctcgttgatcctcagggcctgtgcctcgtgcggccctacgtatcctactataccaggatgctgatctatgatacgcatgtggctggcatggccgagccgccagactcacggctggtggaggacgacccgcgtgatatgtcgggccaacgctagttggactgacgtggcttggggccgtcctaattgagtcggggcctgggcaggcgccatagttgtgtaccactccataacgtgcgtgcccccacacgtgctggcctgtagctgcttgcgcgcatcgtcagcgcataggggcgttggtagacgcacatctatactagcatgtgactggggacaggccaccgtaccggactcagtacaagtaaccccgacaaatgtgcttcgcatgcaccatgggttaggccggaggaccataacgtgacatgtacacgttcgacacgctcgttgtgagccaagaagggctaaccaattcccaacttaggaacaagaaacaccttttgtcgtttctcccgatctcaagaaccggggggatcgtaccaagtccgtaacactatcgacgatggcaccacttgtcccgagtgcaatacccgtcggcgaaacactccacgaagagggcgaacgatcgtaagttggccttgggtaccccccgttaaccagcggggagaaaacaacccataggaccgtacgtttagaactcgcggacgcgctggcgaggggctatctatcggcctagaaagaactggacttccacttcgcccttttgcccataccttagcgtgggggctcgacttggtcactatgggggtttgatggactcgaggcaaaaccggggtcaaagtgcaccacgtggggagcgttcactggtacaacccgtgagctacccaggccttccaaagctgtgggacactcatgtgacgccattcacgggatgcgtttcagccccacacctttggacccacagcgggctgagaacaaaagcattggatggtatgggacccctgttgacatcttgtacgcaaatgctcgacactactggtacacatcggagtgtcccatatagaatccggcatgtgtgccccttacattatacca

SEQ ID NO: 631311 - DNA, 991 bp, Homo sapiens
cttttcctcggtgcaacttcggttgatctggcagccattgttagggtgtctgaactctttcctgacactccttttaattcgtatacagatagcgctctatgtggccacctctgttcctcttctagaacctgttccaaatattcgcccctcaaccaatgcttccctgtcgatgttctaaacttccaaaacttatccttgcccgcaagtttctccttttttgtgtggccatattcgtactcattcaggcctgcttgggccattgtctgaaggcaacgatatagttgatcaggctacccaggtagtggcttctgccttgtctaccactcctcttgccgccgctcaaaaggcccatgatttacacaatcttaatgcccataccttgagacttaaattttccatcaccggcgaacaggcacaagaaattgttcggcagcgtaagggctgcctgacccttttgcctaagccacatgtgggagtcaacccccacatgctaattcctgctgagttgtggcagatggatgttacgcactatgctccctttggaaagttaacatatattcatggctctgttgatacttttagtgattttatctgtacatctttacagatgggggaggccacttgacatgtaatcagtcatgtctctcctgtttggtggttacaccacaaggcaagattcttcaggccagataatgccctgggatatgctaggtcccggcttaaaccagtttggctcaaatggggttttagctttttatgggtttcctattaaccccgaggcaaggtcgtacaagggctaatcacccctaaaattgccctaactacgccggggacagcattcccatggagagaacctctattcgacattgttcattccataacacggcatctcaactttacctcacatcatcactgaggtctacacacaacactgacgcctagacacaacacaacaacaaccctctctactgcttcttgtcttccttttctg

SEQ ID NO: 631312 - DNA, 963 bp, Homo sapiens
gtaaaacccagcccatgacccctaacagtgtgccctctcagccctcctaatgacctccgtgcctagccatgtgatttcacttccactccataaccgctcctcatactagtgcctactaaccaacacactaaccatataccaatgatggtgctgctgatgtaacactgatgaaatgcacataccaattgccaccacacaccacctgtccaaaaatggtgccttctgatactgtgtgataatcctatttattacctcagaagttttttatcttctgcagtgatattttcttgagcctattatacacactaccagaaactaagacacccatacacccccaaattaagagagtggcacttggccccccacacatgtgcaatacaacaacacctgacttaaatccacactaaaaagtcacacacatccatcaacacaacatacccgctatatactacgaccatcatgatgtaatacaatacacactgaatactacaccaatacgtctcaactagaaacacacaaacccgaaaaccgaaataaaactacaacgccacttgccttcatcacacaatctcttcaccatgggctctactaatttacaaccccttaccatcaccaaagcccttcacgacgtaactctccgcatgtactcccccattctcaacaccaactttatacctggactgtgacaatacataccattgctccaagaccactaccatccattgtacagcgcaaccatgtgcacttccccacctatcaacctatcccaccgtacaacatacatttggccatcaacactattaccccatcacactaatacatgcaatccaatcaccgcccaaccctacactactaataccatcctctatatcaattccaacaaacactcaccgtatcgccctacgaaacaccagccacgactgactacattgtgcatacatacacactctcctattccaaccc

SEQ ID NO: 631313 - DNA, 134 bp, Homo sapiens
cccggtagcgaagaaaggcgggcggtcagtagcaggtgcgtccacctccgcatgacaacagacacattgacgtggtgggttacccgccaagcgtcgatggtcttctgtgtgaaggccagcggagggcctcgtgg

SEQ ID NO: 631314 - DNA, 328 bp, Homo sapiens
atggaatgtgtgtgtgagtgtgtgaatgtgtgtgaatgtgagtgtgaatgctggtgtaatgctgtgaagtgtgtgaatgtgtatgtgtgaatgtgtgtatgtgtgaatgtgtgtgaatgtgtgtgaatgtgtgtgaatgtgtgtgtatgtgtgtgaatgtgtgtgtatgtgtgtgaatgtgtatgtgtgaatgtgaatgtgtatgtgaatgtgtatgtgtgaatgtgtctcaatctgtgtggtgtgtgtgtgtgtgtgtgtgtgtgtgtgtacacgcgcatgcgttgtgtaaagtgtaggcctatatgggtgtacgctgaagcgggtg

SEQ ID NO: 631315 - DNA, 630 bp, Homo sapiens
cagatttagggaagttttaccttattacactttaatctctggatttaccccatctcatttctcttttaggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagagcgtacacttgtgaataaagagggtggggtggagtatagtatgttgctaacacgcaacacaaagctttgtgcatatgtgcatagatattaaaacatgcctgtacattactgttttgggtttagtttggaaaaggaagtgcaaagaatgaagagtttgtttgttggtgtgactgtttagagacgtttgcgttatttttcttaatatagaacaagcaataaactcaagagattgagttgggaaaaatcaaaga

SEQ ID NO: 631316 - DNA, 259 bp, Homo sapiens
  misc_feature (219)..(219): n is a, c, g, or t
tcaaacaccgcaatcgacctatttttatttttttagacaagagtctcactctgtcgcccgggccagagtgcagtggcacaatctctgctcactgcatcctccacctcccgggtcaagcaatcctcccacctcagtctcctgagtagctgacactaaaggcacgtgccaccacacctggctgatttttgtgtatattttatttttttttttggtagaaancgggttttgcgctatgttcgcccatgtctggtctcaaact

SEQ ID NO: 631317 - DNA, 802 bp, Homo sapiens
gttctgttcgcatgtcagtgtagacgctgcacctggatgtacctagcattcgatctcagtatcgtatcacagggtgaaggcgagaggtggttactacactgcaattagaagactggcatagtggttctgtagtactcatttagagcacatggctgtggcagggttgatgagggaacgagcttgtggggcgtccgtgagagtgatggatgagtcctactaatgatgagccttctattctagcatcatgcacatcttgacttaagatgtgctcgtgtttgatatatctatgttttcgctcagatgcatagccgtgcgtcgcaccgacggagttctcagtgtctcaatgcctctttgttcgcttactatcattgctttgatgatgtcgcgtcgtattctgactgtatatgttagctgttgcctatctcgtcgatccgagatctgatcttccagttgcgcgctccgatatctccaggtagtgttcctctgtgcgagatggtctccgggcttcttcactcgagcctccagggcggattccaggaagactccttggtactctcccgataggtccagctctagcagtctcttctggctctccttagatccttctcgtacgcagatcatcgacagacgggatggcgcgtcccgctccaaatgccaaatcacctaaccagcagattgggcaaggtagaggaaaatggcggggcccatctgcctcacgatcacccatagtgcacattgggtatactccgccccggacctgtggccagggtcacgttcatgggattctttcccctcctgggaa

SEQ ID NO: 631318 - DNA, 308 bp, Homo sapiens
tgagtccttacgacgaagcgtaaattattggtgacgtttaagatgggggcagcacattggaagtccctcatgagtgcgggcccgccacttgtccagagggccacgagtgggtgcactgtacttgagcccacagccatctgggatgagccggttttcagtcacgatgtcttctatttcatcagcattgaacttggtgaagccccatttctttgaggtgtggatcttctggcggccaggaaactatgaagttaggacttgagcaggtcctctgtcagatgctccatagttctacgagcttcgtcgagtca

SEQ ID NO: 631319 - DNA, 904 bp, Homo sapiens
ggaactagtctcgcgtattttttttattatatattaaaggtatgtgagggggaatgcgggaaatggtaaggggtatggagacaatatcatataagtaaggctagggtgagtggtaggaagttttttccataggaggtgtatgagtgggtccgtagcggaatcgggggtatgctggtccgaattcataagaacagggaggttagaagtagggtctgggtgacaaaatatgtggtgtagagtccaggggagagtgcgtcatatgttggtccctaggaaagatggtagtgggcgagagggttgtccataatagataaggtcggggatatcggctatgaagaatagggcagaaggggcctgcggagtatccgagtgtgagaacgcctgaaacaagtctcgagactcccctatgccggcaaggtccagcacgggggagtcacaggaagggcctacatggacaagtggtgggaagacacactcacatcatgaatgggccaaagggtccatcagacgggcaaggaagtaacaccaagaagtgggaaccaagaaagcaggcagacaaaggcggtagagacaagagtatacaaaggagagggcacactaaattcaaagagaaacgtagcacaaaaacaagcacaagaaacgatgaaaagcggggacaacgaggcgcaggaaacacaaccaataaactggcccacacaattgatcatgagggcgagcaacatcattgaacatacgaagacacaaacacgcaagacggaacaccaaacagcgacagagcaacataagcaggaaaataagagggaaaggcgaaccaccgcccccagcgaaaaacaaaacaagagaaaagggaggacaaccagacgacaagaggcgaccaccccacacgaggggactagaaaaaaaa

SEQ ID NO: 631320 - DNA, 353 bp, Homo sapiens
  misc_feature (195)..(195): n is a, c, g, or t
  misc_feature (227)..(227): n is a, c, g, or t
  misc_feature (231)..(231): n is a, c, g, or t
  misc_feature (249)..(249): n is a, c, g, or t
  misc_feature (251)..(251): n is a, c, g, or t
  misc_feature (260)..(260): n is a, c, g, or t
  misc_feature (311)..(311): n is a, c, g, or t
agatggagcctaggtctgtcaccaggctggatggagtgcagtggcactatgttggctcactgcaacctctgcctcccgtgttaaagtggttctcctgcctcagcctcccaagtagctgggactacaggcacatgtcaccacactcagctaatttttgtatttttagtagagatggggttttagcatgttggccangatggtctcgatctctcaaccttgtgatctgnccanctcggcctcccaaagtgntnggattacangcatgagcaccctgcccagtcgcattatttcttaaaaaataaacacaagtngttctctgaaaactgtcgacgcggccgcgaatttagtagtag

SEQ ID NO: 631321 - DNA, 304 bp, Homo sapiens
tctaatgacacaggacagtgtgtggagcgttaagagctcggtggtaaacgtgcactgaaatacagtcatgctgtgcagaagctctctagtttcattagataccttttgtcaattttggcttttgttgccatttcttttggtgttttagtcatgaagtctttgcccatgcttatgtcctcaatggtattgcctaggttttcttctaggatttttctggttttaggtctcacgtttaaatctttaatgcatcttgagttaatttttgtataaggtgtctgcaaggaacccacgcgggtaccgagct

SEQ ID NO: 631322 - DNA, 141 bp, Homo sapiens
  misc_feature (88)..(88): n is a, c, g, or t
gtgtatattgctgtgatatgtgttgcaatgttgaaatggactgtgctggttggctccagcgggaggtgcacttgaaaagaggatcagncgtagttgtgacaggcagattttctggcttgcttatgtttggggtggactctg

SEQ ID NO: 631323 - DNA, 102 bp, Homo sapiens
cactccgacggaagcaatatgaaatgatctgctgcagtcgtctgagccctaaggattcatcttatcttttcacctgtaggtgtgcctgcttgggcattgtat

SEQ ID NO: 631324 - DNA, 320 bp, Homo sapiens
cgccatttacaactatctcagataggtacagggagcactgcaatggagtcttgcagttggggagagagattgggctctactctatatactacaagtaaaagcgggaatttatagacaaggatgtgggtgtggttggtggatggaaaattactagggggcaacattaggaataagagaggattctggccaaactgacctaacagggttcttgttgaaggcaggccagggtgatcagacatcacctggaggatggtgaaggatgaggaacctaatcagatatgaggatgatcagatagttgtaaatggcggggtaccgagct

SEQ ID NO: 631325 - DNA, 198 bp, Homo sapiens
tcagaaaagctgttgacttttcttaaatcagcttccctgctgggcccctgaaaatggactgggtgattctgtttggcaaaaagtggggaaaaaacccggtttccagcttgcagatttgttaagtttttcaggcagattttgactttcagcctttcaaacttggttaagcaaccatttgtattaaatgaagttttttga

SEQ ID NO: 631326 - DNA, 392 bp, Homo sapiens
accatgtagaagacgaacagacattgaatgctactgtaaacaactacaggccaaagtagatgcataagaaaaatccaggacactaaactagacagaggagcttgcagtagcaaacaacaggatcattaccttacaagaagaaatggaacgagtacagaggaaagtcctacatactggaatccaatcggaagggtcccaagcgacagacagaactgcagaagggcaagcactaagtgaagcaagcaaagcatttaaaagaagagacacaattacgattggatgttgagcaaagcaactggagatgcagatcagcatgcggcaggagatggaattggctatgaagatgctggagacggatgtctgtgagaagcaggatgccctggatatctctt

SEQ ID NO: 631327 - DNA, 134 bp, Homo sapiens
ttatatttggctttttgactcttttaaaacaatcagcctgcatttatataacttttataaataatatcttaacttgacccaaattatattattatttataaaagttaagatattaaaagttcctttcagcattg

SEQ ID NO: 631328 - DNA, 149 bp, Homo sapiens
ccccctgggggtgctgcccgggcctcctgagttttggaacaagtggatgttggaaaagccagccccttttcccagcacaggggtgcctgacattgagccccccctttccaagtttttttgtgaaaacaattaaaggtcctgccctccca

SEQ ID NO: 631329 - DNA, 564 bp, Homo sapiens
cagtaaactactattcagcacgtctgttttgtacataaagttttactggaacacaggcgtattcatttattcttatattatcccatgctgctttagcacaataatgacaaagtatagttacaatagaaactttatagcatactaaacctaaaatatttactatctggcctttaatagaataagtttgtcaacccctgatacagcacaatcttgaaagcccctagatgtacaataagaaccagactacaagccaggtgcagtggctcacgcctgtaatcccagcactttgggaggccgaggtgggcagatcatttgaggtcagaagttggagaccagcctggccaacatggtgaaaccccatctctactaaaaatacaaaaaaatgagctgggcatggtggcgcatgcctgtagtcccaggtacttgggaagctgaggcaggagaattgcttgaacccaggaggtggaggttgcagtgagacgagattgtgccactgcactccagcctggtgacagagtgagaccctgtctcaaaaaaaaaagatacatccctaagcatggatct

SEQ ID NO: 631330 - DNA, 433 bp, Homo sapiens
  misc_feature (40)..(40): n is a, c, g, or t
gctgtggatgatctaaggatcccttggggctccatacagnggtcggctccattcagggtcccactcatccccctttcatgcacgattttctgatctggtgggtgggcacagagcagctctgcaaaataatggggtaatggcttctgtagtcggggtaacgaggcttcagctgtacaatcttcttagacttgtaaaccaagttctgccacctgaggctggtatccaaggcatttctctcgttctttctccaggggcttgatctggtccagcaggtgcggcaggggcatgttctggtggcaggggtacttcttccggatggagtccgggagccccttcaggtatgcttcagaagacggcgcctcttcaaaaactggaaagtaggcagcattttctttcagatgaccatcaatgcactgggtgatctgaagaatcc

SEQ ID NO: 631331 - DNA, 315 bp, Homo sapiens
  misc_feature (28)..(28): n is a, c, g, or t
  misc_feature (181)..(181): n is a, c, g, or t
  misc_feature (251)..(251): n is a, c, g, or t
gaactacacagattgactccagtaaggnagccccatgtggaggtgatagaggcaggaggcagagaaactctaggcagacaggggtaggtccctggcaaaaccccaccttcaaaccaaaaagtctgaaacccatggcccaaagtgagaacttttatcctggtttgcccactgtctcctgatnggttctttccgaataatatctttttaccaatcgaattctgcgttttccaaaactacctatggcccacccnatcccccatcctgtgcctataaagaccccagactcatctggtagtaggggagaagtggctggat

SEQ ID NO: 631332 - DNA, 120 bp, Homo sapiens
ataaagaaatcatgagatataatgactcatagaatcctcacacctactatttaacagagatgccagtggggcttgagattgcatcacttgccccactggcatctctgtaaaatagtaaga

SEQ ID NO: 631333 - DNA, 277 bp, Homo sapiens
  misc_feature (193)..(193): n is a, c, g, or t
  misc_feature (202)..(202): n is a, c, g, or t
ggtggttcttgcagaatgggggcaggtgccatcaagtggatggcgctggagtcattctccgcggggttcaccaccagagtgatgtgtggagttatggtgtgacttgtgtgggagctgatgacttttgggtgcaaaccttacgatgggatcccagcccgggagatccctgacctgctggaaaagggggagcggnttgcccagncccccatcttgaccattgattgtctacatgatcatggtcaaatgttggatgattgactctgcaaggaaccctgag

SEQ ID NO: 631334 - DNA, 250 bp, Homo sapiens
cattgagcccctgatgctagaaaatcagctgtgcgcttctgattcaagcttctagattcacaactattaaacggttctcaagttactacgttatttgttgtccaaatgcctctagcctctgacatgaatcccaccttttcccccttcctgttttgcctgtttacaagaggtgtctgcatgtcactattagccccctcccccaatgagaacaggattttgtttccggaaactggatcagcttctcctcagt

SEQ ID NO: 631335 - DNA, 174 bp, Homo sapiens
  misc_feature (129)..(129): n is a, c, g, or t
gtagaactcgtgcggggtcagtgcgctcctccagctcccggtaccacagcttcagcagggacgcagggacgtgggggtcttccagtgcctgtgtggcaccttccactggtccacctgcagcttcagttncattcacctcgctcaatgtccccaggaacccgttgagcgccaggt

SEQ ID NO: 631336 - DNA, 167 bp, Homo sapiens
cggtttttttgtttaaataaaagattacaatttgaatgttgatgtgataaattatttttgtaatgcattgccccaacatgttgttgtacctttctttattccgattaggcacttgggttttagatgactatatgtatgatctacatttgatgtaggtcttttttgat

SEQ ID NO: 631337 - DNA, 327 bp, Homo sapiens
  misc_feature (75)..(75): n is a, c, g, or t
gggtttcaccatgttggccaggatggtctctatctcctgaccttgtgatctgcctgcctcagcttcccaaagtgntgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctacc

SEQ ID NO: 631338 - DNA, 220 bp, Homo sapiens
cttcgacaaggacgacagcgcccggctggtcatcgacgaactgctggccgcctcgcggcgcggggtgaaggtgcgggtgctgatcgatcagctgtcggcgatctccgacctgcagatcctcggtgcattgtccggtgcccacgagaacttccagctgcgggtctacaacccgaccttcggcaaggcccggctgaactacttcgactacgccggcagcgtg

SEQ ID NO: 631339 - DNA, 434 bp, Homo sapiens
attagaaaatcattactaattactgagaccaggaggtaaagctgcagtgagctgtgatcatgtcagtgcactccagcccagacagcagaatgaggcccctgtttcaaataaatacattaataggttggaaactaacttcctctatttttgccttttggtgccactgctgtttctattctgagcatatttatagcaacaaccatcaccaacaaatacatacaccattagaaagactctctggaactaaaccctttcaaaaggaccctaattttcaccttctacttctgtaaagcatgtggggcttgaagaagttgaacaacctgtgccagaaggtgtgcttctaaggggcaggaccggaactgatctgctctgtgtcctttgctgtaacccagtgtggagactgggtctccaccatagatgtacgcttaaagggt

SEQ ID NO: 631340 - DNA, 352 bp, Homo sapiens
  misc_feature (175)..(175): n is a, c, g, or t
  misc_feature (318)..(318): n is a, c, g, or t
ggattatcccgtcagctggaaaaagcaatacagtaagattcaggtctccctgacaagtctgtagtagggagcgaataaagccatacatctcaagatgcaagcccagcgctgagccacacgcagtgttctgagccccttgatctctgcaaccgttgatttttatcacaaagcaganggaactgcaagaaacggtttgcaattcagatcagagagactttcgcagacctgccacacagaaggaggccttctctttcattctatctcattaggaaatgtatttattcattctaattcatacataaaaatttgaagtcctanaatttgagacaggtctcatttaacttcgaaagct

SEQ ID NO: 631341 - DNA, 864 bp, Homo sapiens
  misc_feature (200)..(200): n is a, c, g, or t
  misc_feature (254)..(254): n is a, c, g, or t
  misc_feature (262)..(262): n is a, c, g, or t
  misc_feature (296)..(296): n is a, c, g, or t
  misc_feature (316)..(316): n is a, c, g, or t
  misc_feature (320)..(320): n is a, c, g, or t
  misc_feature (326)..(326): n is a, c, g, or t
  misc_feature (332)..(332): n is a, c, g, or t
  misc_feature (335)..(335): n is a, c, g, or t
  misc_feature (346)..(346): n is a, c, g, or t
  misc_feature (350)..(350): n is a, c, g, or t
  misc_feature (359)..(360): n is a, c, g, or t
  misc_feature (380)..(380): n is a, c, g, or t
  misc_feature (382)..(382): n is a, c, g, or t
  misc_feature (384)..(385): n is a, c, g, or t
  misc_feature (397)..(397): n is a, c, g, or t
  misc_feature (399)..(399): n is a, c, g, or t
  misc_feature (402)..(403): n is a, c, g, or t
  misc_feature (415)..(415): n is a, c, g, or t
  misc_feature (458)..(458): n is a, c, g, or t
  misc_feature (492)..(492): n is a, c, g, or t
  misc_feature (623)..(623): n is a, c, g, or t
  misc_feature (639)..(640): n is a, c, g, or t
  misc_feature (647)..(647): n is a, c, g, or t
  misc_feature (649)..(650): n is a, c, g, or t
gacggacctaccactgccctgcgtatgtggtgcagcctctcttcaatccctaagaatggttctttcaaagcatgtatttctgaagaaactttagaaccacgttattttaaaagaacgaatggagaaaacaaatcgattaatgctcacagcttcttgggtgctttctcacgggtaaagccatggcatccgtaccttccatnggttgccttctagccagaaatcagtattatcgaaagtccagtgtttcttcagtnagttcttnaactagctctgattctgttaacttcatagatgangaaaaccacagaagggttgnctgnagtggnagaatncanctgggtggttnaacnactcgtttnnccattctgaacctgtgcttncnanntgtgagaataanangannctgtctgctacntggcatgaacagttgattctgacaatcaagatcctctgcctgntgcagtggtccatacatgaacagtccccttcagngccccagtattccaggactcttctccattgtacagaagaccgaaatgttgtctgagatctcatttatgaggacacagatcacaggcagccactgatataacgaagaacgtttaggcatttttctccaacanaagactatcgtggaanntggactngnnacctggtgcatctttgaaaggtgtgcctttaaaaacaagaccccctttaacgtatttgtcttccatgttgtgcttccctaaagtcgcccttacttttacatcatcttacttcacacaccttcgttaacccttctgcgggaggcggaatataggctaacaggtgcaggccacacggtacaggtgacgcattcaaactggcacacctcacacggcg

SEQ ID NO: 631342 - DNA, 349 bp, Homo sapiens
  misc_feature (49)..(49): n is a, c, g, or t
ccagtagtggtgtatatcatcctggccaacattgtgaaaccctgtctcnacgaatgctataaattagctgggcgtcgtggtgcatgcctataatcccagctactctggaggctgaggcaggagcatcgcttgaacccaggaggtggatgttgcagtgagctgagattgcgccactgcgcttcagcctgggcaacagagtgagactctatctcaaataaataaataaataaaacccacaaaaattagttggatgtagtggtgtatgcctgtaatcccagctgttcaggtagctgaagcatgagaatcacttggacccagaaggtggaggttgcagtcagccaggattgcg

SEQ ID NO: 631343 - DNA, 620 bp, Homo sapiens
ggcggtcctgaccttcttggtgtgttggaaccgtgagatccactccgaagtgagatcactagatgatctcgtatcgtcatcttgcacctgctcagagcttacagtcataatgttgctgctactcgaaacgatctctactgttcatcaagaatcgcagaacacaatactaccagaaccttcactgccagtttcaaccgaacaggttattgcttctaacttacaagacaggaagagatcctcacattttacatattgtcatgtaccacttaacaccaggccatacaaaataggtacaagcctgaatgtgatgtatatgtcaccgagtaaggtacgaccactagttttcacatcctttgaaatctgatgcactagataatcagaggcccttctttgtcactgccaaatagtttcttagtccttttggggaaacagggtacatatccataatacattttccgtccctttcatttgcgcagattcgtcataatatacttgaatcgtcaattctcttactgaacttaagccatttctatttcctggaccatttgaacggcatatgcctgctgacgctgcttgtttatcttgcagacaccaaggagcgtccggctcttcttggtgtg

SEQ ID NO: 631344 - DNA, 107 bp, Homo sapiens
acaggaaatagatcgccatcgatctctgttccctgcttttcttcaaaggttttctctgctccagcttctgtcttaacattcactataagccctccctttacttttcc

SEQ ID NO: 631345 - DNA, 340 bp, Homo sapiens
  misc_feature (17)..(17): n is a, c, g, or t
  misc_feature (24)..(24): n is a, c, g, or t
  misc_feature (38)..(38): n is a, c, g, or t
  misc_feature (45)..(46): n is a, c, g, or t
  misc_feature (88)..(88): n is a, c, g, or t
  misc_feature (137)..(137): n is a, c, g, or t
  misc_feature (155)..(155): n is a, c, g, or t
  misc_feature (164)..(164): n is a, c, g, or t
  misc_feature (197)..(197): n is a, c, g, or t
  misc_feature (225)..(225): n is a, c, g, or t
  misc_feature (238)..(239): n is a, c, g, or t
  misc_feature (262)..(263): n is a, c, g, or t
  misc_feature (266)..(266): n is a, c, g, or t
  misc_feature (276)..(276): n is a, c, g, or t
  misc_feature (287)..(287): n is a, c, g, or t
  misc_feature (303)..(303): n is a, c, g, or t
  misc_feature (316)..(316): n is a, c, g, or t
  misc_feature (320)..(321): n is a, c, g, or t
  misc_feature (324)..(324): n is a, c, g, or t
  misc_feature (329)..(329): n is a, c, g, or t
  misc_feature (331)..(331): n is a, c, g, or t
cactaaaggacgaaccngctctcntatactagtatccntaatccnntttattgccacaactaacctcctcggactcctgcctcactcntttacaccaaccacccaactatctataaacctagccatggccatccccntatgagcgggcgcagtgnttataggcnttcgctctaagcttaaaaatgccctagcccacntcttaccacaaggcacacctacaccccntatcccatactanntattatcgaaacatcagctactnnttnaaccaatagncctgggcgtanggccaaccgctaacantactgcaggcacnactnnatngaccnanttggagggc

SEQ ID NO: 631346 - DNA, 215 bp, Homo sapiens
agcggatcccatcgtaatatgtaccatttcatataactaaatataggtcatgaactgtgtaagggcatgcttataggatcagttttaaagttaaattctttgatattaataccagaccaaagaccattttctgtttcctggaaaaaaaaaatgaatccaggttaggctttaggtgagagtaccttttttaccaagtagctatagtggttacatat

SEQ ID NO: 631347 - DNA, 192 bp, Homo sapiens
  misc_feature (8)..(8): n is a, c, g, or t
  misc_feature (26)..(26): n is a, c, g, or t
  misc_feature (73)..(73): n is a, c, g, or t
  misc_feature (141)..(141): n is a, c, g, or t
  misc_feature (166)..(166): n is a, c, g, or t
  misc_feature (183)..(183): n is a, c, g, or t
gagacagngtgtcattctgtcccccnggctgaagtgtggtggcacaatctcagctcactgcagccttcacctnctatgctcaagtgatcctcccacctcagcctcccaagtagctgagactacaggcatccatcaccacgnccagctaatttttgtttgtcacagngacaggggctcattctntcccccagg

SEQ ID NO: 631348 - DNA, 308 bp, Homo sapiens
  misc_feature (11)..(11): n is a, c, g, or t
  misc_feature (48)..(48): n is a, c, g, or t
  misc_feature (143)..(143): n is a, c, g, or t
ctcgtgcgttntggtttctttgagcaaaggagaagttgacaggatgantcgccagcaccctccccacccacaaatcctgtttttggattgttggtgtaccatacttcagtctcccaccccacctcccacacccatcacttctnttctgatgaagtgcttttaagaaaatcatttttgtatttaattgattttaatgttgaactctggaagttgaccatttccttgaattttgggagaaaactccaatagatgtcagagacatgcactgtccagtataactgccactagcccagcatgtgggtatttaa

SEQ ID NO: 631349 - DNA, 126 bp, Homo sapiens
tgagctaacactagtagtctcactctccaagacatatggactagactacgtacataacctaaacctaataccaatgctaaaaactaaatcgtaccacaacaattatataactaaccactagacatg

SEQ ID NO: 631350 - DNA, 372 bp, Homo sapiens
atttgcggctgcaaaattactgggctcagcaggccgggcttttcaccatgagcgccagaaaggccatgctggcacatcctgaggtggactataacctgcagtacagtcattacaacggcacggtacggaaccagctggcagcagaccaggcgcagcagcgacaggccattgcgaaactggctgaacactacggcatcatgtttttttaccgggggcaggaccccatcgacgggcaactggcgcaggtcattaatggcttccgggatacgtatggtctgagtgttattcccgtttccgtggatggcgtgattaatccgctgttgccggattcccggactgaccaggggcaggcgcagcgccttcgcgtgaaat

SEQ ID NO: 631351 - DNA, 929 bp, Homo sapiens
tactgcaacagctcttgcttctgtaaattgttccaaagaagctcgacgtgtaacgttggtcccagaacagatgggaataagtgcacagtgaattggatatggtgaaactgaatgtgcgagtgatgtccgccatacttgagtggagaagttactcactgggtttgacaatccatgaatgacatggagctacttgccgtaaactctattaataaccaggttcggtgacgtagtgctgagaggaggtactcatgggatccgctgacttgatggtcggtggacaacgaagatgtacactgttgagctaccatccatgtgaagctgaggactttagaatgaagtgctactcctcgggatatgaagaggtttactagagaaacacgtcaatggaatttccggacgcgcacactacgaaccctaagaatggaacggccactccaagtgaactactacaagatgacgccggtgcataggcccacatgcgtcatcgaatgcttccatcgcatgctgaaagctacccacgtcgccgcggagtaagccatagggggctcaccatctgggaagatactccatacgatccaggggaaataccatcgaactccttgtcacggtctgtagagagttgtcaatggctagtccgaggattcgtgacttgtaatctatacaacgttggtaaccccatgttctgcatcgcactagcatgaacatagtctaggccgttggtagatataccatgaagatagcctccacgtttggccgcagaaaagagaaccaatgccaaaacctctagcctctagagccatctgcatattgattgatccatgtctagttctacgagaaccaatgggtcagcgagcacccaatcaagaccatgaggtcttgccacccattaagtcccagcaaactcaataccatgtcgaactgaccaaatc

SEQ ID NO: 631352 - DNA, 263 bp, Homo sapiens
gctcacagctggccgtcacttgtgggggtccacgggacgatggtttgcagcttaaagtaaccggatggcggacacctgccccgaggtccccggccgccgccctgctgctgaccagcctgttttaagttcttgatgcatttctctgggtatttggggctatttttaaaattttatatgggtctttttgtgtgatttagacactttttgactcacgtacattttgatgtagtagtaattaccaaaagtacactcctattagtaca

SEQ ID NO: 631353 - DNA, 1022 bp, Homo sapiens
  misc_feature (19)..(19): n is a, c, g, or t
  misc_feature (435)..(435): n is a, c, g, or t
catttttatattttatttnttgccgcggcgtggctttcttttttgtgtgtgttttcttattttattatatgtttttagagaggttaagagtataggtggcgtaggacctattcgtcgatgtgatagtatagtctttatgtttgatcgaagataaattatgataaaattaaatcgcatcgcacacgccccgccccgcgcgcacgagagtaggggagaggggacggagaggaaccaccacaaccgacccaggctggccacgtcaactgacgtgagaggaggagggaagctgagaacgcgcaacgctagataacgacccccgggtgcgcgcggagcgaggcgcgggacagggaaaagaggttgtaagagatggtcactccacttacacataacagttaacatggatttgaatattactttttttgtagttggtgttgngccattgctttccccaatatttatttctcgcttcttcaatcaggttaattcacctcacggagtggtgtgggtggtgtggggtttattgagtgtggcatattcgcgcgccggtgtggtctcatggttcgttgaatttatgcgggcgctcaggttggtcgtgcgcacgtgcggcgcgacgatgagggtagtggtacggcgacaaacgggtgacgcgtacgatgtgtaagcctccgataggacgacgaggtagagtagcttcagcgacgattagatggttcacgcccaaagtccggcgaggacgaatgtggtggatagagtgtttgggtattcgagtttcctctgcacagtcttctccttctactctgtttacctgttctagcggctctgattatctgcataaagtattgtatgaagaacttatagtatgtgttgtgggtggatgttgatggtaggtgacgtattgtggatgttgttgctggttggtctcgcgtcttttcataccgcccttgtaatagaatcgataattaaagtgtatcgttgtgggtgagtttaggttgagtcgtgcgttgccgttctacttgtgcgcg

SEQ ID NO: 631354 - DNA, 425 bp, Homo sapiens
  misc_feature (423)..(423): n is a, c, g, or t
agttgatctctagagtatcccctggagcgtttctcgtggttgggttggggctattcctggtcagtctcgtggttgggttgtttgtattcctgtgtcacgtctcgtggctgggttggggtattcctggtcagtctcgtggccgggttggggtattcctggtcagtctcgtggttgggttggggtactcctgagtcagcttaatgtcccttgactgctttctcccacagccatatttaagcctcagtcctctctgctgcatgggctgttacagcagccaatctggcaaagccttccacatagctctatgtgtcccctgtgcaagtgctgggggatcctgactggcaggctttgaaaggctcgaacttgataaaatgtggtcccccgaccagtggagaagtcagcatcgtcccagaacggagccanca

SEQ ID NO: 631355 - DNA, 437 bp, Homo sapiens
aaggtaccgccaccatttgtatataagtgagagcaactgaatacttctttactgagacgaatccttactgtgagtgaaagtatttcgtcttgaatctgaacaatctgtacatgtactgactatggttagttattgctcaccagtcacatactctagaatacttttagtcagacccagtgactatgaccacagtgatagcagaagctggggtgggcacagatgcttatacacaatattacaaaagacgacattcactggcttagagaaactgatgaatgttcattacttttacatattataaggctagctaacttgaacagttaactttagataaatctacttacacagtacaatcaagtcacaaatactaaaaggtctcatgatctaaatggttactacttcccccaaaaccaaaacagagtgcgggtagcttagaa

SEQ ID NO: 631356 - DNA, 680 bp, Homo sapiens
  misc_feature (35)..(35): n is a, c, g, or t
  misc_feature (64)..(64): n is a, c, g, or t
  misc_feature (86)..(86): n is a, c, g, or t
  misc_feature (89)..(90): n is a, c, g, or t
  misc_feature (93)..(93): n is a, c, g, or t
  misc_feature (107)..(107): n is a, c, g, or t
  misc_feature (115)..(115): n is a, c, g, or t
  misc_feature (131)..(131): n is a, c, g, or t
  misc_feature (150)..(150): n is a, c, g, or t
  misc_feature (157)..(157): n is a, c, g, or t
  misc_feature (179)..(179): n is a, c, g, or t
  misc_feature (182)..(182): n is a, c, g, or t
  misc_feature (202)..(202): n is a, c, g, or t
  misc_feature (221)..(221): n is a, c, g, or t
  misc_feature (238)..(238): n is a, c, g, or t
  misc_feature (258)..(258): n is a, c, g, or t
  misc_feature (294)..(294): n is a, c, g, or t
  misc_feature (338)..(338): n is a, c, g, or t
  misc_feature (349)..(349): n is a, c, g, or t
  misc_feature (380)..(380): n is a, c, g, or t
  misc_feature (426)..(427): n is a, c, g, or t
  misc_feature (429)..(429): n is a, c, g, or t
  misc_feature (503)..(503): n is a, c, g, or t
  misc_feature (506)..(506): n is a, c, g, or t
  misc_feature (515)..(515): n is a, c, g, or t
  misc_feature (524)..(524): n is a, c, g, or t
  misc_feature (529)..(529): n is a, c, g, or t
  misc_feature (535)..(535): n is a, c, g, or t
  misc_feature (549)..(549): n is a, c, g, or t
  misc_feature (551)..(552): n is a, c, g, or t
  misc_feature (556)..(557): n is a, c, g, or t
  misc_feature (559)..(560): n is a, c, g, or t
  misc_feature (563)..(564): n is a, c, g, or t
  misc_feature (567)..(567): n is a, c, g, or t
  misc_feature (573)..(576): n is a, c, g, or t
  misc_feature (578)..(578): n is a, c, g, or t
  misc_feature (580)..(580): n is a, c, g, or t
  misc_feature (583)..(583): n is a, c, g, or t
  misc_feature (596)..(596): n is a, c, g, or t
  misc_feature (599)..(600): n is a, c, g, or t
  misc_feature (602)..(603): n is a, c, g, or t
  misc_feature (605)..(605): n is a, c, g, or t
  misc_feature (608)..(608): n is a, c, g, or t
  misc_feature (617)..(617): n is a, c, g, or t
  misc_feature (619)..(619): n is a, c, g, or t
  misc_feature (671)..(671): n is a, c, g, or t
gaaatattatgctttgttgtttgggagtatatggnggatgggggttattgcggaggatgggggngggggggtaatagggcaagggngcnnccnggtttgttaggggngggtcggngaattgtgtaggcggnaggaaatgatcattcgggnttggtgngggggggggtgtttagggggtnggntggggtggggtgtctggggngcctgagggggtctggtgngaatggtgttaatggcngtaaggggggaatgggggangtgggccgagggcgtctttgattgtgtagtaagggnggagggtgattttagcgggatggggggggtgtgccgaggggggngtttggtgccngtgttcgtgcggggaggggaggtggagggcngcggagggcggcagtgaaggggggcgggatgggggggggtgagganngngtgagggtgggactgtctactgagtagcctcctcagattcattgaactaggtctgtcccaatgtatgggatggnggntagtaagtntgtaattantgtgnaaacanagaatgatatttgnanncacnngnngannttnactttnnnngntnttnctatacttccacnccnncnntnttnccatgttancntttctgggtagagaatgttcgtaatataggctcgccgatgtgtaggagaggnagatataaa

SEQ ID NO: 631357 - DNA, 442 bp, Homo sapiens
cgcccgccccacctcgataatgatattgcacatctcgccagttgatagcgtataacgctgttctctacagttcatgcggtatgataaggccatgcttcagcgtctatctgtagagtcatcccggtcaataaggcttggaacgaatgtgtgggaacagatacatcacatattcttagcatggtctgtcgtaaagaacctagataatggattcacatctgcggtgtggagtcattggcctgtattataaacacttgtgggaagctgtgtgcgtgagtagtcctaggctaagagtactcactgtcatcatgttgagcatggtacaggcccgtatgagttaacaatagtttcatcaggcgggtgtgttggtatggcgcctatagtcccagcaattagtgggtataaggcagtattatagcttgaacttgggctcgtgccgaattcg

SEQ ID NO: 631358 - DNA, 870 bp, Homo sapiens
gccgggacctggcggtcaggaactgcatgctgaatgatgaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagagggcaaactcccatatccgggcgtggagaacagggagatttatgactatctgcgccaggaaatcgcctgaagcagggctgcggactgtctggatggactgtatgccttgatgtcgcggtgctgggagctaaatccccaggagcgggcaagttttacagagctgcgggaagatttggagaacacactgaaggccttgtcctcctgtaccaggagcctgactgaaatcctctatgtcgaacatggcatgacgggtgggaggttactcctgaatcccctggagctgcaggagtgagctgaaccaccctaaatctagcagacctaaggattcctgtagctgctcactgcggtgaggtccatcctgctggacgctatgtctctgccgttccagaaccctagtcccgctcagcctgctgataggggctccccagagacccagggcaggaggatggtgctgagaaaaccctccacctggtactccctctcaggatccaagtaaagcactgccacttggggaaaaatccaacttcccattttccaccccacgcttatccacttggagcctggtttcctactatccaactcattccaagaagtcctccttttgtgagagctaccttgaaggggtccctgcaacgaggtggt

SEQ ID NO: 631359 - DNA, 193 bp, Homo sapiens
tctagagtgatcccagtatgctagagaaaaaggaatctcagaagtagatggaaacaggtttttagtattttgatttgtaaagacaaggtcttgtataggtagcccagcctggtgttcttttttttaaaggccagataaatttcttttttcttttctttttttttgagggggggggggttccaaaatttggccc

SEQ ID NO: 631360 - DNA, 205 bp, Homo sapiens
catctagaggatccttagtgagcaagctggcatgattgctgacattgcaggtatatgtgtgagtgcattaatgtcacctcctcgtccaggtaggtagaggttcctagttgtctggatcagcttgttccctctgtaccaaaggtattgacacattaccattttattgggcaatctcctgcttctgggacctgtcagcttgctcagt

SEQ ID NO: 631361 - DNA, 843 bp, Homo sapiens
agctggaaagtcgttatgtcagactcagctccgctccactggaccgcagtatgtaactgaaaagttcctgatcataaagcgtggtgttgcaagtcgaaagttagcaatgttgggagaattagtggatagatgctgacccatacctcaagtatcgccatcagtgattgctggcacgctgctttcattcagcactctacacagtcacgggacaaagctggctgaatcataatacgaaagactggctataccctggaacgtcttaagccttgtctcatggacctacaccagacgtacctcaaagcaccacagcatgacaacagtcaatacgagaaaggtacaaaagatttcaaagtatcctgcggtgtggtctcctcaaacccaccagagacactaaatctgtaacaaatgaaagactgcccttgtttctaagatgtaaatcactcacagtatatggtgtacagttttaaaccttaggtttaactttaacaatcatttctgaatacagaagttgtcggcaagtacaaattatggtatctattacttttaaatggttcaattgtatatcttggtatatgtatctgtcttagatattggtagttttaagtggtttgtaaagtataaatgatgcagtgtcaggatataattgatttggaaaactttgcagtccaatttacttctacggattgttagacaagacgtacttggtgactcattactggaagtgaaacttcttaaataagaaggttggaaaagcctcaattgtattattcaaagactggccatggggcggggaacacatacagcattggaagttgagaaaaaacacacatgcttgaccgttaa

SEQ ID NO: 631362 - DNA, 102 bp, Homo sapiens
gcggccgcctactactactactactgctcgaattcaagcttctaacgatgtacggggacatgaaaccccaataaatatcctcattgacaaccagtaaaaaaa

SEQ ID NO: 631363 - DNA, 126 bp, Homo sapiens
aagggggcctttcccgggctttttttttgtttttgggggggcccccccccctttgttttgggggggggggggcgttttttttttttaggggcccccccattttttaggggccccccttttttttta

SEQ ID NO: 631364 - DNA, 300 bp, Homo sapiens
gtatcacctagggtcgttctgcggtggtaagccatttaccaagatagttgtaggtaaagaagggcagatttattagagaaattgtgaacaatatgttgcagtgggcagctcagcagagaaggggctacctgcaaaagaggcaagggctggagcgaaagttttatacgggtcctgctagaagggtgctacgtgtggccatgaggtcattgttgcccggcaggttgttaggtgattaggctgtctctagacaattgttcatacaagtaattgttcattatttgttctcaacgttgggggctc

SEQ ID NO: 631365 - DNA, 114 bp, Homo sapiens
agctgggctgccccaagttttctgggggacttgccctggcgcgcctgccttcctccagctctcccccatggccacctgggactactccggctgtaaaaagcatttttaaaccag

SEQ ID NO: 631366 - DNA, 930 bp, Homo sapiens
catatttgggattatgggtggcaaactcttggatttttaaatgggcagtgaacataaagcgacaagaggcgattgaagaagggagtgtatatcgtatgtcccgaactgaatagttgggtgatgcgaagagacttacttggtatatgttgaaaaaagtcgtggatacttagttcaacggtgatgctttttccttaccggttacaggagataaaatgtgatcatccaagagacaggctttccgaagagaagtcctactctatgattggtgaaaaacaaggtgatctaggcgggtaacgggaaagatccttggattttgtatctttgatccgtcaaggggttatagcatttgagtaatgatcggaatgctactatccgcgtatcgtgagacattatgggagtgtgcccataacttacctcgtgtgccagtctaataactatatgtatcttcttgaatcgtagttaaggtatgtaaatgacaacatttataaccggtaatttctttaaagaagtagctttccagggattcagaattaagaagagatagtgataaggaacatgagagatacatttccatcaagtgtaatctaccgtctcatgatgacccacaagccctgagaagtatattcttctaaaagctgacacacacacacagacacagcgggcacagcacgcacaccgacagaatcttaccacacttttgctgtacgtggcagtgttcaccatgtcgtacagtccctactagaatagtgcagtcacgcgttctcagagggcaagacttctgtcggttcaccattatactcacagggcctagcaacttaacaggatgctgagtatttggaataatgacctgttatagaaagaaaactcactattaaaggttagtgtttactcagaattgttaatcttggagatgaatctcttgtgaaatat

SEQ ID NO: 631367 - DNA, 117 bp, Homo sapiens
agaatcgatgcacatactggtttcgaggtgcatgggccatgagccgtgtctaaatcctgtgtgtggaacatgacttcatcccctcacccctgtgcttttgcggggaggtccgttcgc

SEQ ID NO: 631368 - DNA, 91 bp, Homo sapiens
taagagacagtcttgttctgttacccaggctggagtgcagtgcaatcctacggagaatttctagcccattagaagaacacatccatgaccc

SEQ ID NO: 631369 - DNA, 125 bp, Homo sapiens
acgtgagtaaagggtaacctcagaagctacaatagcccatgaaggggaagccccattgcagtcgcaagcctgtccttgtccagaggaattggcaggtattcccggatctagccatgtacttccag

SEQ ID NO: 631370 - DNA, 138 bp, Homo sapiens
taccccttcgcgctacccgatgccgggtcgatccacgatcctgcgctcgggctctctaagacgagctggcgacatgccatcattggcactggtcggcgctgcaccgtacatgactggacgtacccgttgtgacggtat

SEQ ID NO: 631371 - DNA, 938 bp, Homo sapiens
cgtcactgtcgctgttcaccaaggagactaatgggtttcttgtagacagatctgctcaaagggggagacctatagaatggggtttttataagggtgtgttaatccctgggggccactaagggccctccattatgtggggaggccgccccggatgttggttgtgaaccccgccggtactatacctcacacgggcgggtgtttaaaaagagacgccctttctactttttaatacgctgggcggaactacacactgtgcatgtgtgaacggacggtcctcacgaaaatctaaattttttgcggacccgaaaaacacgacgtctctgtccaaaagtaaggggcatccatacatttggcggctcaataagtttaaggccccggtttcctacagccacccctttgtgaaagataaacattcttggccccccactaccctccagggtaaagactagaagttggcaactttgttttggcaagacctcctctcccgttcttgttcacacaaggcaactcctagtgtgagtgaggtgcaggtggtgaagtcacaaatctgggaatcccccccccctgtgagacaaggctacccccgttgcaaccctacatggatgcatgataccgaggcgggttactcccgccccactcgtgggcgaactgcagcaggtctcttctcccgcctccccgcgcggtgttctcctgtgtggttagtcttaccaagtgtcttctcccttgtcctcacgctccaccactacaggtcgtgttttcaagcgaaacgatgagtgtcaacagtagattcttgtgtcgccccttcattttgatgtgttagcccgcgtgttgtgccccaagtggccccggggacatggtgagccagggttttcctgagatgttctgcagcggggcctctcccccccccggaaaaaaaaacttttaaaaaaaaacaaaac

SEQ ID NO: 631372 - DNA, 1426 bp, Homo sapiens
  misc_feature (1085)..(1085): n is a, c, g, or t
gactgcttgtattgacctcttgtctgagcgctctgaggacccacataacgtctcgtcctgtgtctctcgcctaggacttgtcctaactcttcatcctcccccactgggtacgagggtcggtgtcgggctgcctgccagtcttaatcttgtctttctccgggcatgctggcctgggctagcgccgcgcgcaagagctgtaagctcggactcgtacattgcttctagtgattgtcgagtcagctgcgcggccgagccgtcgacgggcgtgggggcgcaaggggctgcgggtacctgttggaggctcttcatctttgtgtgcctctatttgcacgtctccaccaggaccttatgttggtcctttaggtttcgtcgtgcatcaattcgggaggggatccctcgccgtgttgcctcttcgcccgtatagatctgaccatcccttatgttccccttcctaggtctgggagagtcgcggggatgaccccgctatggatgtggcggtccatgggaacgggctactcgttgtgacttctcgtacaataacgcaccgtgtgctcccagttggccgcataaggagaccttatcgtctgtagcgttggccaggcgtttggcctctttagtaacgacacccacggacctattccttcgcgttctttctacatatgcaattggcaatcgcaattggagcgctaacatggaccgacaaaattgggtcttcgtcccattgacgagggaattgcaattgctctagtgggtacaggatgcaacgttatggccattctctggggttcttttcccgggaagaacccggggcagtttgttgcctatgggacctacccttgagtaacccccggacccatttctgcaagatggcgaatttttccttttagcgaaccttggtatgctgtgtctttgtagaccctgtcagacaaaattgcgacgcccctgtagagtgtggacacattttgtgaagggtgttggattccctgagtttacaccatacaagagagtggcgaccgtgttgtgcgggtagcaagtacgccaatttttttctcaaaacgccgactcggttatcgcccccatttatntgggtgccaattttccttccctttttgaccggacctagtgccctaccgcccgggggcctacacttggaaggggctctttgtgtgcacgattgcacattggggatgcagggtacccctagcgggtggctcgacaaaggtctccgacgtcattggaaaccgtttggcagcgcgagtttgtgagcgggtatgtgtgtgcaacatgccgtaagcttgtggtgtcaatttcgaacaagtgtatggtattacctgtatctagtcgagcagcacaaagtgtgtggagtttgtacaaccaattgtgtgtgaacggcagacgcgtcactggagcaggagatatacaccag

SEQ ID NO: 631373 - DNA, 181 bp, Homo sapiens
agaggatatcttaaaatgtaattattatgaagtggaggagaatattaaagtaaaggtggacactgtgaggcacctgtgcggagcgcagagcggaagtgcaggcactccagtgctggtagaaccggagagaggatgagagaaggggcgtaggaggagggagggatgggacacaggtggtata

SEQ ID NO: 631374 - DNA, 882 bp, Homo sapiens
gatgaaccatcgactctcatggcttctggtatccgtagccactgaccgccctcaaccgctgtcctgtgcgcctcgtcgtcgaaaccttgcgcataatgacactcgcgcggctaacacatggtttagttggcgccgtctccatctccatatccgatccgtccgatacctagggccacgtcaagcacaacgcagagataggctcagatcgctcacctcattgtgcgcgtatgtcagcacctgcaagcacccggcacaataacgcttaggactccccaacgaatattgcatgcttggttcgccgcgaagagccttgtctactaacaggtgatataactcgtgagtgcttatttaccttgggaggaagattcagcccctgtgccgatgatacttaatgactttgacgcgcatgtccaccctgttctgaggcccttagggcgcatcatcacgagcagaaggcgatggtcttttgggggaccgtagaatgagcttgacttcgggctagaatagctggtcaccaatgcctctggtcagtaggggacatctgcgagatataatctccgtgtcatgtggggggaagcaaaagcctacgcatgaaatgggacagcctggctattctactgagacaggttggttttcccgaaatcaagtaccaaaggtccagacgcatatcaaacgttgaacgggacttgccgacgtcataagggtccgtcctgtgcctagtgcatgcctggtggttgggcccatttggtctacttgcgcaagaattgcgaacgaccccccaaacgggcccaaggaaagtacagtgagaaaaggctccggaaggcatggcttgaaagtcccaacggttttctgatgccggtggccttccaagcacccgtatca

SEQ ID NO: 631375 - DNA, 181 bp, Homo sapiens
cttagtaggtgtgcatggatgcgcagcaggttagatgcggcaacctcctcggtagtgcccttctcctccaggtagcgctgcacactgctcgatgatggcacacacctggccctcatccttcatgtgctccactgtactctgtgggagtagagggtcagatatttggcattaggggtaccga

SEQ ID NO: 631376 - DNA, 204 bp, Homo sapiens
gacacctgaccgtagggttcgccacttagggttaggatgtatattagctcggatttcagatgggataggaaatcccccagtagcgttcagatgataagatattttagagattttggcatgtggtatgatttctgtgctatcacacatgctcgtgcaggctaaaagttggaagggtggttcttgcttacagggtggttctagttg

SEQ ID NO: 631377 - DNA, 203 bp, Homo sapiens
catctagagatccggcgagtgcatggtacgggcaggcgcagcgactcagcactgacaaggggggagtcgctgggtatcaagcacgaggaacccctggcacaggccaccacaacccaatgcgtccaaatttgcccagaagattggtggctccgagctgctgcccccgtatgcagccagggcagtctattgctgcggagacaggt

SEQ ID NO: 631378 - DNA, 416 bp, Homo sapiens
  misc_feature (373)..(373): n is a, c, g, or t
cacgaggcggccctacgttggcgccggaacgcccgagcgctgccgcacccttcatcgtgtttctggcgggcgaggacgttttcttgatttcgactgggtacaggacgccatcggcttcgatcaagagatcgacctccagaaggtctttgtcgcggtagaaataaaatggcgcctgtttcccccggtgccagtaacttttcagcaactccaccatgacccaggtctcgaatatggctccggagagggccccggcttccaagctctgagggctggaccactgggtgaggtagctgcacaagcccgtgtccagaaagtacaacttgggtgtcttgaccaggcgtttggtgagattgctgtgccaaggttgcagtangtacaccaatccagaagcttcgagaatcgaaaggcagcttttc

SEQ ID NO: 631379 - DNA, 223 bp, Homo sapiens
cccgtcacggattactcaaaacaacagagtatgcattcttctcatctgcatatggcacatactctaacattgaccatacaattggccaagaaaccatcttcagcaaattcacaaaatccaaaatttggatcacagcactcttggatcacagtgcaataaaaacagaaatcaatactaagaaaatcacaggcaggtgcactagctcatgcctataatcccagca

SEQ ID NO: 631380 - DNA, 222 bp, Homo sapiens
ccgctggccactggatctgtgtcttcctcatgcgggcggggacactgggctgccatgtgatcgaactgctcgtcaggaaacaagactccttggttgtgactgtggcacacaccccgcaaaacagtcccctttcttccgccacttctgcttccatgcctgcttgcggaggagcctgctacggtgtgcccggacgcggacggtagtgtttctagctccatgttt

SEQ ID NO: 631381 - DNA, 145 bp, Homo sapiens
tgtacctggggccttgctttactagctagggtggtgagagctgaggtgtataatgttagtgagcctagggtgttgtgagtgtaaatcagtgagagtgagtagtagaatgtttagtgagcctagggtgttgtgagtgtaattagtg

SEQ ID NO: 631382 - DNA, 124 bp, Homo sapiens
ggatttgctggtgcagtacaactaggcttaatagggctcgaattcgactcgaattcgagaattcgagcaactaggcttatagggactcgaattcgagtcgaattcgagattcaagcttctaacg

SEQ ID NO: 631383 - DNA, 241 bp, Homo sapiens
taggaccgtgatcgtagtggtggtgatatgcatgttgactgcagttatttgacagtgatatgtgctatgtacgatcaataataatatgtactatgtaatattaataataatatgtacatgcttatatgcatggggactagcaattaatgcacgacgtacatagggttatagtatattagattttttaggttttcaatgtgtaaaatttttggggtcacatatttgtatgttcggagcagtt

SEQ ID NO: 631384 - DNA, 286 bp, Homo sapiens
catggtccgagagaaattaggatattaaaagtgtacaggtaatgaataatagtggagacagaataaatcgccagtgacttcagagtgctagagacgattagcttcgaaccatattgaggtactggtgctagataaaggacgtagcttgggtatattactgtgatggtaagtacaatggttgtgttgtagaaagggaaccagagtatgaagaaaatcatggggactcaaaagtacaagttccttgaggacatctatacaggcatttctaatttctctcggaccaatg

SEQ ID NO: 631385 - DNA, 470 bp, Homo sapiens
ttttaacccctgcctacgttttcagttctggcaagtgtagggagagcctcctagcagagtccctctagccttcctcgtcggttggcctggaagcgtttctgtgtggccaaagggcggggcgaacaggaggagaagggtgcgcacacggattccttcacccactcgagttctcgcccacctacgtggctggaggagggtgcgcgtgctctgtgggtttggactgagtggtggttaaaccgcatggccccgtgcgtgctcacaagtgctgggctcccttgaatgtacccctaaagagggtacatttcctcggatgaaattttggcctaaaagcaatacagctccctttctacgtacgcatttaaagacatggaaagagaaccccccccccagattttcaggggctcgctcacattttcatcttttttcagttctgtgaaatgggaggatctgaaacggccatgattattaag

SEQ ID NO: 631386 - DNA, 805 bp, Homo sapiens
gcacagagaatatgactcagattatgtaatgagacctacaacaccccggtccatgtacgctggccatccatgccgtgctgtcccctctacatcctctgagcactccactggcattgtcatcgagtactagtgagacggggtgaaccaagcggtgcccatactaggaaggctactccctcgcccccaagccatcctgcgtctggaccttggactggacggtgacctgatgcgactatcacatgtactatcttcactgtagcgagggtacacgcttcgaacagcacggtcgcgaacggcaatgtcattgacgcgacaatcgaccgtagaaagctgtgctacgctaccggtccctgtcatattcgaacatgacattgggacctaccgatcgtagttctctctctactcgtggagcaccaagcttattgagcctgtccgatggctcagggtaccaatcagcaatttggtgctagctgagcggattccacgtgtccgtgaagtgcagctgttaccaagctattcctgtccctgggtatggacgtcttgatctgcaatccacagataactcaagattcaacttccagacattgaaagtgtgacagtggacactccgataacatgaaccttgttacgaccaacagcgtgtgctgtcgaagacggcacactatcatggtagcccgggcataaggcgactagggaattgcaggaaaagtgacgatcaccgggcctgcgcgccccagcaccagtgcaagatccaagatcatcgcacccaccagagcgcaaaggtactcggtggtggatcggtagg

SEQ ID NO: 631387 - DNA, 486 bp, Homo sapiens
gtccgtccgccccagccggtaccagaattgctgattaccctgctgccagccctgctcatactgctgcgccgattcaggccggatcttactgctgtccaccgaagaacagaattgcctgcgctcttcataattacgatgcagtccatctgaaccatctttgttaccgataaaattccagtcaccggtctgacagtcattcatccggctgatggtgctctggcaagccatcagcggcaacaacaacaggaacgacaccagacgacaggcgcgctgaagcaactccctggcagttgatgaggtagtcagtaagacaggcatctggtcagctatggcgggcatacaatcactttcaacggaaggggtgatgacataacgtaaagagtggcacggctgttgacgccgtttcacacattacgttacataaagaggcagggattatcgcattccctgcttgattttccgattcaggtcatcatgtaggcgaag

SEQ ID NO: 631388 - DNA, 114 bp, Homo sapiens
gccaacgatggtcatcagctgaggctgttggaatgagctagaggatctggggtgagctgaggactggtggggtgagctgagcgatgattcaatgagctgacgtatggtgcgggt

SEQ ID NO: 631389 - DNA, 589 bp, Homo sapiens
tcgccaggccccccctcgtttctcggagattaaggggatatctcaaatgttatattgatatttattggccctggcccgggtgaacttcgcggggaagagaaggcgaacccccctggtcacatcttggttcccacacactgtctgcttggcccccctgtggagaccacagctctgcacccgttcttttgtctcttctcacaatctcggcgaaacacgttcgtgagaagtaaacgtggaaggacgggagcccggaaagacgaagaagaagggctggacaatcctgcccacccggtgtcccaggcacacgggcacagggaggggacccacatggccccacaagggtcaaaggggccccagaagtgcaacagctgccaccacgggagggaggttcttggggagatgggcacgtctacggtggcccgtccttggtgagtgcaacacacctgcgcgcaacaacatcgcggccttcctggctttttctggcccccacacgtgtcctgtgctgtagatactgtatcaaagtcccagcgtttagatggttaaacatagagctgcttctgtgtaaactcctgcttaattttaaacacta

SEQ ID NO: 631390 - DNA, 224 bp, Homo sapiens
  misc_feature (29)..(32): n is a, c, g, or t
  misc_feature (63)..(65): n is a, c, g, or t
aaaaatacaaaataataaaatagccaggnnnnggtggcctgtgcctatagtcctagctacttnnnaggctgaggcgagaggcccaaatgagcccaggagtttaaagttacaatgagctgtgatctcaccagtgcactacagcttgggcaacagaccctatcaaaaggaaaaaaagtttcacctgcaaaggtcctagttctgtggactaaagggcctagaggcac

SEQ ID NO: 631391 - DNA, 80 bp, Homo sapiens
gcggccgcctcctactactactactactactactaccactgctcgaattcaagcttctaacgatgtacggggacatgccc

SEQ ID NO: 631392 - DNA, 783 bp, Homo sapiens
atacagatactcaattaaaaaatgggtaaagaatttgaagaagacagcagctgggtgtggtggctcacacccgtaatcctagcactttgggaggccaaggcaggaggatcgcttgatgctaggagttggtgaccagcctgggcaacatggtgaaaccctgtctctattaaaaaaaaaaaaaaaaaaaaaaacaaaaacttgtccaggcgttggttgtgggcccatgcgctggtagtctcaggtattcaggagaggctgaggttgggacggattgcttggagccgtgggagaggtggagactgccggtgagccaatgatctatgccacttgtactcccatgttgagaacccgtgttctcacaacaattacacaaataatttgaaaatgggcaatcaggtggtgaataagcaagtcccacttcgtggatattatatccacacagaatttcaaaggcagaactcttcaaaaaaagaatttgggacattacccagtgttttactcatagcctgtaattcgagcaagtaaccccaagagggtaagaaacaaaccgcagattattccattcacaaagagtaaacgggctctacacgaaacatcgtgtgggagctggggtgcgggggctaccacacctggtaatcccagcccttgggaggccagggctaggctggttcacccggagcctcaggagtttgagaaccaggccgtgcaacatggaaaacccccgctgtttatcaacaattacaagacatcacgctgggcagtgcaagcgtgcacatgtggccc

SEQ ID NO: 631393 - DNA, 387 bp, Homo sapiens
  misc_feature (2)..(2): n is a, c, g, or t
gnttcaggaatctcatagagcactgcaccctaaaaattcttctatgaccttaggaagcaagaaggaccactcctactcctactccacatgatgcagaagcacttccccatcctctttcatggggcaaagctgagtcagtattttttaatgttggaaccaataaaataatgtgaaattcttaaatctcagcactgttcagcatattctcaacattacacaaaatctggctggcatgctggaaaaagaacagaatgataaagaccatatttgagctgtcatcatatagcagcaatgatctatatcatagcagttgaatcataggcctgattgatcattttcatgtgcattcatcaagaaggacattaaagcctgactttgcatccatga

SEQ ID NO: 631394 - DNA, 267 bp, Homo sapiens
  misc_feature (59)..(59): n is a, c, g, or t
  misc_feature (254)..(254): n is a, c, g, or t
tttccgccgctcgcgagacccgcgcatgcgctcgcttctctacctgctgctgcctaggncaactctcccccagcgccagacatcaagagatttgacagcggctatcgagcgacgacgaccgctcacaaggtatcaggactgaaggaaaacattgaagacgcattcccagggattgcaagcttgcagtgacctgctgggggctgtagccgctctgctgcccagctctcagccctgctgctggtctgccctctgcngagagagaaaaag

SEQ ID NO: 631395 - DNA, 180 bp, Homo sapiens
  misc_feature (2)..(2): n is a, c, g, or t
gnttcaggaatctcatagagcactgcaccctaaaaattcttctatgaccttaggaagcaagaaggaccactcctactcctactccacatgatgcagaagcacttccccatcctctttcatggggcaaagctgagtcagtattttttaatgttggaaccaataaaataatgtgaaattctt

SEQ ID NO: 631396 - DNA, 106 bp, Homo sapiens
gcggccgcctactactactactgctcgaattcaagcttctaacgatgtacggggacatgtgtcctgtgtttttgatacaaataaatttgttgtagccaaaacaaaa

SEQ ID NO: 631397 - DNA, 690 bp, Homo sapiens
  misc_feature (2)..(2): n is a, c, g, or t
gnttcaggaatctcatagagcactgcaccctaaaaattcttctatgaccttaggaagcaagaaggaccactcctactcctactccacatgatgcagaagcacttccccatcctctttcatggggcaaagctgaacgaagtactatgccatgaaatgtggaacgtggcttcctgaacaatggcagacagtctgaatgttgaaatgtgaaggtgcaggggaatttgttcaccatggattgaaagttaaccaaacagaaatggcagataggagacagccagacatgcagtttccttctagtccttcagttcttcatgctgatggacacctgcatattgaattatttcatctgaggcaaactacaatggaaaaataaaatcacctgaaatgatgaacagttaagttataaatgaatgctgacaatagaaaacagcacaatgtcttgtgtagtttaaatatatgtagaagtaagatgaatttaacaatgacacaaaatctgaaatggagtaaacacattttgaatgttctctaattctaacattactggatgaactggtagagaaaataatttgtattcaatataataaataaaacacagaaaatgtaatgtctcataatatttagtagaaccagtaaaagaatattgaaagaatgtaactaagaaaccaaataaagaaaaaaattattaatcca

SEQ ID NO: 631398 - DNA, 438 bp, Homo sapiens
agcgggcacacagccatccatcctcccccttccctctctcccctgtcctctctctccgggctcccaccgccgccgcgggccggggagccaccggccgccaccatgagttccagtacaatatacgagcaactacgtcgacctcctacaagcggcgctacgtggagacgccccgggtgcacatctccagcgtgcgcagacggctacagcaccatctccgctcagagtaactccagctactcgcgcgccggtgtcattcctcgctgatccgtgcgccgcagcttactcctccagactctggactcgtcgatgccccacgtctggacgaaactcgcacgtgagcccagagtacccgcacatccagcaacgacctcacagtccatccgccacgcaatgagaaggcgccagctccacgcccctcacctgaaccgcattcgaccg

SEQ ID NO: 631399 - DNA, 141 bp, Homo sapiens
tgttgacggctagaaatacagcctcgcattgatttgacaaggttcctgtcagagtaccaacgtgggtccctcattccataaagcttaagctttgaaaaagtgaaacgccatgttagccaggatggtctcgcatctcctgac

SEQ ID NO: 631400 - DNA, 203 bp, Homo sapiens
  misc_feature (33)..(33): n is a, c, g, or t
ttccccccccccccgggaaaggtttggaaaaanggcccccttttttggaaaaaatttaaagggggaacaaaaccccccccaaaactgccttttaattgtttttgggggggccccccctttaggggacccctttttttcaaggaaaaggcccttttttttttttggggccacccggccgctttaataaaagttttttcccccca

SEQ ID NO: 631401 - DNA, 162 bp, Homo sapiens
ggatctgcgtgctgaggttgtctatgctccactaaggctgattggtaatatgcaggtgcaggagtagtgtccttcgagtttggccagctctgtgcaggtggtcaattctccctgtacgggtttgtagagtcccgtagaggcgacagctgttgtgatgtggcg

SEQ ID NO: 631402 - DNA, 497 bp, Homo sapiens
ggatcacattcgtaccttattgggctggctcaagctctgcaagagcagaaggtggcccaggcccatgccttccaggatgtcccctggagcccctctctgggaaagtgcggcagagctactggccgctgacaaaaactatgggccctcgtgctagagaggccttcgaatccaccatgctccagcccaggaagcaggcccagtgcctgtgcttcccacactgaaaccgacctcagagcaccctgcctcaactgtgagttttttcttggaaatcctctgaaactggaaagggtctcagtcctgagtagggcgaacgtgaggtccattctgcatctccatccaccttagctgtctccttggaaacggacagcaagggagtatgaggtgcactgacacagtcatttctgaacagtgaagagatgacaggtagggtggtcccccttgaacagtcagacagaagtagctgtatctgatgcactaggtggcggggagtgatgggg

SEQ ID NO: 631403 - DNA, 462 bp, Homo sapiens
tctagaggatcctggacgcttcattataacaattcaataatcctgtgacttatatatctaaatatgcccccaattctaagcagagtatgtaaattggaagttaacttatgcacgcttaactatacttaacaagctgtgagtgccagagattgaagagttccaatctgacccagatgttgatgttggataagcgaattctctgctccccaactctaagttgccagcccctaataaaactacctgtggagcaaactggtcagatacatccaccctggagcacgcactcaaagtagaattataaagaagatcatgtccatgttaacattattataaccctacattttgtgcataaagtgtaagtgtataagccatatcaatattaaaaagcaagcaagccgaattaggaattcatcccaatccaaatgcggcatcttcaaacctccatgatgctgcttacatgtc

SEQ ID NO: 631404 - DNA, 391 bp, Homo sapiens
acgttaagtctcagtccaaacagttatcacacagcactataaccaagtccctgggatttactgtcttgatgactacatggctttgccaagtctgagatgcttcagtgtgcaaggaagcagctgggagggcggaggggggtcttcacagggacagctggccagggacttcctgaggcacatcagttacgttggtcaatttagggcacggtctgttttctgcagctttgaaaggtggattctttctatttagcacactttaccaagagggcttgtaaaggattcactcagtccccagaatattaaacaactatttcagaacttcagagacctcttgatcaacagaaccgacatttgggctttaactggtaaagaagctaacctagttagggaa

SEQ ID NO: 631405 - DNA, 178 bp, Homo sapiens
ttggatgtgtgtgctatagagaggttggaaggggtggttggaaggggaagaaactaatggccctctgtgactcgacagctgggatgtatctgcttttgggagcagacatgagtttcttttgcaatttgtcttattgtttgggtctctggcgacaataaactatctcccctgaaaatca

SEQ ID NO: 631406 - DNA, 681 bp, Homo sapiens
  misc_feature (681)..(681): n is a, c, g, or t
ggcgccgcgggggccatggggagcaaggaagccgggagtccgagacccgggcccgcagccgagtgtcgccgcatggttcgccgcagtctgccgcgcgctggtgtcgggcatggtggtggcggaggcgctggggcccccgcgcgctggggaagcctctgcagctgtggacgcctcctgttacctgcgaaagctgggggcgcagaacgcggcaaacgcaatttccaaggaagcgcaaaattcccggggggcaggttttcttcgacttcgacccaagttgcaggggacctggacttcgccattaggaaccaaatttggttgggccggggggcaggaacatttccggggaaatacgccaagggcgggcttgggcggggggcgcgcgaccaccccaacggtcggtgaatctaacagacgcagggaggacccaggggcctcatattccggccaccgggcgcgttcgtggtgggattggcccggggctttgcggacaccaacgcggggtcatggctggagggagaggccccgccaatggggtgggaaaaaacctcccgggataagtccgcggaaagaaccaacgtggccacgagaataccagggcaccaagtcgaacccggccttaaacaagacctacagggacccaaggagagacggaaccccggcacgccagggggggacccagcn

SEQ ID NO: 631407 - DNA, 226 bp, Homo sapiens
cggctcagcgatcctcccagctcagcctcccgagtagcatgggactacaggtgtgagccactgtgcccgcctgagccctcccttcttaactgcttatctatccgtatcattatccgtagtactacatggattcttaattatggcttatgtttttaatagacaatttgtaagagcaatattagaattacagaaaaactgaacataaagtacattagagtattctaag

SEQ ID NO: 631408 - DNA, 352 bp, Homo sapiens
  misc_feature (244)..(244): n is a, c, g, or t
ataaataagtgcaaaagtcacaaatgacatttacggatacatagggcgaaaattagtatctggtacttgtagtgatacagtacacagagtcaagaattccgtgcttttaatcagagttgttgtagtggacataaaacaacacagtttacggccttctgaagtcaagccataataacattcttagactgtcccattagtattttgggacgttgctcgtagaaattcactgaggtttcttataaangggcaaattcagtaagagatcattctctagacaatggttctcaaccatgaggtaccagtccctcaaggaggtagctggtcaatatctggtagacattctatcggttgt

SEQ ID NO: 631409 - DNA, 332 bp, Homo sapiens
ctgcataatgaattaactagaaataactgtgcagggagagccaaagctactgacccccgaaaccagacgagctacctaggaacagctgaaagagcgcacccgtctatgtagcataatagggggaagatgtataggtagaggcgacaaacctaccgagcctggtgatagctgcatgaccaagatagaatctaagtttaactttaaatttgcccacagaaccctctaattccccttgtaaatgtaacctgctagtccaaagaggatcagctttttggaccactaggacaaagccttgtagagagagtaaaaactttaacacccatgctaggcct

SEQ ID NO: 631410 - DNA, 1263 bp, Homo sapiens
  misc_feature (189)..(189): n is a, c, g, or t
  misc_feature (376)..(376): n is a, c, g, or t
  misc_feature (456)..(456): n is a, c, g, or t
agcggggcgtcggcggcggcggcgacagagcgagcgcggcgcggggccaccatgggggcccagctcagcacgtagggccatatggtgcttctatcctcaatctgggttcctagtatcaaggcttgttacattaagagcttatatccattcgcttccgttgcctgccgatcaccctacgattatcccaanactaacaatttagctccatcgactgagtgtctatctgagccaggtataagatcggactttcgtatatggccgcgaacactaacctaccaagatcccctaatcgcggtcaatcccccagactgcatatgcgatataaccgatcccctgattccaattctaagcgatctaaacttatctataattgtgnaccgcgatatataaaagacaagttatagactgcaatttaccatttcctatatctctcattgaaactaccgcgatacgacnctggcttatattataattgaataagatcgagatcaaatgaatcgcgatatgcataccgaagattgaaaccaatcaatttatctttcccagatctctcagagatttatgcctcacagatgagaaaatactgagaaattgacagatgggcctgaaaatatattgcgggattcggataattaataacctgcgcggaaaaattgattggcaaggggggccttcaagaataaatcaaccgaatggttgccaacctcattaaccgtgagaaattagcgaatcgggccgaggactctattcgctagatcaaagaaaaaaacctatatgcgcgaaggcatggcaggaaggcgaagagtattttgaccaatgaaagcagaggacaccgtcttggcaggagacatccaagtcctaaattaccccccaaaaaaacaaacaaatataaaaaccattgacccaacatagaacgaaaccctaatataagaacctatcatctttatttttgctatcccattctccaaatattcccattcttcataacccagaatgaggataaaccaaactctgattcgactattgctataatcgatatttttgatctaccattaaaactaatgctatactctaggcggcgcattcgaaggctaccatagaacaccgcctaattttggctaaatcccccttagaaatcccattgggagcacattccataagccgccttgggaaaattacactacgaattccgtgcagtcactctataccaccccccaggataaagataggcctttataagtggaacaaattattccccccatc

SEQ ID NO: 631411 - DNA, 287 bp, Homo sapiens
ctgattcccctaaaaatcctggatgcttgtaatgctatttacaatggttattttgtgcttactgatgtgcagacattttttccaacccattcttttttttttggagaatgaagtttggctctaatagcccaggtggaagtgaagcggtgtaatcttagctccctgaaacctccgccttcaaggtacaagcgattctcctgcttcagcctcctgagtagctggaattacaggcatttgccattatgcctagctaattttggtagataaacgggggaaacagggggaac

SEQ ID NO: 631412 - DNA, 456 bp, Homo sapiens
catagggcctgtactttcgtgttgtgatcgaattgttgccactagcattacagtatgacacagtaaatcatctggtaacagctggtctctgtcacacagggttagacacagcacgtattggtagagatcctgaataaagaactggcagttagaattccgcttcgaattgagtgtgtcctgaacggtactggaggtgtagctctaggagcccacgtcaatctcacagtatagattgttctctccagttggttggcagacattcaaatctgtagcttcaatcacatgcaccatcaggcgctcaacgcctgaagtcttatgggagcggagcttgcgtaagctttcgcacgcatcttcctctcggtgtccatgtacagctcagaagccacagagatcttgtacacacagacggtcctctcattactgtggtctgttcgcagggtgtagacccgttggtcc

SEQ ID NO: 631413 - DNA, 238 bp, Homo sapiens
  misc_feature (7)..(7): n is a, c, g, or t
  misc_feature (26)..(26): n is a, c, g, or t
  misc_feature (37)..(37): n is a, c, g, or t
  misc_feature (70)..(72): n is a, c, g, or t
  misc_feature (100)..(100): n is a, c, g, or t
  misc_feature (103)..(103): n is a, c, g, or t
  misc_feature (108)..(108): n is a, c, g, or t
  misc_feature (132)..(132): n is a, c, g, or t
  misc_feature (140)..(140): n is a, c, g, or t
  misc_feature (149)..(149): n is a, c, g, or t
  misc_feature (189)..(189): n is a, c, g, or t
  misc_feature (198)..(198): n is a, c, g, or t
  misc_feature (204)..(204): n is a, c, g, or t
  misc_feature (210)..(210): n is a, c, g, or t
  misc_feature (233)..(233): n is a, c, g, or t
gattttnagccacacatagggttggntcttgagagtnacctacagaataaaagtacttttaaaataaaannnaaaaaaaaaaaaaaaaaaactcgaaatncanaagcnactcattgacttgcacagtccttntgagattnttaagcagnttacttccatcagtattgagccaggagttgaggtggaagncaccattgnagatgnttaagncaactattttaataaattgatgnccagt

SEQ ID NO: 631414 - DNA, 159 bp, Homo sapiens
ctgctggcccttacgcgcgccccccgtggaggcgaccacccattcgaacgactgccgtatcaactttcgatggcagccgccgtgcctaccatggagaccacggcagacggcgaatcaggggtcgattccggagaggcagcctgagaaacggctacggaa

SEQ ID NO: 631415 - DNA, 201 bp, Homo sapiens
gacgagaaaaggaaatggaagaggatgaacgagataggaagagagagaaggaggagcttgaggaaatcaggcagcgcttctggcagaagggcatccagatccagatgcagagtccagaggatggaacaagaggctgagaggcgcagcagccacaaataaagcaagagccagaatcagaagaggaggaagaagaaaagcaag

SEQ ID NO: 631416 - DNA, 1235 bp, Homo sapiens
agcgggagggggccgtggagccgcgaagtggcggcggcggcgacgacgccggcgggcctggcgcgcggcgccgctgtggctccgttcccgttcccgtcccgcgtcgaccagcgaacgcatcgatcatcccaacggggcggagacggagacaggagagagagagatcatgcaggagaaagcatgtgttgatctcccgcaaagggacagtgagagagggacacgacggaaatccggatgacaggtacacaagaggcctgatagagaataggccggacgtgtagatagtagcgagaggtaacagcggaccgacacggggaaccaggggccacaaggccgcggaaaaggcaggacgacagggagaccaagacgaggacagaaacacgacccagcggcagcacagaacgaggaacacacacgagacttaacacacaagaagaaactaggaaagagtaacaatagagaagacgataagataagagtgtacagttagggaaagggcgagattaaaagcgtggggggagaaaaaaagtaagcaggagatgaacggggtacgaggggaatagggagtgggaaaaagattgtaaaacatatggggaaagggagaagaacggggaacagttgtatagagagccagagggggtggtagtgatgatccgacggaagagaactagagacgagcaggaggacgagcagcaaagagacgccccaaaggggcagcaagggacagagcagagaaatgcagagaagttgtgtggggcagacagggcacaagcaggaagagaaaagagttaagcgagatgcgcgagcgacgtccatagggagaccagccgagatgcccgagtaacagaacgggggaggcagtacacagaaccgcaataggggtgcagcagggggggctaagcaacacacggcaacagtactcacaaagaaacaacagaggtggggagcaataatgaggcacagaattcacaagacagtatgcagtgatcgggacaccaacaataatgggaagatagagtctaacaacgagcgcaaccccgacatacacaaatcgaaaggggagcagatagacagaagacaaaagcagtaagaggcacagaccagccacatcaaaatctggaggcaaacaaaagcatgtgcggagtgaccacacaacaattgcaaaacgagacagccacacgtaggatgatagacacagcagacaagggacacaacgagacacaacggaacgcagg

SEQ ID NO: 631417 - DNA, 427 bp, Homo sapiens
  misc_feature (262)..(262): n is a, c, g, or t
  misc_feature (285)..(285): n is a, c, g, or t
gatcccacaagagcattcaagctctacagcagcatgggcagatctttgatgtaaccgtgctgcatgagtctgtctgataagaggtaagggcaggttctctctgtctggtggatctgtacaggctggggaacacccacttccagctttgctgaagatctactcaaacctgacctttcctatcaggagagatggcttgtctctgcctgaagctggccagttcagtcccttattctgcctgttggaagcccctgcttgaaccctnaactattgactgctgcagacagnttatctccctaaccctgaaatgctgtgagcttgacttgatcccaaccctaccatgctccatcatactcaggtctcccctactccttgccttaggattcctcaataaagatgctgtaactaggcatttttttgaattgccctt

SEQ ID NO: 631418 - DNA, 545 bp, Homo sapiens
gcacgagggagagtctcttttttttttttccaatctttcgtgtggtttcctggcagtgggggagctactgaaaaaggcctgtccacattttagctggggtttctcctacctctttagcttccctgtcaaagccccttgcccttcctcggggaacttcagggcaacatgggttttggaggaaactgcaatttcttcagccttataattgttccgctttttccaagcattcccgagggctggtcttctccattgttcaatcaaagctcttgcttatccccctggccctaaagaccaaggaaagcattggctttccctccgggaaagatctctttttactccccttggcctgggcctcttccgtctcccgtcaggccctattcgaatttcaggtttttgtcaccctttgtacctctggggggtgtccgggtctataaccaccctaatcggtgtttcttttccctttattaggatgcccccatacttccttttcctcggcacaatttggtctctgggctcatccgctaatgtcatatcctgttaacccg

SEQ ID NO: 631419 - DNA, 174 bp, Homo sapiens
tgaaggtggtactgataacttcttgcttcagttcatctacaaatgatctttccctcgtaaatcccagatcttgatgctggggactgtggaagcacacagccagtagcggtctagggctgaagcacagatctgttgactgatgtccccaccaatctagacgtgtaaacggtgttt

SEQ ID NO: 631420 - DNA, 472 bp, Homo sapiens
tgtggtaaaaaaggggttttttttttttggggcgtcttctcttattttcacaaaaaaacagagagaaaaaaaaaaaaaaacacccacaacacaaaaacacactccccacccccgggggaacaaagagaataagagagggcagacggggggctgagacacaccccttgtagtacagacggccttcaaaaagcgagaggcgcaggagagagagagggcgaaaacaacacccgataacacacacccgcgcgagaggggaccaccgcgagggggaacacgaggtgcgccccgcgcgggcggggaggggggacacccccgcggggaggacccttattttagcggggggccacaagatttttcccacaatatatttcacctcccctatccctataactcgatttctctccgggggagaaacgtcttctccccccgcccccctccggagggggggcgctctccctcctggagaaataaa

SEQ ID NO: 631421 - DNA, 209 bp, Homo sapiens
agatctggccagctggaagcctgccacctcctatgtgctggaccaccatcaacaatgaatgctctgctgccactgctcagcagcatcagacacatgatcctgcaagaacaatgtacctgccccgacctgcgcatggcagccatcctgcagtggccagcgccatcctgcgcagccagaagccttgtgattggtgaagaggaagctggact

SEQ ID NO: 631422 - DNA, 857 bp, Homo sapiens
atgtggagagcagtgtggcgattcctcaaaggctaaaagcagaataccactcaacctggcaatcccattgccgggtatatgcccagaggaatataaatcattctgccataaagacacatgcacacaaatgttcactgcagcactattcataatagcaaagacatggaattaacctaaatgtccatcaatggcaaactggataaagaaaatgtggtacatatacaccatggaatactatgcagccataaaaaagaacgagatcatgtcctttacagggacatggatggagctggaggctattatccttagcaaactaacacaggaacagaggaccaagtgccgcacgttctcacttataggtgggagctaaattgtgagaacttatgaacacagaaaaggaagcaaagacagtaggttctacttgagggtggagggtgggaggaggaagaggagcagaaaaaataattattgagtaccaggttaatacctgggtgatgaaataatctgtacaataaattccatgacacaagtttacctatgtaacaaacattcatatgtattcaaactaaaataaaaatttaaaaaacatgttcttattaataatttagaagaacgtagtatagatgaaaagttaaaaaataagtggaatctctacagtagaaatcatcttcttcaaagtgacttttttcgtacatcatctatgcaatatggagttgccaggggacttgggagagaaactcacggttcaaaacagtttaccatgagccttgctatgtggggccactttaaggaagccttgggggggggggggaaatgcgaatatttggagggtggtgtaaaaaagggggaagggggaa

SEQ ID NO: 631423 - DNA, 1040 bp, Homo sapiens
  misc_feature (401)..(401): n is a, c, g, or t
gatagcatctcccccctcctagtgagcaggggcctgcagggcatcactactccagcccctcgcccttctagtggcaccctcagtcaaaggggcaggtgggtgacacttccaagtggggcagctctcctgctacatgcgccccacccccatgagtccagttcagccctatctgggcggctgagcagggggaaatcccggtccattgtgtacatagctctccattgggtatgtccctgtcccatgtaggcgcaccaagcgccacttttgccatgactcgtccctttaaagtgcgctagtagtggtgcccatgccatagtggcacatggcccactaagctgagtgctggggtccccagcagcaaagactggaaggtctgtgtatggtatgtcattcgctttgcnttcgccgagcccccttgatttaacttgtggggagtcaaacggggagtgccccctgcggtcctctggtctgttcagacggtgctcgctggcgctgcgtgaatgacgccgatgggccgagagagtgcctggggatctcgaccttcgtgagttgttggtgaccgtggctgagggtggcctctcgtatccccgggagacgcgccaatggttgcatctggcaagcgccgtactcaccgactccgtgccgaactacggggatagaggttcgcgcggcgtaggacacctgtcatgaggagcactggcaccgaggtgaccgcacgctgtggaatcttattaggcccttcattcttgccacccctgattctcttgaaactctgtagaatcacataacgccccgatttcaccatcggttctactccgttggtgacccgtgcgcgccgattcggggggcactgtgctcctgcgcgttcggcgttgggaggccttccggccaggggaagacgtggtgggattgggccccccccggggggcccccgtgattccctgtgttgttgcttgagacttgttgccacccccgccgggactcctgggcagtggccggaccgcgccataaactgttggcggtgttcgggtccccctttg

SEQ ID NO: 631424 - DNA, 92 bp, Homo sapiens
agttcgaacacttttgttttttggggttttcttttcctgacatacaaagattctactaaaaacaaaccaaacaaacacaacaaacacacaac

SEQ ID NO: 631425 - DNA, 164 bp, Homo sapiens
agtggccggtccacacaaaatagactacgaaagtggctttaacatatctgaacaccaatagctaagaccaaactgggattagatccccactatgcttagccctaaacctcgacagttaaatcaacaaaactgctcgccagaacactactgagcacacatggtgt

SEQ ID NO: 631426 - DNA, 296 bp, Homo sapiens
accccggcaactgcttcggatgtgtttaggagggcactggctaccaacatgcgtcaccctgctaaatcgagtataagtcccactcctaaacacatccgtattactcgcatcccgagtctcaatcacctgagctcaccatattccaatagaaaagagccgaaaccaaataattcaagcactgtttattacaattttactgggtttctattttaccctcctacaagcctgatagtactttgaggttcccttaaccatttccgacggtatctacggtttagcattatttgtagccacag

SEQ ID NO: 631427 - DNA, 505 bp, Homo sapiens
aaattaccaagtggaaagtagtaaataactatgtaaactagaatcacatgtcaggatctaaaatcttcggacaataatgtgttcttttttcctacacattttgggaactccctcagatttaacatcaattaaataacctagctaaaaccttgaactcttatcaaaacgaggtagggtggtaaaataacaataatttcatactcatagtttttaaaagaataaaacaacgtgattagacagacatttcacaatttttggtggtcatgcaatttgggatacagccattcgtgcagtggattcacaaagttggcatagagaaatataagtttcctaagtggaaagggaagattataaaagagggaaggagaatgagagtaagagattggttaaagatgcaaaggatttccacttcttcatggtaatgtaaatgtgtctgcttttaaaaaagcacaagcacggaaaaatctattgggataatgccttcactctatgcaactatatctga

SEQ ID NO: 631428 - DNA, 112 bp, Homo sapiens
gattactggtggtcattatgatgtagattgtcgattagaagatcctgatgatggaatctgcctgtgtttcaattcacggaagcttttaaaggtttttcaatcgaataattaa

SEQ ID NO: 631429 - DNA, 546 bp, Homo sapiens
  misc_feature (29)..(29): n is a, c, g, or t
  misc_feature (59)..(60): n is a, c, g, or t
agaaacaaaaacagccccccacaaaaatnttacacaccccctcctctcccgctttctcnnaaaagattaatgtggcgcgggccccacaaaaaaaaaaaaaaaaaattcctccacgtggtcttccaaaaaaaaggggggggggtttttttttttcccccccctttgtttataccacctcttttttataaaaaacaacacagagggggggaacacccccacagaaaaaaatttcttttaataatagggggggcggcgcgttttttttacaaaaagaaaaaaaaaaaaaaaaattttttgcggcggcccccctccttttttttttaaaaaaaaaagaatttttcttttaaaaggggggggggtttataacccaccatcaacaaaagggtgtttttttgtgtggggggaaaaaaggcgcttttttaccaccggggggatctccccccgaaagaggggcgccccccccccgggagaaaaaaggcgctaaaaataaaactttttcaggtttccacccccccagggccaatatttgtaaccggaaaaattgaa

SEQ ID NO: 631430 - DNA, 234 bp, Homo sapiens
taattgcaatttttgttaaagcaatgttattttatttaatgtcttaggaagtcctaagcaatgctcaccgctgaatgatgcgttgcaatatctacaagttcccccccacgcgccaccccttctaactgtaagaatagcagctttctaacattactactttggagaaaaaaaaatgcctcttaaaactatgttgtatttataaaatggttctttataaaatcttttcagagaaat

SEQ ID NO: 631431 - DNA, 219 bp, Homo sapiens
cggtcatgctcactattgccactgagccaagctgaacaggggctcgggccataaggtgttgccacatgttggctgcaggctccagtgtaaaagcgggccgtataggtgatggggggcagtcgagtggttgggctggggtaactggtctccaccagcaccttctcgttgtacagagagatgtcaggaaaagactctgcggtcaggtgcacgtagggctgc

SEQ ID NO: 631432 - DNA, 400 bp, Homo sapiens
cactcgtcatggctatatacataaaagcatacaataaccaatgtcctgatatgcaatctggatgtgcagcatttcagcaacacataaaagaaagaaagaagaatggaaaagcaaagacgaaaaacacaccacaaagtccaaacctcacgaaattaacattcacttaagaacacagtggtgaagacttttggtagcaaaatttgcacggttcttaaaatgggagtcttcaaaagtacttcttcaaattcaaaagctaagaaaaccaaagagggaacagttacacaggcttagtggagatgccgcctgtcatgaagatgaccatcagtcctacttcccagacacagtgagaaccggtgagcctgacgaacctgaaggaaaaggccggctgacgagtgcccag

SEQ ID NO: 631433 - DNA, 166 bp, Homo sapiens
aatgtgatagaatattcatttggttttgatgtgctagagaaactggtacacattataaaatgtatcagctgacacaaccaaaaccaattggatatctgttaagtgtatatatctggagtagcatgtgagactagctttcgatttaggatatataactcatacttac

SEQ ID NO: 631434 - DNA, 158 bp, Homo sapiens
ggacaataattaaccatcacggacctctttacaaggataggttccaaatccttcgtgctgctcattggtcattacagtgactagcatgttttggacccataagccatccaagatgagacaagtgctgcagccatcacttaagctcatcacctagaatg

SEQ ID NO: 631435 - DNA, 949 bp, Homo sapiens
ctattccatttattgcccatctctatgatcaggctgtaatctccctgtggaccccgaagtaccaacaaattgagacttgacacctgggatcacatctccaaaattgccttattgtttgtcacccagatgatcccccaagtctacccactttgttaaggtcttcaaaaccttatgaaaaatcggcgaacccaaatttgttgacaacacctgcacgcaatgaattccccttgccagaaaaccatacttaaccctgcctcatgaacacaacttatgtggttgtgcctattaggaaaacaccccccttatgcgcagattccccaaagcaggccagacggaatcctctgtgtaaaaacagcagcaccaagtcgttccaacttctgtattcgatgtgaacaaaaccggttctccccacagagttttactcgtgaaccaacccctccccctctcccctgcatgatttatatagccgcccccccttttctgagtaaggagaaggaccacattcctagagcacacactcgccccttgtgttgatgcccttgttgtaacacaccagccccaacgcgctccactaaagaccccaccttgaaacctgcttttttggaatgaagtttctcccagcgttttgtatagaaaaatcttgcaaaggctgaccgatttaaggaaacccctctcttttccccagggaagggttcaaaaacttgtgttctgcacaatccaaactgctccttatggcattattatacacactcctactgtttatagcaattctcccaccctctcccccttagtgagatatagagataaaaaatattagactcacaaaccttaattctaatcctgtttttcttttttctattggtgttaaaccaccaccacccccgttttaaaaaaaaattttttttaaccttttccctttttttttttggttccaattttaaaaaaaaaa

SEQ ID NO: 631436 - DNA, 406 bp, Homo sapiens
gagacgagatctcatacttcacttcttttcaatgagaatcggagtggtcttttgggtttttttcccccttttaaaatccacagtgaatgtttcaaaggagggatagaaatgcttcttgagttcctcagagacttggcaaggtagacctcatagcaaccttgaatatgactttctttagtctctagctatgcactattaagtgcctcttgggtagaggtagagttcagtattggggtgccagtcttggacgtccggtatgcctcagtttttctccatattattaaaaggcagtaatacatacctaccctttatctacctacatcattgtgtggtacgggattaacatcgcgggagagccattctgaatgcctattaaatttccttgaacgagatctaacgaaatcct

SEQ ID NO: 631437 - DNA, 294 bp, Homo sapiens
  misc_feature (28)..(28): n is a, c, g, or t
  misc_feature (230)..(230): n is a, c, g, or t
  misc_feature (278)..(278): n is a, c, g, or t
taccatcgtggctcgctgcaacctccgnctcccaggagaattgcttgaaccctggaggcggaggttgccgtgagctaacattgcgcccctacactccagcctgccaacagagcaagactccgtctcaaaaataaaaaaaggatctacttttgagaatactgtcattggttgataaaatacagcagaaacttgtgaagaagctattttccatattcacctgggcatgtttnggagatgattgccatcaactttgttgactgtgaagggagaaacctttntgccacccaaaaactt

SEQ ID NO: 631438 - DNA, 360 bp, Homo sapiens
gctttcttccagctggaggccctggacaccactcccacgagggacgtgacaatgaacgtggccgccttgcagccccccgtggtgcagctgcacgatcagcaacccctacccgcggcgggagcacccccaagcccgaccgcgcggcctggtcgggcagatgactatccatggcctagcccatactcgactgctcggagcccacgagaccgtagggctaggacgccacgcgccgaggagcgccgtacggtgcaccttgtagagcgggcgcggaacctaaaaagcccaaaccaggcacaaaaggcacccgagacatcccatccgggtggcaccaccatgggaagagcgaaaaaaggcaaccaa

SEQ ID NO: 631439 - DNA, 854 bp, Homo sapiens
gccggccaagggtgctcgagtccttccgaggaagctaaggcatgcgataggggtgaggccctcacttcatccggcgactagcaccgcgtccggcagacgccagcccgtacactcgcccgcgccagtgggctctgtctccgaggctcgcctgtcagtctaactcgggcctcattctgtcacgacagattgaggtgacagtcacggaggataagatcaactgccctcatttaaatgcagccggtgttaaagtgttgaagcctttttggcctggcttgtttgcaacaggccctggccagcgtcatagcatttgggacgcctcatctgctagtgtacggggccggtggacctgctccaggcagctggtgctgcatccaggcaggaggtcctggccccctgccagctgctgctgactccagctgacggagaacgacacacgtggaagactacagaagacgacagcaatccgagggacgtctgattgactgacagtgggctcttggatctatggatgatctaaagcgctcttttagtaaccagtgttgcacatacatactggcgtgagactctgtaggagagtaagaatgccacaccaaaatcatcagagcaacatcgaccaacgaatcagtggggcagtaactattcccggggcgcgcggtgatgaacggaggctcgggctccaggagggaccccctgaggacggaagcctaggacacaacgtgaccccgcgatctctacggcacggatccgacgggaggaggaacaccacaggcggggtgcacccacaaaaaagatccggggcccgacgggtcggggagcctgatagaggaccgaggggcaccccgggagcttgaggc

SEQ ID NO: 631440 - DNA, 187 bp, Homo sapiens
ataaaaaaagaaattattcatgtgtgagtggatgcaactgtcgtcctagctacttgagaggctgaggtgggaggagatgacctgagcccaggagtcaagactacaggctgcagtgagctatgattgtgccactgcactccgtcctgggcaaccaagtaagaccttgtctgtaaaataaaataaaata

SEQ ID NO: 631441 - DNA, 116 bp, Homo sapiens
gtcaaagctgatgagcatgtcattgaccaggaggatatggagcacttttatgtcatgacggggacttattgccaattttggtacaaaaggttattcaaacccgctctttttggcaa

SEQ ID NO: 631442 - DNA, 245 bp, Homo sapiens
  misc_feature (42)..(42): n is a, c, g, or t
acatggtagggatactactacaaaggcattcactagctttanatacaggttactgttgatccccgacttttttttttggtttgtttgtttgtttttggtttttgtttttaagacagcatttccctatgtcgcccaggctggagtgcagtggcatgatcttggttcattgcagcctccgcctcccaggccgaagtgatcatcccacctcagcctcctgggtagctgggatatgtaccacagatagg

SEQ ID NO: 631443 - DNA, 548 bp, Homo sapiens
tactatcaatacttaatatttacttttcctggttttagttttcaaatttgcaacggatgctatttgcatagaatactgatggctttaagtcttaaaaacagaaatctgactgacccaaggaaaaggatgaaagaaagagattttgtccctttaaaatcagccaacacatcctatcttagtactgaagtacttcccaattctggcagaatgggctccttggccacctgcttgcactagggtctgactagcattttattaacatccaactgcagttaccaggacattcattaccactgcttgtacaaagcagaattctttttaaatttttttcccatacagatttcatcaccaggtgtcaaaagacaaaaccgtggcctgaggccaaatagaaaaatgtcatctccacaaataaggagaaaagacaaggactttaaaaaatcaggtcaacaagcccattagccaataatagtttgtaaactggactgtcttcacactagaggctgtgctagcaaatgtggtccttgaaacaagagcttagagcttgaatg

SEQ ID NO: 631444 - DNA, 226 bp, Homo sapiens
agacaccgggatagagaacgggaccgcaccactcagataggagtctcgttggaagcaaatgtcattctaatggacttgcatctcctcaccttcatcaggactaaaggacggagcgtacccacccttccttcctccaaacccctaacttccgtcccagacaaccagggaataccctcgaccccacaggattaagactgctgcgatctccaatccacactctgtttca

SEQ ID NO: 631445 - DNA, 110 bp, Homo sapiens
gaaaggagaaccgggaatgcccatggacattgtcaataacctctgggccgccttcttcatcaatcaacaagggaaaattacacttgaggttgaccattgtgacctccaga

SEQ ID NO: 631446 - DNA, 368 bp, Homo sapiens
  misc_feature (1)..(1): n is a, c, g, or t
  misc_feature (349)..(349): n is a, c, g, or t
  misc_feature (368)..(368): n is a, c, g, or t
nggttaaggacatgcctgtgacagcctcaggaagtcctggtggcaggtgccaaggagttggggtacagcttgcttttatacattttagggagacataatatatcaatcagtacatgtaagatcttattggtttgatctgaaaggatgggataactcgaggtggggggcttccaggtcataggtagatttaaccatattctgattggccgttcgttgaaagagttagtggaatgtgtgggttacaataaggagttgtggggagaggtaggttttatcatgcagatgaagcctccaagtagcaggctttagagagattagactgttaaatgtttcttttttagacttaagntccagtatttgatgtttan

SEQ ID NO: 631447 - DNA, 819 bp, Homo sapiens
ttgtattgatagcggatggctcttctatgatatgtgctttcgggctctgtatcttacctatcctgactacgggagatctgaaccaccttgatcatcagcacaccatgaggtggtgtcaccaccatgctctccgtttccctggccagctcaatgctgacctccgcaagttggcagtcgaagcatggtccccttcccacgtctccatttctttatgcctggctttgcccctctcaccagccgtggaagccagcagtatcgagctctcacagtgccggaactcacccagcgaggtcttcgatgccaagaacatgatggctgcctgtgacccccgccacgggccgctacctcaccgtggctgctgtcttccgtggctcggatgtccatgaaggaggtcgactgagcagatgctcaacgtgcagaacaagaacagcagctactttgtgcaatggatcccccaaaaatgtcaagacagccgtctgtgacatcccacctcgtggcctccagcatggccgctcccttccttggccatagcacagccatccaggagctcttcacgcgcatctcggagcagcttcactgccatgttccgccggcaggccttcctccacctgctacacccggcgagggcctggccgagcatggcgttcaccgaggctgagagccactgaccgactcgtctctgagtatcagccgctacccggatgccccgccgcacaggcggccgcttcgcgtgcggacgccgcgaggacggcctacggcaacagccccatacctcacgcttccagcttccctcccactcttactccactgccctttccg

SEQ ID NO: 631448 - DNA, 632 bp, Homo sapiens
accatcggggccaaatagcgccggctatgccctgtattggattgccaccggctcaccattgcatgcaagtttgttgagctgaaggaaaagattgttcccggttctggtaaaaagctggaagatggccctaaattcttgaagtctggtgatgccgccattgttgatatggttcctggcaagcccatgtgtgttgagagcttctcagactatccccctttgggtcgctttgctgttcgtgatattaaacaaacagttgcggtgggggtcatcaaaacagtggacaaaaaggctgctggagctggcaaggtccccaagtttgcccaaaaagctcagaagggtaaatgaatattatccctaatacctgcccccccccttttaatcagtggtggaagaacggtctcaaaactgtttgtttcaattggccctttaagtttagtagtaaaagcctggttaatgataaccatgccttggtaaaccctccaaaaggaaaggagaatgttttgggggcccctttggtttttttttttggggggggcagttttaagttattagtttttaaaaccaggcctttttaatggaaacaacttggccaaaaatttgtcccagaattttgaggccccttaaaaaagtta

SEQ ID NO: 631449 - DNA, 210 bp, Homo sapiens
tgattactcccggccgatttgtgctccagatctggcctagatctgccgaacatccaatcctgcctctgggatgcaagtcctgccatcctaatattgtcttagaaaagcttagcgccttccttcacaagtcagcagcaagtctacagcttctcatagttgtacatcagagtcacatccattcttggttcgggctgctgtcgggaatcctct

SEQ ID NO: 631450 - DNA, 415 bp, Homo sapiens
aatcctaaggaaaaaattcaattgtaaattggatcatgataaaccaagttactaggtaacttcatgctgctctacagcacccagctgaggacctacaagcctggcactcccccccccaccacagagtagtgctgtgcagagtacttagaaaaccttagtaccgctactgtaattttatatgaaaatatgtgtatttttcaataaagcacttataaattagtctctgtttagttatattgaaaaggagcattactttcctgcataaatgacaatcaatcatttattggtttatttcatctccactaacacatcagtcattcaccatttaaatacctgacttcatcagaaaccgtttgaacacttttttcttcttcctgccataaaaatacagtaatttgccttaaaaaaaaaatta

SEQ ID NO: 631451 - DNA, 418 bp, Homo sapiens
gttgcccgggctggagtgcaatggcgcgatctcggctcaccacaatctctgcctcccaggttcaagcaattctccgtgcctcagcctccggagtagctgtgattacaggcatgcaccaccacggcttggctaattcttgtatttttcagtacgagatggggagtttcaccaatggtcgggtccaggctggtctcgaatctcccgtatctcaggccaaggcggtgggaccgaagttacctctggagtatgaaaataagcaacaccattattgacacaaggttcgaacatacacggcaaaacgcttttcctctgggcgcaacaagggttcccacaaaaaccacggttccccttgccattttgcgacacgggcttaagatggcttaccccaagttacaagccccaaattttcaaggggtcc

SEQ ID NO: 631452 - DNA, 835 bp, Homo sapiens
  misc_feature (331)..(331): n is a, c, g, or t
  misc_feature (366)..(366): n is a, c, g, or t
  misc_feature (403)..(403): n is a, c, g, or t
gatgagcatcgatgcttacacaaaatggttgaccgcctcgcatatagttagtcattcggaatatactgacgctcgggacatcactaggcagtgacgcctgtatagtcgcacaggtacatcagcgtacgttaaggcatgaacaatcgcacatgtacacggcccacgagcgtgcacgaaggcttgcctggtgagtccaaggatcggcgctgatgtcacattcagtgcctgcggacgattagaacggtgacgcagtgatctcaggatgaaacaagaaaggaggtggtggaggctgttgaccattgtagcagacaccatccatggtggttgtggncatgtgggctacgtggaacccctcgaggctccggnccttcaagactgtctttgctgagcacatcagtgatgnatgcaagaggcgtttctataagaattggcataaatctaagaagaaggcctttaccaatgtactgcaagaagagtggcaggatgaggactggcaatgaagcagctgcgagaacggacttcagcagcatggaagaagtactgcaacgtctagtccgtgatcattgcccacacccagatggcgccatgcttcctctgacgccacaagaaggcccaggctgattggagatccacggtgaacggaggcactgtggccgagaagctggactgggcccgcgtagaggcttgatgcagcaggtacctgtgaaggcaaagagtatgggcagcgatgcagatgatcgcaggaacatcccgggtgacccaggggcaaaggctaggccagggggtcaccgaggcgttggagacaccgaaggaagctgccccggcaagaacccaa

SEQ ID NO: 631453 - DNA, 242 bp, Homo sapiens
agatccccgacagccgacaggctagagtgggctgggtgttgtgttggagctgcaggcgggtgggggctgcgtcctgctcagcccatcccctctctatccctgccacctgccaggctccctccggtgtgtttgagacagcctgccaggcctccagcaggaggacagagtgccctggggactccaccttcctgcccgggggacgtggcgctgtcgggctaggtcgggggggtaccggggctcga

SEQ ID NO: 631454 - DNA, 370 bp, Homo sapiens
gtagtatgtataaatatcttcttttgcatatataaaagatattaaatattttaaaatattatctgacagagcttagagtgctaaatccattaactagcccttgtatatatattgttagaacatactaaatttgattatgaccatgttaaacattgttattcaggtcatttagaaacatgtacagactgaaaagactattcttatttaccatgctaaatgaaattagattaatgtaactatagtaaaacagtagaatgccccaagagggtctttgtatcttcaaagtgtgtcagatacagtcttgattaatctgaggaaccatataatctgattttcagtatctttctatttttatgtgatcttatgtcca

SEQ ID NO: 631455 - DNA, 476 bp, Homo sapiens
atttttaaatgaatgcatttagtgttgtcagggaataattacaatatgtcagcaaaccttggcaaccattggaatcccgtttctgaaaattacagtgtagtgtgaagtagaaaataacaacgatggttttaactcatatgaaacatagaaaaaattcagaaacaaactagatttattggttttaaggaaaagaagccagaacaactaccagaatactgttctgttaggtaactcttcttttaaccaccttctttaattactcaggaaatatttctgtgttttcctcaacaactggagtagattttcccatgagttttatgttacacaaagtttagttatttttaaagttatcaaatcagctcttactggcttgaagttaagtatccatggaacttgtatttcctttgttttcctttcaaatgtctccccaaaatgcttgtaactgtgtatcctttctgtaaataattttgccactt

SEQ ID NO: 631456 - DNA, 339 bp, Homo sapiens
tccatgtgtgccgggcagaggctagcgagcgagccccaggtacctgcggccgtgtctctgcccacgtcgagcgtgcccgagacccgagggagaaacaaaggcagcgctgccctcgggggagcattggccctggcggaacgcagcaggtgtaattatccatccatgttatttttctctcatcttggcgctaccaggctgcccaaggggggcgggcctgggaatgatctttcacggggcagcacctaggatggggcagagacttgtggcaggtttgtccccagcaaaggctacatgttacctccttcaattgataataaacctttctgagatgcaaaaaaa

SEQ ID NO: 631457 - DNA, 788 bp, Homo sapiens
agcgggatcacccactatggcttcctagtgtcacggtccagctggtgtagtggctcggtgtgattggttagctctatgagtgcacgggtaccctcactcaggatttacgatatgcagaagaagagtcgagactgcctctcatgacccggagcgagggtctgaaaagcccttcaaggaaagcctctagtgatcttggtgccatagatgagtctccgggtcccatggaaaggaagaacttcaggggaagcgtctcgagaacagcacagagttgaccctcgaagctgaacaaggaggttgattgaatagtgttgaacaaggtaggtatttctctgtggattcatttgatatggttcaatagtatcgaagctgggacgataggcttgccatcctgttctcaatttgcaaggaagtcagaggcgtatagagacaaatgagaaacaagagcaaaggtagtcagtaatctaaaaaacagtggccaggatttaatcccgttgcaatagaacgagactaggttgatgttaaaggtaactgggatgaggagttacctcatttgcgagaccagggtcatgttccattgagctgcgtgttgatctggtaacgaaatgggcagaaagaaattggaatcatgtgccgacatggatggttgtacttcaaaagctacgttctaaggactctcgttggcaagatcgtcatggtacataccgtcgagattcgctgagttgtggactgctgtaaaatctacttgaagaatgttgtaatagctagggttgtgcgaaacgaaacgagat

SEQ ID NO: 631458 - DNA, 134 bp, Homo sapiens
cataattaccgcccatagtccttacacattcctcatcagccaagctaaaaatattaaacacaaactaacagcttacctccctcaccaaagcccgatgaaatataaacaaattataacaaaccctggagaaccaa

SEQ ID NO: 631459 - DNA, 159 bp, Homo sapiens
aagtattgatgtctgcctctgcaggcttgtcggacatacttctggtgggcactgtgcgcgaacttgaggactgaaactcagtgacgctgcatgcacttgaaacggcatggcctgtctcctcacttgagtgcaaggtccatcgaccaaagccctgttctg

SEQ ID NO: 631460 - DNA, 227 bp, Homo sapiens
ttaaagtcaaggacgtttatttcctgaggtcatgacacaggaagtggaatcctatcctcggcagcgaagctatcgtattataggaaagagtgatgttgtgacatacctgttggagcatttgcaggagtctgttatcttagcaagaatgctcatgacgttggtatagtgttaaacagtggagcaggtcctcagcgggcacgagaacagagcatggaggagcggccgca

SEQ ID NO: 631461 - DNA, 122 bp, Homo sapiens
tcatcgagctcggccatttttataactggtagactagaccttccttaactttagaaataaaatgaaggcttcactggatctgtgaggataaaatacattttctttaattgtccggggttgtt

SEQ ID NO: 631462 - DNA, 743 bp, Homo sapiens
gccctgatgcgggcggttggtcctgcctgatctcacactgctccaaagacactcagtatctcaaggactctcctggcactggtggaaaacagaggacgagaggctacggtgaagcagctgtccgagtgataagtgttacactgaatggccctcacgttgactagctggtacaaccaatacgtgaaaactggctgagcccagcaagtctgtgttcaaatgagcaagcatggtcagctacgtggaccgtgcctctcctcagtcgcgctggagcccatagaggaaggcgtgctgcgggtcggtggggaccaatagccacatttggttcgtcatattgggggcctgaaacgagtccctgaaagctgccatccttatacgcgggaatacgaatagcccgtactatggccgtgaccgtctcttggattttacatcagtgggttaatttctcctctctagtgagcgtctgacacaataggtctgtacgggacggcgtaataacggggccaataggagaccctggcacagctgaccctccgtgtcgatattccaatgccgtgcgagggtgtgcgtccgagggccgccaccttgacgggccttgcgacccataagtgtcctcgtccagtgcctcgatggcattttgtcgagacccccgaacggtccattctccaagctgggagtcgtgagtcctgagggggcctcccagcgaagatgaacttggtttcgtcccttcccctcgacggggaaac

SEQ ID NO: 631463 - DNA, 294 bp, Homo sapiens
ttactcagaaaatcttaatgtgatgtgctgcgtcaactcacacagtttaacttttcttctcatagagcagttagtgaaacactctgtatgtaaagtctgcaagtaggatattcagacctctttgaggtcttcgttggaaacgggcataacttcatattcatgctagacggaataattctcagtaacttccttgtgtagtgtgtattcaactcacagagttgacagatcctttacagagagcaggcttgaaacactactttttgtcgaatttgcaatgtggagatttccagccgc

SEQ ID NO: 631464 - DNA, 199 bp, Homo sapiens
ggcttctgatcgccatccttgaacagggcaaaggtggcctcaccagccttcgatgcagctgccatgcgcgccagaatcagcgaaggcatacccttacgtcgttggacgcatgtttagatgcctttgagaccgcccagagaagtccttgtccttcttaataaacacctcctcgccaactgcgacgaccacaatcaccgta

SEQ ID NO: 631465 - DNA, 160 bp, Homo sapiens
gtccttgtgaccgcgaggcggggcgcaccaggaagggagttggacaacgcgggcgccagggattttgccttggttaccttccttcttttatacgtcaagacaaccttcaacaattgctttcagcttttaccctttttgcttgacccaaagacggcctttt

SEQ ID NO: 631466 - DNA, 623 bp, Homo sapiens
acagatgatacttaccctgcaagaatgggtttaaactgtgattaacagctttactaattgtgagattaagcaagattgtgaaaaataaacttagccaaatctcatgtgaggattaaaaaaatcgatgtcccagataagtcaatatgacactaaagattctactcaattttatttaactttttcagttttttatcaaatttcagcacccagcaaataataggcactgttaatatttgcttaatataacgtttctgtgaatttttgcccacatttaggctgacgggaaaattaacgccagaatatcccgaaagtcaaattttgtcatcttacacttaggaagttacgttacaaaattctcaagtctcgtagtatctttcttaagcgccatttgggaatttccatttgcgtcgtgatctgcgccttctgttacttgctatcaattgcattgccttacagatttatttattatcctgcggtattcctttaacttgttcttaaccgctcgagtgttctgtgagattaacttcttgtgaaaattaacttatccaatctcgttgcgagcttaaatggcgcatccatatccgctcttgccattagacttaccatttttttaccttaagtta

SEQ ID NO: 631467 - DNA, 104 bp, Homo sapiens
taccggctgcacagcttctcggacccatctctgctagggacaccaactgatcaggatatttgtttcagatactatagttttcagttccaaaatttttatttctt

SEQ ID NO: 631468 - DNA, 277 bp, Homo sapiens
aaagggataaaaggcctttttggattaaattttcctttaaacttataaaggctttcccaaattttaaggaaacaggatttgggcaaaattttttttttttgaaaatcccgttttaaaaccaaagggatatttttgggctaccttttttttagtcccttggaaaaataatgttccttgaaaaatttttgaaaaatgaaaatttgcggttttttgttttttgaaaatgttaagcatttcccccggcattttagttctaatcactttggcaaaataatca

SEQ ID NO: 631469 - DNA, 202 bp, Homo sapiens
gtagacagtctcacatatcatgcccatggcagttctccataagcatgcatatctggtatccaagcaacatgctgttatatctagtagcaccgtagtcaacacatgacatagtttgacatagaccagcatagtaatatcccactgtacgctcacagaacaagatcctacacttcacatatatgtgcttgtcactaccagccag

SEQ ID NO: 631470 - DNA, 214 bp, Homo sapiens
  misc_feature (81)..(81): n is a, c, g, or t
gcaaagcacagtgtttactaaaggcacaaagtgaggggtcggagggcagctgctcttccggcagagacacaatatccgtcnttggcggtttttgcgctcacaccacctggtggagagctattatttccaaagtggggggtgcccacctgtgggagagcccgggaccaggctgtggggtggtcctcctgccctctgcgtcccccacgggccggcc

SEQ ID NO: 631471 - DNA, 907 bp, Homo sapiens
caccaggctaatttttttgtatttttagtagaggcaggtttcaccttgttggccaggctgttctcaaactcctggcctcaagtgatccatccaccttggcctccccaagtgctgagattacaggtgtgggcgacaagccacccaggtgccaaggcaagagactgagggcacaagctgtcccagtataataaagaaaatatatagaataagaatagttatactagaaatagattatagatatgattgtatatgagtatcattaatcattagtttgtagcatcactctttattccaatattataataatctttgttctataattataacccaggaaaaaccaggccatacagcgataggagctgaaggggcacggtgagaagtgaccagatgagtgtgagccctctgttacgcctggacagggccactagagggctccctggtctagtggtaacaccagcacctgggaaggcatccattacctagcggaccttggtctaggcgtagcatcagtgcctggggaaggcacccgttacttagcagactgggaaagggagtctcccttttcctgggggagttagagaagactctgctccaccacctcttgtggaaggcctgacatcagtcaggcccacctacagccatctggtggcctgtctccctgtgatgctgtgcttcagcggtcacgctcctgtttcacattcatgttatgctctgtacaacctggctctgccttctagatagcagtagcagtattagtgaaaagtattaaagtctttgatctttctggagaagagcattagaagaactaatgatgtcagctgtcctctgtctctccggcttggctacctaaagggaaaggcccctgtctggtggacactttccctcgcgtgatttatcaatcattgga

SEQ ID NO: 631472 - DNA, 262 bp, Homo sapiens
ggttgacgcgactaagtactttaagcacccttactcccttccccagtcttcattctcagaattacaccttctgtagcaggctttttccattgctctaatatggaattatacgtttaggagatgtgtagtcatttgcctttgtgttagaacattcactgaggatcctcataggcccttctagcagtccacctccttccggattacctaatccgtaattgcccttcttacctttttcttgtgttagaaaaaactgaagccacgg

SEQ ID NO: 631473 - DNA, 112 bp, Homo sapiens
accttctttgcaaagagcagttttgaaacactctttttgtagaatctgcaagaggatatttggatagctttgaggatttcttgggaaacgggaatgtcttcagataaactct

SEQ ID NO: 631474 - DNA, 1185 bp, Homo sapiens
  misc_feature (591)..(591): n is a, c, g, or t
agcggggtacgactggtgctcgccgtgcgacgtcgtacgccctctgggaccgcttgtagcgtggtgaaaaacttcgcggttccctcggtcgctgcgtcgcactcagtgctccaggcccgggaagagcagagcaatctgcgccccggggtccttgagggctaggaggatgctaggcggggggccagcgcccaggcgcggaggcgagtcgcgcgagagggtggccgacagcggaggcaaacgttgtgcgcgcgcacatgagcgcgtgctcgtggaaaagcgagcggccggctagcacgaggtgggcctgaggatttagtgcccactcgctagatggttttcgttgcagtgccgtacttgtgttgttacaaactccgcacctgtgtggcggattcatgttgtccgcgtgctttggacattcgccgcctggcggtggccgttcaccggcattcgagggggaaggttcgttggaagacgccgtggggcgaacgagggatgcacaggccctctgccaggccttgtattgttgccgctgtgcgagaaagcacctcgcctggcatttgacaagccctgttggtgttgacgttgttgtgnacgtcgcgcggttccggtgcgccagttggagcacttgggcgcgttatggccagagaattctcccgaatgggttgtcgctgtggcccctctcggcgtggtatatatcaccgttgtaccatccccgacgcgcccaacgcgcatgcacggtgtgccacggtttttttggatggcggggcacggggggcccctttcgcgggcctggccgcccttgattcaccttgtaagcgaagtttccctccaatgcaaagcgttaagcgttaagaggcgtgtgtgtcaccgacacattggccttggatattgtgggtagacccgcttgtcccaatgggctcccacgcggcaaaaaaaattttttctctctattggcagttggacatctattccacagtaaacgcggttctgttacacaatgtttgcacaggcacagtggtttcgccacgaaccggtgtacacttgtcaggggcagagcggttggtggggatacatctggtgaattaattagtgacaatgtcgcgtggtagcattggcattttccaatcggggaagggcaagaccacgtggcgcgagcggtgtcaattaggagtgaaagcacacact

SEQ ID NO: 631475 - DNA, 415 bp, Homo sapiens
ggtctaacttacttctcagaatgtaactctactattaagcaactcatgaccgtattttgcagctctgttattagtgcataaatgtttagggcttacttgtctccataataaacccttttctcattatgttctgaaatgtactttgtgtgatattactataagtaactccagctttgattagtgttggtacggtatctattttttactttttacctgtgtttttaatgtgttttcttataggcaccatatatttgaatcttgcttttttatacaacttgacactcctgtccatttaattggggatttaaaccatctaattttaaacttaggtttttgagtttaatttcccaatacctgagaatttaaaggatttttaattaattcctaatcccatatggtaattagtgaatataca

SEQ ID NO: 631476 - DNA, 318 bp, Homo sapiens
catgataaatcggctcggtacctcgatagggcaactttttgcatttcagtagagacggggccccaccacgctggcaggctggtctcaaagtcccgacctcagatgatccacccaccccggcctcccaaagtgccgggatcacaggtgtaccatgcccggccactcggctaacttttgtattttggtagagacagagtttcaccacgctgcccaggctggttctcaaactcccgacctcaagcgatccgcccgcctctgcctcccaaagtgatggattcacaggcaaaaaggagtttttttttttgggcccttatcgag

SEQ ID NO: 631477 - DNA, 534 bp, Homo sapiens
  misc_feature (405)..(405): n is a, c, g, or t
  misc_feature (441)..(441): n is a, c, g, or t
taaggcttgaaacaataaatttattcccatagttctggaggccaggaagtccaatatcagtttaatcggtatctgtagggccatgctcctgctgggaaagaggctctgggggaaagaatctggttcttggcctcctccagcttctgggtgggctggtcagcattccttggctgggggctccatcactccaatctctgcctctggggtcactggtgctttctcctcttcgggggggtaatatctcccttggcttctgaagttcagagggttctttcaggagtggatcatattctttcgaaagtctctctgacggcatcttcatttccatcacatcatttggggccttagaaggggccatctggaagctcttcccttaattccaggtttctcaggtttctccgtggntcttcatactaagttttcaatatttctggcttccanaaacacattctttcatctttaccagggcttttcaaaatccttttaagttttccggtttcttccataaatttttgggcagcttgtaagtatttg

SEQ ID NO: 631478 - DNA, 113 bp, Homo sapiens
ccacctcagcctccagagtagctgggattacaggtgtaagccactgtacccgagtgagaatggttttagagttttgtttctactagtatttgcttccatttatttttattttt

SEQ ID NO: 631479 - DNA, 220 bp, Homo sapiens
tcccacctcagctcctaatagtgctgggattacaggtgcccacacacgcccggctaatttttttgtattttttagtagagacggggtttcaccttgtttagccgggatggtctcgatctcctgacctcatgatccacccgcctgcgcctcccaaagtgctggtattacaggcacgagccaccgcgcccggcagaaatttctctaggatacagtagggaga

SEQ ID NO: 631480 - DNA, 209 bp, Homo sapiens
ggggggggggggaaaggggggccccccttaaaggggggccctggaaacccggccccggggggggggggctttttggtggggggggttcccccgtttttttaaaaggggcccggggggttttttttttccccgggcccccttgggggggttgggttttttccccccccctgggggtttttttttttttttttttttgggtttttttttta

SEQ ID NO: 631481 - DNA, 610 bp, Homo sapiens
aaccacagtcctggtgaagatgtggatggggacccaggggagtagggctgaacgatgtccctctccccttggtccccaatcacagtcctggtgacagactgtggactgatcatggtgccttgatttccaaatgaatacagctttattgcttaactctattgtacataggatacacgttcagtgctacaaagtgtcaacggggaatttcagcgcttaactgctgcacctagcatataaactgctacatgatacttgggctttatagccttctgatcctttatttctgcactactatatactagatactataccactactatatatatacgcgtataacacataacaccgtactccatccttaacaacaacaaacacaaaacgcgcgacacgacccagctcttagaaagtctactcacccctgccaaagagaggccccctaacggcatcacccgacggcacacgcccgagtgcgtggcctatggccacagcaagatcggagtacccctaaactagatcggcagactagagcaatttacttatagcgcctacgtctgccctcgtgtcgccccgctgtgctttctacacaacgttagagcacaacttggcgcac

SEQ ID NO: 631482 - DNA, 1890 bp, Homo sapiens
tttgtttttgttgtgttgtgattggtgctgtttagtttgttttgtgtgtattggtatgttatgtggtgttgttgttgtggtagtggttggtgtttgtttagttgcgttctttctctggttgatgtgtttgttgtggatgtttgttgttgttgtgtgtttgtggtgtttttggtcttttgtgttgtgtatttcttttgttgtgtttgttgtgtgtgttttgttgtggttatggttggtgttgtgtggtttttgttttttgttgtgtttgttgtttttccacaccctcgtgtaagttttttgatctccgggtttctccacaattgtttagtgatgctgagtttgctccccctctttgttgttggtggttcctacaaagtctaatccactagttccacgtagtatgttttttatggtgggcggacaccgcccggaatttttggtactactgttcttgcttatgagggggatgttcccccacacaaacaaggttgttgtgtggcccacccaacataagaataattcccatacgggcgcgttgttgtgtttgtataatcactacgtctgcgtggcgctcaccatgttgttgactctgatatgttatatcgatcgtcgtgttctccatctatataatgaggggtgttttctcgagctacagtcgccatctatcttgcttgtggttgttcgccatcgagtaaatttatattgcgtggcacaacatacagcaagaagtgggggggggtgctaacttatactgagtggctctcccctctcgtcgtgagtggagaggacataccacccttctctgcggagagtgatattttccattgtcggttggtgctgtccaccacaaataagtatctcccaaccagggtgggttttattttgtgggtatactcctcttttattaggggccacatcatttcttttgtgcatgtactcctgcctccaacataagggggcttggttttgaagacgcacacaacacgagggttggcttatgaatagcctcagcactagccgcctcacacacaactctgtgaggagagcggctctgctcacaagagagcaacacccctcactgtctctttttctgatgagatatacacacgacagtgggatactctctctctgtctgttgtgcgcactactataatctctggtgggtttattctcgcgcgtgagacacacctgagacgcgccccgcgcgttgtacacacacacgtgtacgcacatattggacccacgctgtacacacatctctggtgtggccccgactctcttactgcgcgctcgcgcgtacacgcgtgagaacacacacagcgcgcgtgtttatagatgtaaggagcacacacatttgtcacacatatgttacatcgtctctcactctggagctctgtcacactgtgagaggcgcacactgtgtgtagagtcccctctcacacacacggagagtgtggcagcaacacaccatctgtctgtgtctgtgtgtgtgagagtgtgagagtggcacacacagagagagacccctgctggagaatgttgtggagatataatctctctaagagcccatagagcgcccagagcgttttgtgtcgccagagcacacctgtgtgaaggaaccccctctcacacccaaatggcgcggcgcatctttacacggccattgtgttgtgaaacatgggggctcagaaaaagaagaaaatagtacccaatttgtggagagggcgcgggcactcctagaaagagacactttgttagaaccatgggggggaggatgggactttgtttttttccaaaaatttatctttccaatccctgttaaaaaaaatatatagaaaaaataacatcgagcattaagtcggggcgagaagagtactacatcttttttat

SEQ ID NO: 631483 - DNA, 139 bp, Homo sapiens
cctggtccctgttccggttccggtcccggccccagtaccggttccggttccggtcccggccccagtaccggttccggtgccggccccagtccctgtcctggaaccagtcccagcccccaataaagcccccgccccctca

SEQ ID NO: 631484 - DNA, 219 bp, Homo sapiens
gctgacgtgtcacaactcacgagcgtggaactcgcttggggatcaactacccacaacaccaggccatagtgaagaatcagcaacagtccacagcagcccagatgcaatggcaacaacagtcttacctgccggctctacaccctcagttcttgttggagactcgacgccctcacccatcagttcaggctcaatggaaaccaaagccgtcgtaggcagtga

SEQ ID NO: 631485 - DNA, 103 bp, Homo sapiens
catgtcttccttggcatctcaccaagggcaccagcaatctaaaggctctctcttcattccttccttccttcctttttttcttttttctttctttcttttcttt

SEQ ID NO: 631486 - DNA, 335 bp, Homo sapiens
gaaggggggcccccccccctttggggggaccccgggcttttttcccgggggcctttttaaatcccccgggccaccctttgggggggggaaaccccccccccccccccccttttttggaccggggtttccggggggcccccccctcccttcccccaggggcccctttctgggggggggaattttcggttttggggggttccaaaagggccccccccccccttgtttttctggccggccttcttgggggtggtaaaaaacggttccccttacggcggttccccccacctggggtttttttcgttggaaataaaaaaatttttttcccccccccttta

SEQ ID NO: 631487 - DNA, 663 bp, Homo sapiens
ctctccgccggcagcaactcggcgccgcggtcatggaccggaacctggggccgacggacgggaacccgggccgcgatcgccgcctccccgactcaggctcctcctcctcgctctccgccgcctccgccggactccctgcaggccctgcaccgcctgcgccaggctagcggagctgccccgggaagctgggtgacgggttctgcggctgcctggctggactgctggcctactccggcgcctctcagtgctattgtccctgggcctggccttgagcgggtccactggggaaggccgtgtgcgccggctccgcggaagatgccggcacaagccctacagcagatgctggacagaagttgctgggtatgttttgctactgatgaagatgatagaacagctgaatgggtgaaaccatgcaggtgcacaggatctacaacaatgggttcaccaggcctgttctacaacggctgggtgcgactgcaaaagcagagaggaacacagtaccagccacgagtggccatgtccgtcagtgcaatgctgacatacctaatagatattccaaacatgggtcaagtggttacgtcttggatcttgcagatagactgatctcaacatgcctgtcccatttgctgcagcccggaataatgagtcggatctatctattgg

SEQ ID NO: 631488 - DNA, 269 bp, Homo sapiens
agtattggcgcgatgtagtggccgtggtggtaagtagatagggggagtacactggtctgtagtgctagaggagggtgttgcatagaaccagtggccacagttgtacgtggtggtggtcagcactgtgggggtgtgggtaggtccccggcgatgcagcgagggggtcgccgttgaaacctctggctcgtgggctgtgcgcggcttgtgcctgactccacacctggcaagccgctgcgctgcccgtctccccttgtctcctggccggcacg

SEQ ID NO: 631489 - DNA, 974 bp, Homo sapiens
tggaacccccaacctaaaaatttttccccaaaaaggggccaccccctttggggggggaaaaaagggttccccccccccaaaacaccaacaaaaaagtataaaaggaaaaccccttttttaaacacccctccatcaattcgggccccccccccctctacaatacgacgtgaggcggctgagtaatcattctcctcggcgccccatcaaaacaatcattcaaaactacaggtaggaggaatgtgataaacacaccacaatcgatcatccaaggagaaccatattgtgagtacatctaggagaaaacacactagtttgtatgtacaacaacaaaaaaacaccaccctagataagaaaacaaaaaaaacaatctatattaatagcgaggcacagaagaacaacgaaagtaagtcatcacccaagcccttcttattcctccccagcccaatgtttgtgagaagaggccgcagaggtgggtgtgtctatatcccacagtccgagagtgcgtgtgagcaaattaactcactataaaacaacgcggctagagtaagaaccaaacaatcttaataatatgtgtggtatacctcgcagatagaaaacaccctctgtgttatttatataaatcaaaacaagatatcaaacacttaaatctgtttacccgcgcgatatcataatgtgtgagtgcggggagacacaatgtgtgtatatcatctccgacgcaagctatatctagcgagagagatgccctatgcatgcacagatacacaacacatccttcttaatgtaacccccaagataggacgatcaaataaaaggtattggcgggagaaaccgagcaacgaaaattatcagcaacaacatgagtagtaccaactacacgaccactcttttgtcaaaacaaatagatgaataaaaacttcccggtattacaaacaacaaaaaaaccaagttgcttctttattcaatgactaccccca

SEQ ID NO: 631490 - DNA, 470 bp, Homo sapiens
ctgtagagcaagttacgagagaagtttgaagagtccgatatggatggcatttgagttatcttctacactggagccctccagagaatggtatgaggataatgatggagtggtggggtttgagtgtgtaatgagaatctgttggcagtataggagaatcagcagggccctcatttgggaggcttccatcataatcttggtgagatgatgtgggtcataactaatcagtgaacgtgatgatagaaaacatgaatcaactgaatataattgatataggtgtaatatgtatgcttacctaagaaggaaaagaaagaaagacttggaataaataatgatcctttccctcaagtaattcttattccagctttgtgtagataattaacacatatgctaatgtaaaatgaatttggtgagaacaaatctacacactccaagtgctgtggctcataagagaatcaagtttagattagtca

SEQ ID NO: 631491 - DNA, 768 bp, Homo sapiens
  misc_feature (321)..(322): n is a, c, g, or t
  misc_feature (522)..(522): n is a, c, g, or t
  misc_feature (735)..(735): n is a, c, g, or t
tgggaactggtagagaaagtaaaccggttatacaaagagaatgaagaaaacaaaagtcctatggcgagcggtgcagctgcggatgaggaagacgacagcctgtgtcgcatctgcatggatcccgtcatcgaggtgtgtcctacgtagagtgtgcggcacattggttactctgcaccaaggtgcggtgaagccgcatgaggttgagtgtcccaactctgccgggcaaggtatgttgcgtgccgaggccggtgccacgtgtgtctccaatcgtcccttgaaaaaccgaggggcttccccctcttccacgcaagtgacgatggnntcaccgcgcagaaaaatgttttggagcccgccaaaatatattttcgaagtggcaccaggagaggcggagctgggcacaagctttattgttccagaagctgctagaggcgcttattttaaacaaacatttattttgtgagctaactaaaggtgggcggaccaggaagagaatcgcatccgtgagcttgtgggaaaactatntgcgtccaattgcctgtgaggccttgttctggctctgttggaaccacgtgtgaagctatcccgggcgctacaagcctgggcttatatcgacaatatcccgggtggaacacttcgattgacagtccagccgtgtttgcgcccattgtggcgcaattcagcccacttgcgtgtctttgaggagggaacactttaattccgtggttctcctatatnttccgcctttcaatccttatgttttaagcttag

SEQ ID NO: 631492 - DNA, 428 bp, Homo sapiens
gcggtccgtgagccgtcgatgggcggcgctctggatcagcggcgccaggtgcggttccaactgtttcatttgcgcaggcgtcaggttcttgatgagttgggtgagcaactcatcatgcaggtgttgcatgtcgataaagccgcccatggaggaacccccgcattctggctggttggaaaaccggttattcgaagctgggcaggtagctgtcggcattgtcgtagaccatggtcaacaccaccgtttcgggcggcagttcgggggcaagcctggcgacggccaccatgttggcggcggaggagaggcccaggctgatggcgtcggtgcgcatgatgcgtttcatcatgtcgatgcagtcttggcgcgaaaccttgagcatgccttcaatcacatcgaggttgaggatgctcgggatcagcccaatctaa

SEQ ID NO: 631493 - DNA, 228 bp, Homo sapiens
gtcatccttctttccttcaagaaacctttttacacatctccatttcttatttcacttggattttctatagcaaaggaacccattcatgtgtattggatcaactttttatagtcttttcacacttcagcttttggaaaacttcattccttgatttgtgtttgtcttgggcttccttgtgttcagtacttctgtagaaaagtattaatagcttcatttcatattaacata

SEQ ID NO: 631494 - DNA, 1568 bp, Homo sapiens
caaaaaagggttgtttttaggcaattagtgcttatcactggaggtgctaaaggtggtagaaggttgtggggatggggttgccaccactgtggcttttcaggctacttttaccacagcttgaattctccagaaggaatggaaaaagtctcgaggaaactttggaaaacaccgcgtgcgtgaggctcctttgcagccccagcggctccccgaggcgtggttgactgtggtgtgggggagagttatgtggagtctccacgctgtgaccaccaaaagcctgtgcaacacctgtgctgtgctatagtggagggacgagacaagggagtgactttctatacctcttcctttctccactattctccaaaatttctcccactgtgtgactatccccatttatatatgtgtgggcaggccaccccccgtctgtgtgcaacagtgtgacgcccttgttatgtgtgtgtgtgccttctcctgtggagccttctctgtgcgccacctttatttgtggtgttctctgtgggacaacaatatgtgcgtgtgcccacagagaagggtcttccgtgaattgctgtgtggaccagtgtggtctgtgccccaaactatctcccgcagaaaaacaggcacagaggtgtgttatatcttcttaaatatattctcatcactgtgtgtctctcccaccaacgagaaaaaaccttttattttagcccagcgttatttcgtgtttgtgtctacacatttgtctcgtggctgtgtggcgtggagcgaaaattttcgaaattattttccccaaggtctcgagaaaaacttgtggaggccgttgaaaagccccaggtttctccccacggcggggccttggaaccaaatataagggcgtggcccccgggtcttcgttgacgagccccccattttttctcccaattctctttgagaccccgtgggcgcttctcccgaggggggggttccacctttggaaccggctgtggcttccggggagatatcctacgcttcttgggggatccagaggtctcctatcccctccttttccattttattccaggcactgttcccccctttctcttggaagcttaacttggctcccgcgggacatcttcttggattccacaatctgggcctttgttctcccagtctggacccctctcacatgttttggggtttattgcgcccattagagtttggtcaaaatactctttcccccaaagttgtctttcgccaaaagtttgcaatcttggtctttctcccaaaaaaacaggttgtctgagagtccccctccggaaaagaagggaggggccaccatcgggcgaacgatcttcttccacaggagcgaagtttaacgcttttagaaggacagaccaaactaggagtcccgagggtcacaagaactccaccatcttgaggacgtgttcgcaacagtctttctgccacaagtcaccgccacgtcgatgttttatgtgctcaccacatccgctgtcgatcacccataagagccgtactttacatcacgacactcacgacaatctgacaagcacagattcatcgtgagtactacagcg

SEQ ID NO: 631495 - DNA, 196 bp, Homo sapiens
agtggcaagggcaagggcattgcgggacgggaaaaaatgactgccaacccaggctatgtgagtggttacaagggttttggcccctccgataaaaagaccaagtaaagaggagcttcatttcagcctgctagccccctgaccctgcatgtttaaccccagggagcttggaaaacaataaacatctgtgtgtgcagca

SEQ ID NO: 631496 - DNA, 360 bp, Homo sapiens
aggccaaggcccgggggggggccccaaaaggcctggccccccagggcccagcccccccgttaacccaggcccgtcccttccaaaatggggtttttgccttaaaagcttttttccgaaaaattccccccgtagcccgtggccgcccccacccttcaggcctccgttccttttccccattggttacatagaccctgttggggtcccgatgggtttcccagccccctgttggggttgttttgtccctgtgggtccgtcccctccccggggggtttctgttttcgggggccctttgtttcccttttggggtaaagggatccggggtcccccccgcttatccttattaatcccgtgtttttggga

SEQ ID NO: 631497 - DNA, 222 bp, Homo sapiens
caaggacgaacgggacctcttatactagaccccttaaacatttatatggccacaaataacctcgtcggactccggccttactcattaagaccggccacccaactatctataaacctagccttggccatccccttatgagcgggcccattgattataggctaccgctctaaaattaaaaatgccctaccccactttttaccacaaggcactgattggactctg

SEQ ID NO: 631498 - DNA, 381 bp, Homo sapiens
  misc_feature (23)..(23): n is a, c, g, or t
gccgttgggtttaaaaaaagagnattcctctcccccccccaaaacccctttttgtggtttttttttttgggttttgccccccccccacccccaagggggggggggtgggggggtttttcccttttaacccaggtttttcccaggggcctttttttcctggtggggtttcccccaaaaacctttttgggcaggggggaacccccccctttcttttaggggttttggggttacccccccccgggggggccctttttcccctttttttttttggggggcccccccttttgggggtgccccccccccccggggggttttttgggggggggggggggcccccctttttccccccccgggttttagccccccccccccccttgggga

SEQ ID NO: 631499 - DNA, 135 bp, Homo sapiens
cttcttccggtgcgcggacatgaatacaggaacttttaccacacagtggatatcaagcttacacagtggactgataaacaacttcctaataaagcagtagaggttgcttgggagaccctacaagaagaaaatgat

SEQ ID NO: 631500 - DNA, 438 bp, Homo sapiens
tggagaccaccccgtggagctgttggcccgagactttgagaagaactacaatatgtacatcttccctgtccactggcagtttggccagctggatcagcaccctattgatgggtacctgtcccacactgagctggccccactgcgcgctcccctcatccccatggaacattgcaccacacgtttctttgagacctgtgacctagacaacgacaagtacattgccctggaggaatgggccggctgctttggcatcaaggagcaggacatcaacaaggatctggtgatctaagttcacgcctcctgctgcagtcctgaactctctccctctgatgtgtcccccctcccattacccccttgtttaaaatgtttggatggttggctgttccgcctggggataaggtgctaacatagatttaactgaatacattaacggtgcta

SEQ ID NO: 631501 - DNA, 297 bp, Homo sapiens
  misc_feature (41)..(41): n is a, c, g, or t
  misc_feature (119)..(119): n is a, c, g, or t
  misc_feature (174)..(174): n is a, c, g, or t
tacaagaaatgttaaatgatgtgcttcaagggaagagacanatgaagagcatgtgcaccatccaggattttcctcgttatttgaatccctttggcccatctcccatttgccccaaggantgagtgctggcagtgagctgcacttttttttttctctaaacgggaaatgggttanaagatgagtggcttggccgggtgcggtggctcatgtctctaatcccagcactttgggagctgaggccagaggatcacttgagcccaggaactggggggtcatgctgggaaacatggcaagacc

SEQ ID NO: 631502 - DNA, 137 bp, Homo sapiens
aaggaaaactcactcagtagaccataatgtatcatgaagaaaactgattctctatgacatgaaatgaaaattttaatgcatggttataatatactaagtgtacgctggctgcagtgacattaataacagttgctttt

SEQ ID NO: 631503 - DNA, 357 bp, Homo sapiens
tgtcgcccaggctgcagtgtgatggcgcgatcatagctaactgcagcctcaaactctgggactcaagcgatcttccggcctcagccccagagtagctgggaccacaagtgcgtacccccataccgggccatttaggcccgtttaaatctctgagggcctcactttttcccagctgtaaaatggggtttgtatggtcccggtgtgacaaagggctgtgaggatcaagagtatggaaaacaccgggtagggggtgtagcgacttctacataagggtcggcggtggtttacatgattggtttacaagccgtcggtggcagacacggtgggtttgtataacccaagatccctccttccagg

SEQ ID NO: 631504 - DNA, 303 bp, Homo sapiens
  misc_feature (8)..(8): n is a, c, g, or t
  misc_feature (22)..(22): n is a, c, g, or t
  misc_feature (86)..(86): n is a, c, g, or t
  misc_feature (164)..(164): n is a, c, g, or t
  misc_feature (291)..(291): n is a, c, g, or t
  misc_feature (294)..(294): n is a, c, g, or t
  misc_feature (296)..(296): n is a, c, g, or t
aaatatancataaaattaaagnggacaacccaacaaaagctttattcaagaacggggtgaccataggttgaatttgttgtaaatcnggatatcatcccaacaaaatctcattcatttcgagcaatgtgtcagaatgggaaactggtatgtcccagttgtgaagnaaaatagaatcaatggcattactattagtaaaatgcacacctttttctgaatttactattatatttgttttcaatttcatttttcaaggtactgttttactcatttttattcataaataaagttttntananatttgtg

SEQ ID NO: 631505 - DNA, 294 bp, Homo sapiens
accagtctggttctaccattcccacttcttcacattggctttttgaattacttcccaagttccttgcccctacgtgcttgtcatagagtctggcatgccttaatgaaacactcgttaatttttttatttgagatccattgaatcctcactctgtgccagacatctttcatttatgaaaatagtagcttctatttttgtacccatttttgtgataaattaatgtttagagagatgttaaataatttacaaatcacagtgagtggcaaaacctagtcaatttccattatggtagaa

SEQ ID NO: 631506 - DNA, 290 bp, Homo sapiens
atccaagcagtcggttgcttctatactttactcttattaaaacatcacctccatcacagcaggggccagtttctctatcctttcatctgcaacaactgggctgggtaaaagaataaaaggtggctcgttaccttagaatgatcacagtgacaccagtccaagcagagagcagagactgcttatgtccagtctccagaactagactgtgagctcctagaaggcagatagtttttgttctatttccttctaatatctcattttctattttctgcgactgcttggattacaag

SEQ ID NO: 631507 - DNA, 295 bp, Homo sapiens
ctgggtgatgatgggagagggtgtgtcggggaagaggtgtggcttcaaagtgtgtgtgtgcaggggtgggtgtgtagcgtgggttaagggaacgttgtttcggcgtgttggtgggcatgtgagatgagtgactgcggtgaatgtgtccacagttgagaggttggagcaggatgagggaatcctgtcaccatcaataatcaacttgtgggagcggcaggtcttgccaagggggccacctgggcggacaggcagggagctctccatgggcagggctgcttgtgtgcatgttccctgt

SEQ ID NO: 631508 - DNA, 315 bp, Homo sapiens
  misc_feature (261)..(261): n is a, c, g, or t
  misc_feature (279)..(279): n is a, c, g, or t
gaatccacaaccacacaaagacgaacccgaacatatatctcccactggcacaacagaattttgactgggaaatgagaagattcatttgataagcacacagtctgccatcccacacgcattaagagcggaactgaaagactggaatggcagaactagtactgcagattataacatgcccaagacgggacctgaagctgacaagtatcgcctcacaagagcttactcgaccgcagggaccgccgaaaacacttttaccggttntgaccccgtccacaaacntagtcatgggcaaatacaactcacaaaaacatacgg

SEQ ID NO: 631509 - DNA, 951 bp, Homo sapiens
  misc_feature (80)..(80): n is a, c, g, or t
  misc_feature (87)..(87): n is a, c, g, or t
  misc_feature (102)..(102): n is a, c, g, or t
  misc_feature (106)..(106): n is a, c, g, or t
  misc_feature (127)..(127): n is a, c, g, or t
  misc_feature (151)..(151): n is a, c, g, or t
  misc_feature (154)..(154): n is a, c, g, or t
  misc_feature (160)..(160): n is a, c, g, or t
  misc_feature (163)..(163): n is a, c, g, or t
  misc_feature (171)..(172): n is a, c, g, or t
  misc_feature (175)..(175): n is a, c, g, or t
  misc_feature (179)..(179): n is a, c, g, or t
  misc_feature (213)..(213): n is a, c, g, or t
  misc_feature (215)..(215): n is a, c, g, or t
  misc_feature (218)..(219): n is a, c, g, or t
  misc_feature (222)..(222): n is a, c, g, or t
  misc_feature (225)..(225): n is a, c, g, or t
  misc_feature (236)..(236): n is a, c, g, or t
  misc_feature (244)..(244): n is a, c, g, or t
  misc_feature (279)..(279): n is a, c, g, or t
  misc_feature (286)..(287): n is a, c, g, or t
  misc_feature (293)..(294): n is a, c, g, or t
  misc_feature (296)..(296): n is a, c, g, or t
  misc_feature (300)..(302): n is a, c, g, or t
  misc_feature (305)..(305): n is a, c, g, or t
  misc_feature (311)..(311): n is a, c, g, or t
  misc_feature (315)..(318): n is a, c, g, or t
  misc_feature (320)..(320): n is a, c, g, or t
  misc_feature (323)..(324): n is a, c, g, or t
  misc_feature (326)..(328): n is a, c, g, or t
  misc_feature (330)..(330): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (343)..(343): n is a, c, g, or t
  misc_feature (345)..(348): n is a, c, g, or t
  misc_feature (353)..(353): n is a, c, g, or t
  misc_feature (361)..(362): n is a, c, g, or t
  misc_feature (370)..(370): n is a, c, g, or t
  misc_feature (372)..(372): n is a, c, g, or t
  misc_feature (378)..(378): n is a, c, g, or t
  misc_feature (385)..(386): n is a, c, g, or t
  misc_feature (392)..(392): n is a, c, g, or t
  misc_feature (394)..(399): n is a, c, g, or t
  misc_feature (401)..(402): n is a, c, g, or t
  misc_feature (404)..(405): n is a, c, g, or t
  misc_feature (413)..(413): n is a, c, g, or t
  misc_feature (424)..(424): n is a, c, g, or t
  misc_feature (426)..(427): n is a, c, g, or t
  misc_feature (433)..(433): n is a, c, g, or t
  misc_feature (438)..(439): n is a, c, g, or t
  misc_feature (441)..(441): n is a, c, g, or t
  misc_feature (444)..(448): n is a, c, g, or t
  misc_feature (451)..(451): n is a, c, g, or t
  misc_feature (456)..(457): n is a, c, g, or t
  misc_feature (461)..(462): n is a, c, g, or t
  misc_feature (465)..(466): n is a, c, g, or t
  misc_feature (473)..(473): n is a, c, g, or t
  misc_feature (482)..(482): n is a, c, g, or t
  misc_feature (487)..(487): n is a, c, g, or t
  misc_feature (496)..(496): n is a, c, g, or t
  misc_feature (500)..(500): n is a, c, g, or t
  misc_feature (503)..(503): n is a, c, g, or t
  misc_feature (505)..(507): n is a, c, g, or t
  misc_feature (714)..(714): n is a, c, g, or t
  misc_feature (846)..(846): n is a, c, g, or t
  misc_feature (949)..(949): n is a, c, g, or t
gcggtaaccagcgtgaggcgcccgccagaagaatatgaaaaagcagagcgagctcggttaagggaaagcgccgagatgangggcttnctgctgccgcccgcnagcngagggactcggagatcatgcngcagaagcagaaaaaggcaaacgngangaaggnggnacccaagnngcnttgnggcttcgtgtccaaccctcttgcccttcgcctgngngcnnggngcnagggccaccangcgcgcgnttcctcctgtggtgctcacaggtcccagcaccganggcattnnctttgnncngagnnngcngcgggncccnnnngngcnncnnncnccncnggnagccncnnnnccccngggccacnnccgggggngngggggntaccccnncccagngnnnnnnanncnngtggggcncaccccaaagnannaaaagnagcgnngngannnnntgngcgcnngggnngannggggacntgggggganggggntggaagaangacngcncnnnccgcaccaaaaaagggagaactctttagattcagattgtgggtatgtagacttaataagtgaaacatcacagaagaagcctttattatacaatgacaaccaaacaagtactccggatatgcagtagaggaatcctctaagaaccatagagacttcttttctgtgatttttgttccccacccttgaacaccatctctaggatggagtnggcctaagagtgaatgctgcaagatctgtgtttatgcctcttttcctcattcttcctcagtttgttcgtctgcttgaaagttggccaaaaaatcctgctgctcaccgacttcccgtggtcagctgctgtcancgttcactttctcttctgtcattcctcatggaatgagggtggttttgtcttccgcttcccttgactcaaaatcaggattaaaactggggtagctctgtgctcntt

SEQ ID NO: 631510 - DNA, 716 bp, Homo sapiens
  misc_feature (328)..(328): n is a, c, g, or t
  misc_feature (353)..(353): n is a, c, g, or t
cgtggaaagcacacccctggtcaagggcagacaggtctggagagaaccaagggctatatctgttcctggttctacatttttttgaatggggcatgcttatttaagatggcgaggaaggtacttttaaagaataatcaggcatcctctactgacaggatgaggtcaatatcctttcaggatacccgggccaggttgattagaaaggcctgctcgctgaagtgttttagagagagtttgacagtgattaggggtggtcgtttgatcgcagacccattacggaggcaggcaatgaggcagtgatcactgagatcttggttgaaggcagcanaggtgtatttggaggtcaagttggntaggatgttatctatgagagtgcccgtgtttacggatttggggttgtgcctggtgggttcattgatagtttgtgtgagattgaggccatctatcttagattgtaggatggccggggtggtaagcatgtcccagtttaggtcacctagcagcacgagctctggcccccatctatcttcaatcaattcacatatggtgtccagggcacacctgggggcagagggtggtctatagcaagcggcaacggtgagagacttgtttctggaaaggtggacttttaaaagtagaagcacaaagtgattgggtacagcctgtagagttcggtcttactatctagaaagtgtgctcagggtgtgcttcacaaa

SEQ ID NO: 631511 - DNA, 1300 bp, Homo sapiens
gcaagatggcgggaggggtgcgcccgctgaggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagactgcacaacaaatttctcctgtacctatgggaagcctgtcacttttgactgtgcagtgaaaccatctgttacctgtgttgatcaagacttcaaatcccaaaagaacttcatcattaacatgacttgcagattttgctggcagcttcctgaaacagattacgagtgtaccaactccaccagctgcatgacggtgtcctgtcctcggcagcgctaccctgccaactgcacggtgcgggaccacgtccactgcttgggtaaccgtacttttcccaaaatgctatattgcaattggactggaggctataagtggtctacggctctggctctaagcatcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtagagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtct

SEQ ID NO: 631512 - DNA, 350 bp, Homo sapiens
cccagtcatttcctcatgaagatgccctttgtctgtctgtgtgaggctggtttgtccagtgctgagtttagttggcagtgtagaactttggtatggatgacagacaaatgactcaaaaccagttgtctgggctgtagtctgtggcacagaaagaaactagaggaaggtgagtttctgaccccagctctcctagtgagaactgctacctggctttcagggaaggaaggttgagatcggaggcaaccggggcgtggtggctcatgcctgtagtcccagcactttgggaggccgaggtgggggattgcttgagcccaggagttcaagatcagcctgggcaatgtagcaagatc

SEQ ID NO: 631513 - DNA, 493 bp, Homo sapiens
ttcgggagccttaccctggggtaccagtgtggcggcaaccccgtgaaccaagacaggttacagaacatagaacaacgtgacaagcgtgactctggtatcccagagtcaacacaacaggtgacctctcacaaccaagtgtcctgccttaaacaattgcccaaatacaattaacagaaagtcgaaagcaaacataagactccaaacaagacatacatgttaggactgaaaatgaaaccaaagtggagcaataaaatggagtcagaggagaaagaaccaggtgaaggggtggcaagaatgtgcttcaaggcacctaaaccgtggggaactgaccgcttagccaaaggcttttatttcctagcttacctgatattactgggggagggtgcaaaggggactctcacccatccacagaagacaaaatggcaccagccagtcttccacgtgggacccgggtgcaggtctctctaggttccccagcttgggggtgctcagc

SEQ ID NO: 631514 - DNA, 100 bp, Homo sapiens
agtcggcggacattgttcacgtacacacagaatgcttacacacaaactcaacatggtgatactacactttatgtgaagtcacattttgcaacaattgcat

SEQ ID NO: 631515 - DNA, 228 bp, Homo sapiens
  misc_feature (181)..(181): n is a, c, g, or t
tcacttgctaccgcactccagcctgggcacagagcaagactcttgtctcaaaaaaaaaaaaaagaaaaagaaaaagaaaaggtctcagagccttagcatttaaatgatgggatgggaggataaggggccgagccaaacaacagactataagaaaaagtgggtcagcaggtattgaaagcangaaagtccaagaaaggaactacagattctatttaaggagcaaaaggg

SEQ ID NO: 631516 - DNA, 437 bp, Homo sapiens
  misc_feature (12)..(12): n is a, c, g, or t
  misc_feature (27)..(27): n is a, c, g, or t
  misc_feature (70)..(70): n is a, c, g, or t
  misc_feature (89)..(89): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (213)..(213): n is a, c, g, or t
  misc_feature (217)..(217): n is a, c, g, or t
  misc_feature (225)..(225): n is a, c, g, or t
  misc_feature (240)..(240): n is a, c, g, or t
  misc_feature (250)..(250): n is a, c, g, or t
  misc_feature (262)..(262): n is a, c, g, or t
  misc_feature (277)..(277): n is a, c, g, or t
  misc_feature (288)..(288): n is a, c, g, or t
  misc_feature (291)..(291): n is a, c, g, or t
  misc_feature (298)..(298): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (317)..(317): n is a, c, g, or t
  misc_feature (326)..(326): n is a, c, g, or t
  misc_feature (331)..(331): n is a, c, g, or t
  misc_feature (339)..(339): n is a, c, g, or t
  misc_feature (348)..(348): n is a, c, g, or t
  misc_feature (367)..(367): n is a, c, g, or t
  misc_feature (375)..(375): n is a, c, g, or t
  misc_feature (433)..(433): n is a, c, g, or t
tgatcattcaanatggctttattttcncatcggccggctgcatcccacaccagcctgagccccagacggncagtcagtgcatccatccngacgacctgtccaggaaggaaggaaggaagccccccccaaaatgctggccccgnggnacccagacaggngcctgccggctagcatgcaagccccccccaaattctctcatggggacaagggggnagcngcctgggncccagagtctcagcncaagtgcccngaggccagtggngatgggcccctgggnaagtctctggnggnggggggnaacccncnggnagacgggngaagagggnccccngccaaccnggaggaaanagggggggttgtccccccncccccccnggctgcaggttctggagggcagaggtgctggccgaagaactggtggccaaagtgagancccc

SEQ ID NO: 631517 - DNA, 318 bp, Homo sapiens
cacgaggcctcgtgccgcatcttcacgaggttcatggccgccatcacccggcccttggcgaaggcatcggccagcgggccgacccagggcgccagcagcacataggccgccatgaagccgaacttgagcagcggcgcccaccacggcgcacaaccttgctgcacgagcagcgcgatggcgacgatcagcatcgcgttgtcagccagggccgacgcgaactgcgcgccgatgacgaggccaaagccccgcggcaggcggaccgcggcaggcggggcatcaggggcttgggcgacggtggtcacatgggagtcactgtca

SEQ ID NO: 631518 - DNA, 131 bp, Homo sapiens
  misc_feature (79)..(79): n is a, c, g, or t
tacaattcacgctcggtacctgacttactgcctggtacttcccgcaccttgggactgccaacgggtgggaacgactcgncttgacgacttacgactgtaacgggctgacgtgacacctactgtacttgtgc

SEQ ID NO: 631519 - DNA, 151 bp, Homo sapiens
ctttgagtataaaacttagtactcatatacataaactaatacgaacttaacaataccatcatacatttacttcatatttttagcttgaccttctagtaaatctttagcttcattgatttttggcttctctataaggagatcctcctattgt

SEQ ID NO: 631520 - DNA, 197 bp, Homo sapiens
aggtggcccagtcgggtctggaactccggaactcaaacaatctacctacctcggcctcgtgaaagtccggggattacgggcgtgagccaccacgcccagcgggaatgaaacattttgtacagtaacgatagttataaaactagacttctcacggcatataagcaaacccttcggtcccagccttagttcatatcacg

SEQ ID NO: 631521 - DNA, 166 bp, Homo sapiens
tagcaggatcctagggtcttagggagcacaatgttctatggccatcatgacattgggtagcattaactgtaagtaatgtgcttccaaatcacttattggtttgaccgaatatcttgatactcttataagactgccttcaacttttgatccctttattctattctat

SEQ ID NO: 631522 - DNA, 120 bp, Homo sapiens
cacgagaagatttccagctgttgagacagtatttttgagggctgatgttacctctagcggcgaaaccagagccagctgttaagcacccagaggtaacatcagccctcaaaaatactgtct

SEQ ID NO: 631523 - DNA, 197 bp, Homo sapiens
ttctacagatgtgaatacattaggaatcttgagctacagagattatcctggattatctgcaatgggccacacgtgtattcacaaggcatacttaaatgtggacagcaggcacagcatcagcaagcagtcagcacatccagcaaaacgcagtcttgcatgcatggaagcagcaggtttggcagtgactcagggccatt

SEQ ID NO: 631524 - DNA, 744 bp, Homo sapiens
ctttttttcttgtgttgagtatagatatacaagaagagagaccagctacacactactctcttgctgtgcgggcggcacagtcttttttgtgtgctgtgtggtggtgtataaagagagaaaaaaaaaaggagagggatgggaggtggcgctcggtgcgccacacacagcacagctcagcctgctcttggttttatatgagaagacgacacgcgacacaactttaccctctccccgccccgcgcctcttctatctgcgaggggagagagtttttcgtgtgtgagagagagagcgaggcgcgcctccctcttgcctagaagagatattctctctctcgcgctgcttgttgtttgttgtgtactgctgctgtgtgtggagtgagaggagcgcgcgcgcccgcgctcattgtttcgttgctggtgagtgtctctcccccgctgcgcgggcgcgccgcccacgcgctgcgttttcgtaatgatatatatgtatgggtgcgggtggagcagaacgacacctctctctcttctctctagtagagagactccaccacttcttgtttcggctacagaagaataatatatggagggccccccccccgtcgatcagagcaggggcaccacctccgcgcggcggcgggctcccccccgaccggcttcatcacccccccctctgcgttttttttttttttccccccccccccccccgctttttttttcccgcgggggtgtggtgttccccccctttta

SEQ ID NO: 631525 - DNA, 109 bp, Homo sapiens
gacctacgtgacttctggacatacctagcaccttcttgcataccttgaccttcttgcataccttgaccttctggcatacctgaccttctgacatagctagaccttctga

SEQ ID NO: 631526 - DNA, 404 bp, Homo sapiens
tgtctagaggctcgcgttatgacgcgtctctggtcagcctcccagtagcgggattacaggcatgtgccaccggaactggttaatattgtatttcagtagagatggagttacaccatgtgggccaggctggtctcaaactcctgacctcaggtgatccacccaccccggcatgtcaagagactggggttacaggcatgagccgctgtgcccgggcaggaactattggtccagcaggtcaaagtcactttgaatcagagctctgtatacacacaagctgggtgagtcatgcaagtcactggtaaagaggaaggacagatggcccccagaccaaaagctcagggatgtcagagaacgcatctccagagccaacccccaggcctggggttccccctccctggtccatg

SEQ ID NO: 631527 - DNA, 431 bp, Homo sapiens
  misc_feature (376)..(376): n is a, c, g, or t
ccttcttctttcccctatcccccaggggtgatccccaaacttgactgtcccactcccaggcctgggggtggcagaaggaggctcctgggtctcctgctctgccttcttctttccattcatatgcaagaagcatgcattgagcacttactggatccacagcccaaggctcagggctatgggaatctgattaggcctctgccctccacttttacagtctgcaggagggaggaggctgatggcctgaaatttcaggccttggaagtggagaggaggaaggggagagcccaggggattcaggagcggggtagactcatccggctcggggagtgtggtggggccagcagggtgggattggaggatgaggccagatcccagnaggattgggatcccgtctgccctgcccctccccagcccaggctgtgaagcaggga

SEQ ID NO: 631528 - DNA, 163 bp, Homo sapiens
  misc_feature (91)..(91): n is a, c, g, or t
  misc_feature (109)..(109): n is a, c, g, or t
gcctgggaacttccacatgcttcaggcgcagacaaaacaaaaacaaaaacaaaaaccaatagttaaaaactaacatgagtgaagtgttttnctgtatgtcaggcaattnctgatattttaatgcaaaattcaaatgttcttacaaaaacccaatgagacagat

SEQ ID NO: 631529 - DNA, 199 bp, Homo sapiens
cggtcgctctcgcgactaccccgatccccacattgcgccagttgccgtccttctgccgggcactttcccggtcattcactttccaacagcttccatcttcatcccaagctcactttgtctttttccacaccgtcatcccttctgccctcacgcgcagtcgttttttttttttttttttttgtttgttttttttttttgt

SEQ ID NO: 631530 - DNA, 504 bp, Homo sapiens
  misc_feature (453)..(453): n is a, c, g, or t
  misc_feature (473)..(473): n is a, c, g, or t
  misc_feature (496)..(496): n is a, c, g, or t
ttcctgctactatgacaaattccacactaaacatcatgggaaaaatacattccagcttcatccacattagcaatgaatttcaattcataaccttacacagttgtctttagaagtactagcattcccttcccacgttcttatctatagctacagcctccaacccatttcctgagacatatggttctgtatttcttggaaggttcgcagcaattcattactacattcaaaatcccctgagtccagctacaatgcagggtaattactccaacgtggagaagagtcaaactgcatgtgaacgtgcttctccaataattataacccatatcttcaaaagagtgacaagcatttttgcttagcttttagaatcataaggtggaagctcagttaagtactttgcataatgctattttggacagtaatcattgggagtacataggcttattcagtattggnccattggtaagcatttaaanatatttggacacgcacacacacncacacaca

SEQ ID NO: 631531 - DNA, 295 bp, Homo sapiens
cagggtgctgacagagaggatgggactgggccatacctttcacttttctttaatttggtgacatgtaatggttcaattaaaatttttttttttggagggtggagaggaatactcgggctgaaggcaggtgctgtatctgcaataccagtttcccaagtcctaagttagatgcaaaggacaagttctggctgtatttagcactgcacagaactggttgggatattagagcaccctgctcatgactacctcacacatacacacaccctatgtcctttcccaatctccctgtcagggg

SEQ ID NO: 631532 - DNA, 382 bp, Homo sapiens
caggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaatttttttcatttttttgagaggttttttttgttttgttttgttgttgttgttgttgttgttgttgttgtttttgagacagtcttggctctgtcacccaggctgggagtgcagtggcatgatctctgcaacctctacctcccaggttcaagcaattcttgtgcctcagcctcccaagtaaactggggacttacaggtgcacgctaccacaactgggtggatt

SEQ ID NO: 631533 - DNA, 302 bp, Homo sapiens
  misc_feature (35)..(35): n is a, c, g, or t
tgcgtagtacagactcaccaagcacagacttgctntccacaatgcacgcttaccttagccacgaaggtcccaagccacacgtactaagggtggacctcaaagatatgtacaggggtataaaacaaataccagggggaacagttaccttcaatacaaggtcaaaatcagcaacaagtcctacaacccagtgctgatatcagatacaagcttcaaggacaattcctttccgaaggctaatcccagttccgtgaggctagcatgaggtgtgtgctttgcgcggggcgaatttcctatcctcaata

SEQ ID NO: 631534 - DNA, 269 bp, Homo sapiens
gatatcccttttaagaaaatgtcaaagaaattttggacagactattattcatcatcatatcccttttaactgggattgtgaattatccagactgcatgttgggcataactggaagaagcatcttaactacacagaatacacgcagtttctccaggagctgcaattggaacatgcaagacaagcctttgcactcacttatcaccagcacaagtggcatgattactggtctggctttcagcgacctcatggttaccctaagatctcacatg

SEQ ID NO: 631535 - DNA, 994 bp, Homo sapiens
atgaagtaaggttccgaatggcttgaaatcaactcagttctcagtccaacaggaggagaaaactttacctttcagatatataaggctgacatgacatgtagaggcttctcgagaatatcatgaagggcttcagacctgtttgatgtggtttattgataactgctaggctttattgacgtggagtgaatgaaagatggcactacgttttctagtatttgagaaggtataatgaaggatggagctacgtctcttagcgaccgtaggctacatgaccagtcgtatacattactatgtgtagcccagacaaaacccggccagcgtgtaagtcagatgctgatttcgactccatttccgaaggtcaaggccatggtgcgtcagacttctggaacacagttcatagatacggacactgaagtttcctacagttgcttgatattacagcggaagatccagtccaaaagctatgtgaaagttacgagacttggtgcttgtgaagcttgtcaagattgccctgttatttccgcgggaaggaaattactgcgaggatacaaggacgatatggcgagtagaggcacaacagaagttcaacatagataagctagacgctagaagggtttatgaaattcttcgactactggtaactgacatgagtgatgccgaacaatacagaagctacagactggatatgagtaggaagactaattagccatataagaaaaagcagagagatctgctacgatgagaccactgtctcgaccgaagaagtgtaacagatgagccaatggaattaagctggactgaacacggggaacacagttccagactactggacattcggggttatgacgcctgggccggaaacactcggcggtcgcagcggcaccttgcaggggcgggacaggagctaacaggcgcgcccaagtcatccgatgggggtactcacacgtagcattcaccgacacggtcagcttggaaaaaggagcccaccataaag

SEQ ID NO: 631536 - DNA, 430 bp, Homo sapiens
cagccaagtggctggatggtattccaaaatggtattccaatgccgcaggattcaataaactggggttaatgcgagatgatcccatatccggggatgaagttgtaaaagaacccctaaaaagccttcctgagaccctttataatgccaggatgtttccccttaaaagggccctggccctgaacttgaagcctcagattttgcctaaaaagcagggggcccaatttgaaaaggaaaatttttcccctgacccgtttttgaaaggggtttttcgggaaaaaaaaaaaaaaaaagaatgggcaaaaaagtaatcctgtagtttaagtctgtggaaccccctgttatgaaaagggttaaacttgaacccacccattttaaaaattttttggtttgaaaatgttttcctttaaataaatgtttattgtaagggcca

SEQ ID NO: 631537 - DNA, 328 bp, Homo sapiens
atagatgtgaacaaaactaatgagaccagaaatataccctatgaccacacacttgtttgactcacacagatattcaaattgatcttagtcaaagatcaatcgattgatgatcaaggagcacaggcaattctaatggagaaaggacagtcttttcaccatatactgctggaactactgtacatccatatgcaaaaagtgaatcaagacatatctaacacctttcacagaaaccatcaaatggatcatagaccttaatgtaaaacacagagctataaaatgacagacagcaggaaaaaacctgtgtgaagttgggtactacgctttggca

SEQ ID NO: 631538 - DNA, 83 bp, Homo sapiens
ggatttgctggtgcagtacaactaggcttaatagggacatgaaaataggtcaaatcatcaagaaaagaaatgctaaaggtaaa

SEQ ID NO: 631539 - DNA, 1187 bp, Homo sapiens
atgagaccaattataaccaatgacataatctagcaaggtactaacctccatataccttctgcatcatgaatccaatctattaaataatctttgctagagggtagtaggccaatagactaaatgaagccctcggaaacccatggagcgagtctatgctaagcaacagggcgttaaacacgcagacggcaacccgtttagtgtatccagaatagtgggaagatttatagagtagaggtgacccaacctatcgagtccctggtatgactacggcttggcttgctccaacgtaataggagattctcacgttctctaacttctttacacttcgacctcattagtaaccctcatcttagaagtcgccccgttggataggatgtgtaatcctgatccagatcccacaaggcatggcaaccaagcctcctctatgggcaactaactacgcgacaaactaaaccttagtttgaaggaatgaagtcctaaataaagtccttgatatccatcacccagttaagtaaagggcccttaaaacgatatgccacccactatccctataaatttataatggaaacatgacttgtgttcctaaatttcattcacatcaaccctcaacttacccttgcaatctacacattcaccaacatcaataagttaaacacttgtatacctatcgcttccaacagaggcaacgaaactttgtgtaaccctaaatttcttcagtcaacccccgtaattagggaaagggaaaactcacagtgggatttagatcattacagcttaacatttgcaaataaccatccctcccctcctgccatttaagcacgtgccgtgtcccgccactgtcataaacccaggtggattactgggccaacatatagtcgagggccccacaattatttccgtaaacgaaattctacaggcaaacaaaagttccatttgatcttacctcctatagcttgttacacaatccaataaggaccaagggccattcggctgccacttcccttgggaaccacggtttacctatcagtgacgttaaaacaagagtaactttcgtgggctacaatctttaccccccgaccttgtaagtaccccacaataagtcttcacaccatccttatgacattctgacccaggtggattcacggaagtggcaacccgtagccttggcacaccaaggctggaccaca

SEQ ID NO: 631540 - DNA, 922 bp, Homo sapiens
aaaaaaaggaaaagaaaaaaagaaaaaaaaaaaatattaatccccaagccccacacctaatgccctccagaaaagtccagctatggtgtccctggaagaacgttccatagattttatagggaatataaaacccaatatggtacgcactcattacccttcttctatattaaacacttaaacctgtggtgtgtttagcattaaaaatgtgagaaagaagaacccattcccattcaattgtgaagtgtgtgtgggaaattattacaaaagaacattctccagaagccattagccctttgtgggttaactttctctaggttaatctcgtggacaatcctccctcccaaatactgtggctctcccagtgtttgtgaaacatgtgtgcttttttctccccctctcgaggacacccccgtggggttaagacagtggggctatcacatttatacaggggtgaacctctcctgtgaaacatgtggtgtggggggatctccatagcctgtggggcctcccacttttctcaatttctctgtgtggcccattcatatataaacacacctatacgatacaaggggctgtgagtgagaaggagtggccgcaatctccagtgagtgtgtgggggtctcaactctctgtgaggtctccgtataaaaaaccccttttcttctccaaacacagcaggaagagcactatctgtgacgcttatgggggacgtgtagctctctgtgggtgacaccccttttgtgtggaaagcccgaggtctctctccaaaggggggatataaaagggccgaagacctattttgtggcaagaggtttctcataaaaactctccttaagccctttaagaaaaggccccctagtgtctgtgggtgtttgtcccaagagaagcctttaaaggaggcccaccaaatatttgaacccga

SEQ ID NO: 631541 - DNA, 415 bp, Homo sapiens
gagacagggtcttttttctgtcccccaggctggaatgcagtggcgccatcttggctcactgcagcctctgcctcccgggctcaaatgatcctcccacctcagcccctcaagtggctgggactacaggagtgagccaccacacccagctaattttcgttttgttttgttttgttttgtgtttttgagacggagtctcactgtgttgccaggctggagtgcagtggcacaatctcggctcactgcaacctccgcctctcgggttcatgcaattctcctgcctcagcctccagagtagctaggactacaggtgtgagccatgacacccagctaatttttgttttttttgtttgtttgtttttttttttgtagagaagagattttaccatattgccctgggtggtctggtaaaatctct

SEQ ID NO: 631542 - DNA, 251 bp, Homo sapiens
gaatcgagctcggtacctccgtgatgcgcgccgagctggcggtgcgtacggctggcttgcgcgcggtgagtgcctcgatcaggcgatcgatgtcaccaccgggttcgagccggcccagctgtggcgagcgtgcgctgccggggctggccggcgtcgttgcggtacgactccaccaactgcgcatagcggtgcccgccggagctcgtgaccttgatgaacatggccgcgagtgtagccgggatgctgtgaca

SEQ ID NO: 631543 - DNA, 115 bp, Homo sapiens
cccccctggggggccccccccccgggggttccttttttgggttccccccccctccgggccccccttttttgtttggggggattttttttttaacaaaattaaaaatggaccccca

SEQ ID NO: 631544 - DNA, 162 bp, Homo sapiens
ttagagacaggctctccatgtatggtcaggctagtctcgaactcctgacctcaggtgatccgcccgacctcggcctccaaagtgctgggattacgggcatgagccatcgcgcccggcaatatgctgttaactgtatatatatctgttgaaagaggagggtgg

SEQ ID NO: 631545 - DNA, 127 bp, Homo sapiens
gctggatgttactcacatcaatctcatttaaaaattgtcagcattggcacatcgtattctggggctcttcagacgctggagcaatgcactgccgcatcctgttcattttctcctgcatgttctgaat

SEQ ID NO: 631546 - DNA, 108 bp, Homo sapiens
tggcagggtgaagcacgcaagatcatgccactgcaccgtcatcttacgcagattggagcaaaagattctccttgtcagcttgatggaataaacagatatgttgcgaaa

SEQ ID NO: 631547 - DNA, 787 bp, Homo sapiens
tgtaactcaacaccatggggaaggtgaaggtcggagtcaacggacttatggtcgatattgggcgcctggtcgagccagtgtctgcttttaactctggtaaagtggatatgttgccatcaatgacccctatcattgacctcaactacatggttatacatgtatccaatatgattccacccatggcaaattccatggacaccgtcaaggctgagaacgggaagcttgtcatcaaaggaaatacacatcaccatacttccaggagcgagatccctccaaaatcaagtggggcgatgcatggcgctgagtacgtcgctggaagatccacagggcgacttcaaccaccactggagaaggctggcggctcaataagcacgggccaggagccaaaaagggacaatcactcatacatgacccccatctgactagaatgcccccattgtacgacatggcgtgtagacaccagtgagaagtatagacaaacagccatacaagatcacacagcaaatgcctcctgacaccacacaacatgacgatagacaccccgtggccaacggtacatcccatgaacaaacaatagtgaaattcgaaagaacgcgagctcaatgaccaacagcaccatgccacaacacatagcacccaggaaggacctagtggataggacccctccgaggaaaacagaggacagatgcaccagcggggctcacccagaacatcatcatgacacactacgcaagacgcccaaggcctacgagacaaagccaaccacaaaagaaaccagagaacacac

SEQ ID NO: 631548 - DNA, 1091 bp, Homo sapiens
tgtggctgcatgaatagatgtgagtgcatggatgtacgtcgtgcgtcagtagctagtgtagtgcgctgtatcaaactcataaggatcatcgtacatgttgatgtgtatgaaccgtacagccgcggcatatggcgagtcggatggtgataaacgcacgggtatagtgattcatgtgattggtgtgtgcgcttagtgtatgtgtgcgggtaagacgttgattgttgtatggaggtgtggatcgtttctatgtcccagattgtgtattagtcatgattataacatgagtgctggagaatcgaagtttgcatagcatggcgggtgagtgcgtggttgtctacagtggcgacgtctaatggtgtttcgatgacggaatattgaatgattgtctgatggattctcctcgtatcatcaatgaagattgagtactgaatatggaagtgtctacgtatatgggatagagtagaggttgactgtaaggaggaggtctcattagtcgggatgagctcgtaatcatgatcgtgattagcatcagtccagtttgcttgatctactatttatgtacaatgttgtgggcgtgagttaatagcgatgtgcgtttacatacgaatgtagagtgctatattgttgattgtctccgttcaaggcatattcgacatctcagtgtagttcaagaatggatgtggtggtcaacagtgttgcttgttcattagcttaggtagggaagtagatcccgtatttccgtgattctagatatggtcaggttgagatcggcatgtacgtccgcatggctctgttagccccctgggtgggtcgattctagggcctgtgttccacaacctcttctctttaggcccaactgctggacaaggaatttcagtgcctcctacgggggcagcacacttagattttcctggacattcagatagctcacatgtgctgaccacacttcaggctctggactggagctctctggcatgggggtagggcctcagatgctgggggccagtctgccccatcttcattcctgcacctttaacctgtgcaattctatttatactggcttaatgaacagcccagctgtcccttgggag

SEQ ID NO: 631549 - DNA, 546 bp, Homo sapiens
gaacaactttagaatgaaggaaatatgcaaaagaaggatcagataaaggatcaatgtgaattacgcatcgtattaattgactatatgtgggtaattatgactatttcccaagcattctagatcgacctgcgagagaacagcactgataacgaacctgacacgtggctgacagcagaggaaacaagaggcccaccgaacaactccagagaagaaaaccacaccgaagcacacacagacaaaacaccaccacaaaaacacaaccaaacgaaaaaccagcgaacagcgacacacaaaacaaagaggaacacaggactgaaacaaaaaacaaaaaccacacagacaaacagaatccacaaggacccgacccacccaccagccaaaagacaaccaagcaagacaaagaaaagaaagcaaaacagaccacacgcgaccacgaagcgcacaccacgcagacaaaccaacaacaccacgaacgaacacacacgaacacccacagcgcgaccaccgcggacaccgccacaaccaaacaccagagacacaaaagac

SEQ ID NO: 631550 - DNA, 330 bp, Homo sapiens
agtgggtagttacgtcgactctgtagcttgtacgcgtggagctgtgaccggaacccggtgtgctgaatcttgtatgtccttctgtcttcctaatcccatagctcactatgcgtgacgtgcatctccagtccacaggttgagtcacgcgtctaggtcgtccaagacttggctcactggccatgccttgtcgtagctacgtatcatgccttggtcacaccggtcttcctactcccggatggtcgagatgctcaacgtgatacattgaccatcgggtggatcgatcatgactccttcatacaatgcgttctttcacgttgagaacgcgtgacg

SEQ ID NO: 631551 - DNA, 538 bp, Homo sapiens
  misc_feature (482)..(482): n is a, c, g, or t
gccatcgtgcagccccacgggtctcagaggtgggtgacctccaggatgggagacaagccaatttgggagcagattggatccagctttattcaacattactaccagttatttgataacgacagaacccaactaggcgcaatttatattgatgcatcatgccttacatgggaaggacagcagttccaggggaaagctgccattgtggagaagctatctagccttccgttccagaaaattcagcatagcatcacggcgcaggaccaccaagcctacaccagatagctgcatcatcagcatggttgtgggccagctcaaggctgatgaagatcccatcatgggtttccaccagatgtttctattaaagaacatcaacgatgcttgggtttgcaccaatgacatgttcaggcttgcctgcacaacttcggctgacctcctcctggccacagtcacgctgtttcctcctcctcttccatcctagctantcctccagatgctccaatatcatcacaaagagcagggcgagcggacggggtgcagg

SEQ ID NO: 631552 - DNA, 570 bp, Homo sapiens
  misc_feature (97)..(97): n is a, c, g, or t
aaagggggcccaaaattaaaatgtagccctgtgtgggtgcgcatatatttggaaattcccctcacttataagatggtaagccttataatgcagggcntttgggtttatttgaccccctgccctcaaaaatttggggggcgtaagcctttgccccgcccctgagttaattgcagctctcacaggctgaaaggttttaaatggcaactgccgtgtttttcccttgtgctctaaagcatatggttttttaaaaatgcccgtgtattttacacaggcagacagaaaagttttgtttctagccaagaaaaaaaaagcttcgcagtttttatgtatctatctcacctcaaggggggaaaagtcagcattttttatatatcggaagttctgaataaacggacctgccaatatttgaagggcctggcgattcttaagagggatgagaatattttttccatgacagcctatatcaagtgtaggttttgctagctgaagtaaaaacagttctaaaaatagccaaatgattatggtcggaacaaatataccctggataccttctgctattgtgaaagcttt

SEQ ID NO: 631553 - DNA, 1329 bp, Homo sapiens
  misc_feature (258)..(259): n is a, c, g, or t
  misc_feature (1329)..(1329): n is a, c, g, or t
gccaaccctttacaactggcccagaccgtaatggccatttcttcttaaaaaaaaaaaaattgttgttttttttattatttcttattgtggcggtggtgtgtggtggtggtggtggtggtggtggtgcgggacagaggggtggtgggggtgcggggagaagtgcggagcggtgaacatactccagagtgtgtgacaacaccacgaatgaagtggtggctcgtgctgtgcctcctcgtggcttatagcacacagaggctnnttaagagacaccacagagtgggagtatttcacgagtgggaggccagaggacacagagagagagagtgtgcgctaaaagtgtgagagtgtgcctgtgtgtgtgttcacgagaaacagagagcctatttactccagagggtgtgggggttttactcccaaaacagcgtaggattgtgtgtgtataaagagtctctcgcgaggggctcgagcggtgttcttataccactaagagagacaacacatctctattctcgaggatacaactgatctgagagaacaaagatgtttggaggaaaaaaaaactatatatatcaaaatataacacgcgtggtcttttaaaacaaaaaaaaaaaaaaaaaaaaaaaaacaaaaaaaaaaaaaaaaaaaaacaaaaaaaaaaaaaaacacaaaaaaaaaaaaaaaaaaagggggggggggggaggaaaatctcccccgcgggggcccaacaaatagacagacgccagcgaatttgtaatagcaaaaggggcgccccaacaaaaggggcgcacaaacaaaacagacaaagcggcggcgggagcaaaaaaacaagggggaagggaaaaacaacaacaacggtgaccatagaggaagaccccaccccccacaggggagggggacacaaacaaggggaaacaacaccaacgcaaagaaactacacacgcaccgagagagaaacaaccacagggaggggggccgaggacggcaccacccgcgcgatcaaactgcgcggcccgcagaaaaacggcccgcgagagagattaacgagaaaatataaacgcgggggagtgtcatcatgacctatcacacacagcaccaaccaaataaaagccaaagagaggaaacaaagaaccaaggaaggacggcggagcggagaagaacagaagacagaaacgaagggagggggaagcagaaaaagaacaaaacacgacaaaccaaacagagcaccacacacgagcgacgacaagaaaaagacagaaacgaagacagcgacagccgacaaggaaacgcagaaaacaagaaggagaaaaaaagaagggggaagcgtgagan

SEQ ID NO: 631554 - DNA, 828 bp, Homo sapiens
agcgggggtgccgaggctcggccggagcgtgagccctgcgcctgtgcccaggaccgcgcccgcgcctttgtccgcgcgtccgtccctccaagtacttgcccccgggacaagttggatgtcgctggaccgcgtcaacacggatggacgacatcatgtgtcagcgatcacatttgaacgagcaagcactgtctattgaagtgaggcccaccgactattgatacttagtatgtgaccatcaacaaaggtcttattcagctatgcaccatgtgcatcaattaggggactgaccgtgacgaacataatattatgtctaaacgaaccgcgcaacagcaagcggttcataaatactattaggatacgtgcacaacggacggttggtcaatagctagtggaatgatgatggcaagaaggaaccgttatgaagcaacatcgggttacagagctgtcgactggggagaatcattgcccgatcggtttttagtcgtttgtggcgtaaaggctccttgagagccattacggtgcatagttttatgaactagaagtatgttcaaggcagatgatgttatatcaccaagcgacgtttgtaggcccagttaagcagtagtggtcgagataacttacccggcaaagcccccagaagccccgggaggccacacatacgatggacccaagaatagattgctgcaaatagttatgccgagtggtttccacggatatggcgccactcccatctgatggcgtagcccaagaagtcgatccctacagcggattcactatcaaatggtagtacagaagcgagagagccgacactggggttgctcggcaaga

SEQ ID NO: 631555 - DNA, 596 bp, Homo sapiens
  misc_feature (15)..(15): n is a, c, g, or t
  misc_feature (166)..(166): n is a, c, g, or t
  misc_feature (189)..(190): n is a, c, g, or t
  misc_feature (209)..(209): n is a, c, g, or t
  misc_feature (212)..(212): n is a, c, g, or t
  misc_feature (330)..(330): n is a, c, g, or t
  misc_feature (346)..(347): n is a, c, g, or t
  misc_feature (377)..(377): n is a, c, g, or t
  misc_feature (434)..(434): n is a, c, g, or t
  misc_feature (441)..(441): n is a, c, g, or t
  misc_feature (501)..(501): n is a, c, g, or t
  misc_feature (524)..(524): n is a, c, g, or t
  misc_feature (565)..(565): n is a, c, g, or t
gcggcgggcgcgcantcggcgggaggcgggcgcccggagacgcggctggggcccgcgcggccggggcgccgtcccagggcagggctgcccggccccgtgccccgtggccgcccgcgctccccatgaaaaaccagctccgcggccccctcagcgcgggcgcacattntcgacttcgggggtggcggcggnngggggcacccgggcggggnccnaccccggtgcggggccggggtccggcgcaggtaccggggcgggcgcggcgacgggggcaggggccatgccctgcaagagcgccgagtggctgcaggaggagctggaggcgcgcggcgncgcgtccttgctgctnntcgactgccggccgcacgagctcttcgagncgtcgcacattcgagtatcggccattcaacctggccatcccgggcctcatgttgcgncgcctgncgcaaggtgcaacctgcccatccgctccatcatccccaaccacgcctgactaaggagcgnttcgccacgcgctgcaaggcggnccaccgtgctgctctacgacgaggccacggccgagtggcancccgagcccggcgctcccgcctcctgtgctc

SEQ ID NO: 631556 - DNA, 215 bp, Homo sapiens
gagctccagtcaatgagaactgaggccccgatggaagggagatgcgcagtgcactgcagctggcgcggtggaggagctggcattgacctgcagcagactggcctctccgtgcctgcgcacccggtgtcagcacgctgcagggaattaaacccatatgcttcctactgtgcagtcaagtggtgacagcggtcctcatgagatgtgaagcccagggt

SEQ ID NO: 631557 - DNA, 125 bp, Homo sapiens
cccttcagcattattatttctctaaagtagccagtgggcaaatctccagtttgttttttttttttaactttgagacaggatctccctctgccctccagcctgggcgacagcgagactccgtctca

SEQ ID NO: 631558 - DNA, 980 bp, Homo sapiens
  misc_feature (632)..(632): n is a, c, g, or t
  misc_feature (638)..(638): n is a, c, g, or t
  misc_feature (644)..(644): n is a, c, g, or t
  misc_feature (652)..(652): n is a, c, g, or t
  misc_feature (667)..(670): n is a, c, g, or t
  misc_feature (674)..(674): n is a, c, g, or t
  misc_feature (680)..(684): n is a, c, g, or t
  misc_feature (724)..(724): n is a, c, g, or t
  misc_feature (767)..(767): n is a, c, g, or t
  misc_feature (799)..(799): n is a, c, g, or t
  misc_feature (805)..(805): n is a, c, g, or t
  misc_feature (812)..(812): n is a, c, g, or t
  misc_feature (833)..(833): n is a, c, g, or t
  misc_feature (860)..(862): n is a, c, g, or t
  misc_feature (870)..(872): n is a, c, g, or t
ggggtgctctcgttgatgaagcacatgtatgaggagaccagcagcaaaacataaccatatgtgtttggcgtttacttcctttagaaaagaatttgcaggcaaccatgtttatttggacttttttagaagggagaattttgaagcttgggattaatgagttttatatggcttattttaagattccgaaaggttacacattcattcggtttttgagaaattccatgagattcaaactgctccctattattggggtattaatttgcactaatagcaaaatgtaatggcagatcagctttgagagtggtcctaagcagtaaactggatgatgttgcattagacatcaataattcatatttaagttttagtagttactactgatttgataatcactttaaatttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgnaactgnatacanatccctgnaaaccatgattggcnnnngttngatacnnnnnacgaatatctccaaggcctatattgtctgggatgtcgaanaatggtcccagaatttccaattcaactatagagttaatgtgangctatactattggaaaaatagcagcttttttntatttnataagtngtatgcataaacataagattngtaatgtttcatttataaactgccttnnncaacacannntaatagtgttttctcaagagtattgatagtatgtcttccagaatttcacaatatgcttacagtaaatatttcctagcttgttgaaatgttcaaaaacaaataaaaaag

SEQ ID NO: 631559 - DNA, 505 bp, Homo sapiens
  misc_feature (462)..(462): n is a, c, g, or t
  misc_feature (473)..(473): n is a, c, g, or t
ggctgggcacttcacaaggatggagctacatttgtttatcaccgtagttccagtactgatgtagatctggcacatagatactcggtaaatatattgaaaactcagtacaactaaatatttactatttggccactctgtgtcatgcaattcagttttgtcccccaatcacaattccaactgtgactacattgaacttgatgcatttatagcttatatttgtaggataagtcattatcctattttctgaccttataggtaaacactttagagtttatatctgttttctaaaataaccacatattagggaccctgtcattgaccaagaacacacaaaaagtgctttcatgagccccgaagacagaaggcaaggcaagagcattgttccgaaacaggtttctagtgttcatgtctagcagcttctttattttgcacttgacccggatttaacctgttactccgggnttatttcctanactgggtttaataaactcgtgttgacccctgt

SEQ ID NO: 631560 - DNA, 253 bp, Homo sapiens
cgagaaatcacttgaacctggagagatagaggttgctgtgagccgagattgtgccattgcacaccagcctgggcaacaagagcaaaaccctgtcgcaaaaaaaaaaaaaaaggggggcaagggatatacccggttatttctcaaaaaagaacttcggtgcacatatagccccacaaaaagattgctaagaactcataaaaagctgtgggaaaaaacgggagacttatgggaccatccttctcaacttaaaaat

SEQ ID NO: 631561 - DNA, 1013 bp, Homo sapiens
  misc_feature (632)..(632): n is a, c, g, or t
  misc_feature (638)..(638): n is a, c, g, or t
  misc_feature (644)..(644): n is a, c, g, or t
  misc_feature (652)..(652): n is a, c, g, or t
  misc_feature (800)..(800): n is a, c, g, or t
  misc_feature (832)..(832): n is a, c, g, or t
  misc_feature (838)..(838): n is a, c, g, or t
  misc_feature (845)..(845): n is a, c, g, or t
  misc_feature (866)..(866): n is a, c, g, or t
  misc_feature (893)..(895): n is a, c, g, or t
  misc_feature (903)..(905): n is a, c, g, or t
ggggtgctctcgttgatgaagcacatgtatgaggagaccagcagcaaaacataaccatatgtgtttggcgtttacttcctttagaaaagaatttgcaggcaaccatgtttatttggacttttttagaagggagaattttgaagcttgggattaatgagttttatatggcttattttaagattccgaaaggttacacattcattcggtttttgagaaattccatgagattcaaactgctccctattattggggtattaatttgcactaatagcaaaatgtaatggcagatcagctttgagagtggtcctaagcagtaaactggatgatgttgcattagacatcaataattcatatttaagttttagtagttactactgatttgataatcactttaaatttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgnaactgnatacanatccctgnaaaccatgattagggatatgttgtgatatcacatgatggagtgatctttctaaggacgagtattctgctgcgtaggaggtgtgaatcatctgttgtcgtacagttagtcctatcatatactctaatctatatgagtgtgagatgtgangctatactattggaaaaatagcagcttttttntatttnataagtngtatgcataaacataagattngtaatgtttcatttataaactgccttnnncaacacannntaatagtgttttctcaagagtattgatagtatgtcttccagaatttcacaatatgcttacagtaaatatttcctagcttgttgaaatgttcaaaaacaaataaaaaag

SEQ ID NO: 631562 - DNA, 109 bp, Homo sapiens
atcatcaaggctggccggctgcgcccgacgctgcgctcgtcaccagctggtactcggcattgctgcccgggcggtcaatgacgccggcgtagtagaccgcatcgccagt

SEQ ID NO: 631563 - DNA, 541 bp, Homo sapiens
agatagcgatcagaaccagcccgacgccatctgggtagccgccgccaaccgttgtgcaggacgcctgcacagaggccacccactgcgtaggcggcgccgtagagaaacaaggtcaatgagtactcatggggtgacagctttaactggtccatgaaaatgagcggtgacacaacgatgaatgagaaatgacaggcgaaggtgatcgcggagatcgtggcgtagctggcgaaatgtctgttggcgaaaaccttggcgtaggccctgaaaataccccgctcgcctggcgcggttggagggaagccgccatgcagtaatcggtgagccataatccacgttgcggcacagagggcgataaacgcgtagaagctggctttccatccccagtgcaattgcagccatgcgcccagcactggggaaatcgagatgacaatgcctccggccgtggccattgctatgcgcaaccgctcctgttccctgccgaaaaaaaggcctgcaccacgcttgggcagttgaaaccccgagcttggctgatgatcggaga

SEQ ID NO: 631564 - DNA, 830 bp, Homo sapiens
  misc_feature (71)..(71): n is a, c, g, or t
  misc_feature (91)..(91): n is a, c, g, or t
  misc_feature (102)..(102): n is a, c, g, or t
  misc_feature (106)..(106): n is a, c, g, or t
  misc_feature (154)..(154): n is a, c, g, or t
tacccctccttagctttatgcgctcaaaaaccaaattaaaccccccccccatgtaacgggggggcaggganaaaagcaaaaacgcacaaanccagccggganaccnccacgtcctgccccccgccatttatcgccctgatggattttggttttncatctgtccctgtggctggggttagagttcgaagtgggtggacgcctccgggggggcactgagccattgagccccctgggagaatgtcagaggggatgtggaaaaggccactgtctccggcccgtggcttatctgtggggcaacaggtggttgtggtctcccccagaaagtctcccgtgagagggggccgtgaagtggtgggggtcttggcgaccaggggttcctcactctcgaggtgtgcctcacgggagggtgtcctctcggtagtggcccccggggagagggggacctccgtgggacgtgggccatagcaagcgcctggcgccctgggaggcgggagacagcgggcgtctaacgccagcgtgcttgcgtgtaacaccccacggggcgggtcccccccctccaacggctggggggcgcatggtgttgcgtgcccgcccttcgcgaacaccttgtggtggggaagcccctgctccgttctacccccgtcggtggtcaaaactcgtgtgaccccggtccccactcagacacccttggcccttggtccacaagagagaggttcccgaagccctctggtggggcccccttagggcgcacaggtgtggtcctaaggcccgcatatcaagagacggccaccgccgggcttgggccccagtaagacgggaaagtgccaggt

SEQ ID NO: 631565 - DNA, 552 bp, Homo sapiens
  misc_feature (18)..(18): n is a, c, g, or t
atttccagagcaaaaggnccggtcatttaggacaacagtggacaggcgtatgggggtgatgggcagggggaccctgttcctgttgtttggctgctctcaggcgttcagctggtcaccctgggagaggggtgagggcaggccctctgctttaactcacttgtgtggtaggaggaaaagcaaattgtttccagatgaggggaggctgcctggggagtggaatttgtgccccgtctgcgcacagcagcctctctgggcctacaggaccctgtgtctttgtgttcagacaagccctgctgtgtagaggcctgagctttctgccgccgacttgggctcagtgccccgaggcaggcagatggaggagtgcggcagatgtgccgtcctctcccaggggagggaagctccttctgtttccgagtgaagtctgggccaacatgccccgtattttacctatccctttccttctaagtagttcagatcactttcagaacgtcacttccataatccttatatttatgctccccgaggaagtaaggaagatatttttccttgtct

SEQ ID NO: 631566 - DNA, 269 bp, Homo sapiens
cgccgaagttttctccggttcgggagagagacggagcccgctctgtcacgcaggctgccaggctggcgtacagtggcgcaatctcagctcgctgcaacctccacctcctgggttcaagcgatttttttgcctctgcctcctgagtagctgggattactggcacacaccaccatgcacagttgcaggaatttagccaattcagaggtcttgttctccataatttggaattttccttcggattttgatcaagttggatagagttggtcaaa

SEQ ID NO: 631567 - DNA, 948 bp, Homo sapiens
  misc_feature (1)..(1): n is a, c, g, or t
  misc_feature (839)..(839): n is a, c, g, or t
nggccgagtttcagcctagtttcgaaattattctcggcgcataattgccgactcccttgcggggttatttgcacccccgcggtttttaggggccgcgtcgtgccgcccgattgtctctcttgaagaatggtgttctccccccctgtggaggctctccacagggcaacaaaaaggtgctcagcgttgatctttaaccgaattcttatagcccagagggttgagcaagcaaatttccgcactctggagcgttctctttgggagcgccaactgacctaccgaggggttccttaacactcaacgggggggtagaagaggaagctgtctcctcatcgggggggccagagaagattctttttgccagacagttgtggaggggtcaccagaccttctcgggcccccgccttttatatccccctggtgaaggccccacttctttttgtgcattttaaaaagcgagagggggacatttctaaccgcgcactatatttctgatcacttctcaaatagtgctcgcagtgcttactcccgagagatactctttaaaggccacattcttttcataacaagagagcggcaaccccccgatgaggccgagcttactcaaatcactgctgttttagaccacccaccccacccgggggcaatccctcaccgctacatccccctacagtcgcacactattctactacgcccgcactccctaaactggtaacaaacacacaatccgtgtgtgagctataggcggtaaaccatcatgctgtaacaaaacaattctatccttaaaggtgtaaataactcttctggaccacacaaaagttctcgagacgggggcaaagagnaaaaataagcgaaaaatactgggtacattctaaacagacacgaccaacaacaccctctgacaaaagaaaaagctcactttccccccaaaaaaagacaaaccacacaaca

SEQ ID NO: 631568 - DNA, 217 bp, Homo sapiens
tgccataacctccacaggctgctgtaacaaaataccatagactagtggtttaaacagcagacatttatttctcacggttctggaggctgggaagtccaagattcagttcttggcgagggccctctttcttgacttggccattttcttaattaatgccctgacagggatggagaagagagagtttaacgagtctactatcttcttacttataatagca

SEQ ID NO: 631569 - DNA, 610 bp, Homo sapiens
ccctgatagcccttcgagagtgtgcatgttggcagactacagtctccgtgcccatttcccaagatataggcaatgcacatatggcccagctgtaatgagttcataagttgcgcgcgcatcacaaaggaggactcagagtctctcctccttgaatgtgaatcgcaagtgccatggccctcaggaatggatctgaacgtggaaagccaccacacagaatgcatctggagcgaatgcactgtctgcaatctttgacacactcatgcaatcacctaccttaatcccttgattttctaagttttcttaaaataatctaaaattccttgctgaaattctaatccagctctatggagcaagacttctttggtgcttaagaacagtctgatgggctggaacgcaggttatttgaggtaccctcaatttagataccaccattaaacccttagttctccctagaattttgacctcttaaaatgatccctaccacccgtgtctcagttaagtatgaaatttatgtgttgagagatatctaataaaagtatgtcttttcttcataatgatagtcacttatactatcacattaaatatgcattctgaaaacacaaaataaacc

SEQ ID NO: 631570 - DNA, 1099 bp, Homo sapiens
  misc_feature (2)..(2): n is a, c, g, or t
  misc_feature (1099)..(1099): n is a, c, g, or t
anccacgcgtccgttgctctatctcgactgtagtgtgtagtgtgtgcgtgtctgtgcatgcttgatgcccgtgatatagagtcacttgtggcgagttgctgatcgacggatagtgtgttggctgagtgacttagtagtgcgtgagagtgctcatcctggacagaaaacatttgtgcctcgcgtagatgatcactggtaagaactagccttgctaatatgcgggacacggatgcgtggcgcgtggcggtaacactacacacagatcacgtgcaaacaacataagctagataggatgactcactgaatgtatgtagccgcgtgttgtgaagactgatggggtgcgaacgaggattggctcatcggaagtgtaataatacctgtggtatcaaagagggtagatctccacaatcttcgccaaagatgtgtgtccgtgccatttgggtcggtgctgatggtccttgcgaaggacgcgtgagtcgcgtcaaagctgttgaaatactcattgtctacttaaagactggtcacacataatcgatgactactgtgcggctagtgctaacggttccctaatactacaaatcgtgctgtatgccttactgtggaaccgccaggtagaatggagtcatgagtaatcggtgatcaaatgtgagggaaaactgatgaggttaggaaatggcccccaaaaagtaatggcttctggagggactgctcagtctgggatgggagccctttcctaggggggcactgtatgcaaggtgggacttggccagcttgggaccagctttagagggagggctgtcgttggggaaacacgagccactgccgatggattttaccaagccagctgccccctagaggcattaggacgtgtatctcgcaggtgccagattgagtagcaaccccagttgggggggaacaacgggcccggaggccgaaattgattggacgtatggcccatatcggcgcgaaacccgcccccaaagccccctcgtgttgagctcccccgcgcgttataattgttgagacgagtggtgtctaatatcaaaaaacacgcgtcctccaccccatctcataggtacagttagcaatgtatgaccan

SEQ ID NO: 631571 - DNA, 456 bp, Homo sapiens
  misc_feature (5)..(5): n is a, c, g, or t
  misc_feature (57)..(57): n is a, c, g, or t
  misc_feature (99)..(99): n is a, c, g, or t
  misc_feature (127)..(128): n is a, c, g, or t
  misc_feature (155)..(156): n is a, c, g, or t
  misc_feature (165)..(165): n is a, c, g, or t
  misc_feature (170)..(170): n is a, c, g, or t
agganggagctaaaagtcagctaagaacaaaatccttatcagacgattataataatntcgtccgtcgcttttgaaattgcatgtttcgactcatctccngatgcactgaaagttgtatttctaaganngcgtcagcaccttttttaatgtgtacnnctgtgaccncgtcntcagcattaactccatttgctgaaagaacttgaggaggataggatttggtattgattccttcaatacgttgactcctccagatttcactgtaaccattagccttggcttctagattgtctttaacttaattttctgtagttcattattacagtcactctgttagcactcacttcctcaggtcacttttcctttcccattactttctttctttctttgagaggttgcagtgagccgagattgtgccattgcactacagcctgggtgacagagcgagactttgtttgg

SEQ ID NO: 631572 - DNA, 232 bp, Homo sapiens
ctagaggatcccctgagactacaggctgtgccaccacgcccagctaattttggtatttttagtagagatggggtttggcgtgtggacagccgggtctcaaacgcctcacctgttgatctgccttcctcggcctcgcaagatgctgggattacaggcgtgagccaccgtgcccagcagaaagtcttttatagggccctgaaagcacacagttaaatttaagaggacaggcaca

SEQ ID NO: 631573 - DNA, 1060 bp, Homo sapiens
gtgctgagccaggcaccagtgggcgggttggtgagaacaagcgccttacgaaaggcggccgaaagggagccagagatggaacacgtggtttgatccaattttcttacgaacatgattggtatgattgtcgaaacgcagccgtgtcgatgtggcaagtatacatgaaccatacttggaagatgacggctcgtcatccatggacccatacggtaactcgaatagcttgctatcctgaatgtgtctcgaagggtcggaggtggtgtagaagatgagatcttggacttgcatcttgcatggaatgcagtgaagttagcatttaagcacaagagttactatgcatgcatggactgaaagtatgtacaggggtaaaaactgcctgactaacttccatggcatggatcttacccgtgacaacaatcgggttccatgtgtcaaaagacagggcagacaatgacttgaagctcacgttgatgtcaagactaccgatggttacttgcttcgtgctgttctggtgttggttttactaaagaaagcgcaacaatcagatacggaatgacctcttatgctcagcaccaagcaggtccgccaaatccggaagaagatgctggacatcatgacccgagaggtgcagacaaatgacttgaaggaagtggtcaataaattgattccagacagcattggaagagacatagacaagggttagccaatctatttatcctctccatgatgtctacgttagaacaacgtcaacaatgctggagaagcccaagtttgaattgggaaaaggtcatggagcttcatggcgaggcagagtctgggacaagccactggggacgagaacagtgctaagttgaaagagtggtgtgttttgagcccccaggtccaggaacccggttcaagcgtcggacctcacatcgtggcgcacaaaaaggggggttgtcggccaaagggaggaccacaaacaaatcggggcacataatcagtgggcaaaggaatataagggagaggcaatgagtcggcgcaccatgtaaaagaatgcgagccataggcacaagaacaa

SEQ ID NO: 631574 - DNA, 341 bp, Homo sapiens
gtttttgggggcccattttggggttttttttttccgggggggggggcctacaccttccccaagggggcaaaattttctggaaatttcaaagaaaatggggggggggggggggggggattttctttttccccggggctagggggggggggtaactttttttttaccgcccccccccccccgaaattaaagccccccctgggggtgggggtttaaaataaagggggaattttttaattgggcctttttttttgaggggaacccccttttttttttttttgaaaaggcctcaaaccccccccctttaggtttgccaaaaaaacccccccccgcttcccccttta

SEQ ID NO: 631575 - DNA, 1244 bp, Homo sapiens
  misc_feature (1057)..(1057): n is a, c, g, or t
tcaggcggccggaaaaatggcggactttcaaactgaccttgcctaccaaaaggcaggccggaccatttttcaaaacaagagaaagaggggtcctggctggggaagaaattgggcaagggaagaagtctcccgagggtcactacaaagaacttcggagtctggggtcttacaaagacaacccaaaggaggcgctatgtggagggccacctatacaattgtgaagcaacgaaagatgtgcccctttacagcgtggtataaagtggtgtctcacaatctcggaggcgcggaatctcctctcttctgtggcgcgtgtggtgtgcaacacaaaagaatatgaaaaaaaattttgcccaaaaaagagagaacccatgtgtgtgctcgatactccgcgcgcgcgagaggaaaacataatctctgtggagcacacatatcgatttcgcagcgcggagaaggttttacatcaacagcgccgcgatattctgcgagaagaaaagtagagcgggacccacaacaagaggaaaacagcagatgttgttctttctagtggtgcttacaaacacacccctgttgtgttttcccccccccccgctgatgatgctacttcttacggaggggggggacaagcagtagcttctgcggaagaaaaacctgcgcgagtggctgaacactcagatacttgcgggtgctaacaaccaggaagatggttggaggcagacgccggaaaaacgatgtggcaccgcagggagagcgacctacttcctgttggaagcaagcgcacgaaaaagaacacaacagaaggatgtatgacagcagcctttttattcataaaagaccgagtgatggccgctttcacaacgaaggtgggttgtttacacacaccaccgatgaagggggcggctgttgttccccccggggggggacataaacccacctgacacaatacacaaaagcaagcacgcgagagatgtattttctgatcccaccgcgaagggaacaaagtaaacgttctttcactacccgatggacagaaggtgtggccttgttgggagagacacancaaaattttttcgcgggggggtacccccgcaggtgttttctccccccgcgtacagaaacacaataactgtgtgtgacagaacattttttatgcaagacgatgcttgtgagataatttatagcttgatgcctcatcaccaatggtcttttaacagcgatgacaggaacagacatcaacacagcaagta

SEQ ID NO: 631576 - DNA, 400 bp, Homo sapiens
agcataactctgatagactaggtgatagctgagcatttctatcatatacgtgtaggccatgtagtatatcttcttttaaaaaaagtctattcatgtctttgcccaccttttaatgggatcttctatgtaaattgctgtagttgaagtgtctgaattccttgaatattctggataatcagtaccctatcagataaatagttagcaaacattttctctacataactaacaggctagtctacttcgatctcctgctgatttctcttgctactgtagaaagcttattggtttcgataaggcccatttgtctatttctgtaaaagtagcctgtgtaaaagaggtcttagtcactgatactaagcctatataaatgtccagaagagtttccctaggtaaattctca

SEQ ID NO: 631577 - DNA, 606 bp, Homo sapiens
tcatctccataagggggacatagagtgagtgaggcagacgatcggacagtgaaaattgctcctaaaaggcctttgtcacctccatagagtagcggtggggtcaacactggggcaattagaaggcttccagacattttcacaatgaactcctctgtgctttgtggtagaaattaaaggcttgttaagtctacagagcaactcaagcaccagattccccaaaccttcttttttctatcctggcctgatttcttcctctccccacccaggctcattggcttcattcccacaggaggcaatgcagctaaacagatgcaccctggcagcaggcttaatcaggcagctttatgttcctcgtggtgagtgatgagttggccaggcaatgtggagcagtgatagggcactggttagccaggtgccactccccgaggcggttcagaggatctaggggaacactagaaaggcttcatctgccatgattggccttgttgtctaggctgtaaggaccaaaggctaaaactgacactttcctgaatgcattttcttgtttgttattcccccaaaccaagctccattaaagtggtcatggatattagctagatgtggtaa

SEQ ID NO: 631578 - DNA, 548 bp, Homo sapiens
  misc_feature (323)..(323): n is a, c, g, or t
  misc_feature (327)..(327): n is a, c, g, or t
  misc_feature (402)..(402): n is a, c, g, or t
  misc_feature (489)..(489): n is a, c, g, or t
ctaggtggaaagcgacgtattccttgtcggcaccgtgtactggtaggagtaccgctggttgccactctggtcctcataaaccgtgggcacaatcttcaggatgtagtcgtgggaggccagggggttggaggtgagtctgtctgctcccccgagagcattgaaagctccgtggatgttctggacctgtagcgtgtccccaaaggagagcttgtggatgacatgcgtcatgtctgggttctgtggctgggctgtggcactgtgtgtggacacgtggaagttgccggggaccttgttgatgctgaactgcccctcgaagcggcagnctgncccattgttcagcgggatcttcagggagttgtcgatgtggcccgtgtggctgtaggcgatgtattcctggttggncagcgtgtactggtaggagtaccgctggttgccactcttgtcctcgtagaacgtgggcacaatcttcaggatgtagtcgtgggaggncagggggttggaggtgagtctgtgtgttccctgtgagcatttgaaaggtcggggatgtc

SEQ ID NO: 631579 - DNA, 155 bp, Homo sapiens
tatctaccactcattcatgggccagctgctgcagtgtgagtcccaggtgctaggctccgaaatagttcggcagaggctgggagccccgccataggctgtagatcgaccgaggacaactccaccaccacacgtgttcacattaccccgtactccat

SEQ ID NO: 631580 - DNA, 345 bp, Homo sapiens
aacacagtaagtgcaaaagacgtgttaagtaaataaaacagcgaatatattatctacctcttaactttggctcacatctatcaatccacaagaaaaacaggacatagaaaacctgaagctaaaagcagccacatggagggaagaaagggattgctgggttccttaaagtcactggtgggacatgatcagatcacacagctgaaatacacaggggttttacctcagtaagtgtctgtatacaaggtggtgggtagctaaatgggcttagttttctgaggagtatccattcagcactacgcagtaagcaggagaaagtagtcatatttgtagaaatgtacaggaggc

SEQ ID NO: 631581 - DNA, 148 bp, Homo sapiens
taaagggaaagcaacaggccaggaccgggggttcatgcttgaaaccccagcattttggaaaaccggggggggcagattacttgaaataaggcgttcaaaaccagccgggccaaaagggggaaaccctgtttttactaaaaatagggac

SEQ ID NO: 631582 - DNA, 835 bp, Homo sapiens
ggtgtgtgctgtccgcccccgccgagacatgggcgcggccgcgaggagcccccccccgcggggagcccaccctcctctctcttctttgtcagtgattgtctccctccccccgccggagaggggaagaagactatcgtccttcccctgcagtcggtagccagtgcccctcctccccatctttcaccccacctagctagtcagtagttcgtcttcctcgtcttcttatatagtacggccgcgcgcgctctcatcagatgtgggtcgcgaccccccccccgctcgggtggcgccctctctctctctctttctgtaggaggcgcgctcccgcgcgagtgtgagtcatccctcgttcgcgagcgctcgctcgctctcgcttactcctagtcttctgtctctcttgcttagacgaccgcgcgcctcttgatagatagaacgtactgatgagcgccctcgttgaggtgtaggtactcgccgccctaccgaggcagctcgccgctctcttggtggagattggctcactgggcaaagcgcgatcgcccgaacgaactgctgtttctctctagcgagaggatgtgcaacggctggttctcacgcacgacggcccagcccccgctgctgcttcgtgcgttctatcactttcttgcgccctcgcctcgtctttattatgagacagcgtgtgtgtgtgtgtgtgtgtggggtctggccgccccccctgatgggcccacacagaagacacactgttggggtttttttttttttttcccccaaaaaaaatttgaaaaaaaaatttttttttttaaattttttgggggggttttctttttttttcccccca

SEQ ID NO: 631583 - DNA, 1069 bp, Homo sapiens
  misc_feature (790)..(790): n is a, c, g, or t
agcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagacagggtctggctctgttgcctaggctgcagtgcagtgttacgatctcggcttactgcaacctccacctcccgggctgaagccatcctctcacctcagcctcccaagtagctgggacaacagacgtgtgccancacgcttggctacttttgtatttttgtagagatagggtttcaccatgttgcccaggctggtcttgaactccggagctcaagcagtcctcccgcctcagtctccctggaattatgggcgtgaaccactgcagtcagctgaaatgttttaaaattcaaaagatacaaaaggatatatatgttatcaccatttaaaaagttcttaaggtcctgtaatatttttgtcattgtttcattatatattcatttattatttagtatgtaattatgtaccattatcac

SEQ ID NO: 631584 - DNA, 306 bp, Homo sapiens
gtcgcggaaatctagtttcatgttctccacagcccaagccctaaagaaggctacattactgacagtcatattggcaccttcagactggttgactccttccaaaccctcaaagggcagctctagcatcctgaccaccccttcttactctactcctgctgctcagcactgctgaaggaaatccatcctacagaaaaggagctcttacacaacaatgacctccagtctcaggggaggcccttagttctactcagcaatcccttcctcactgaccctcttttccctcgtcttattccaaccttacaggcc

SEQ ID NO: 631585 - DNA, 1614 bp, Homo sapiens
  misc_feature (57)..(57): n is a, c, g, or t
  misc_feature (178)..(178): n is a, c, g, or t
  misc_feature (213)..(213): n is a, c, g, or t
  misc_feature (491)..(491): n is a, c, g, or t
  misc_feature (494)..(494): n is a, c, g, or t
tgcacgagcatacatctatttttctgtaaatatggttatcgagagagatactgcttnaataatgtcctctggaggtgctcattctttcagcttgactacttcatacaaattaaatgaggtcattcacactgaattattgtgtttaatctgttttatagacatcttcaccactcatcanccaaaattcaagtatcagataacataaagatttgntttcagctcttttaaggaaatcttaaataaactattctttctcatttcacttgaaatatgcaaggtataactggcatttacatatattaaacaaataagatttagatgtaaagaaatcaaaggaatctgaatatgctttcttatatttattgaattaaacaatatagatacattgagaaaagcatagagggctctcaaggagttcgcctccttaaaataatagtagactaaatagtttttcatcattctttgtattttatttctctaggagacatganggntgggtacaagggaaggaatagtggcaagagaagtggtaatggaggtaaaaggagaataaagaaaagatagacagaaaaaaatggaactttatacatggaaaatgtttttctgatccattatactctttctttaaaaaggtaatattttcttcttaccaactcaaatttctagtatagtttctgttcatttacattctagtagttcttggtttttcgtgaaaaggggaaaggaaaaacccacattttttagcgcttcccactttaccatatctgaacttccatatagtcttactctgcttctaccacttaccatagttaaggattattttaccttctactaacttctaaaacttgttttctgaagaaaaactaaatactgacattctgttattacaatgattaggagcatgctttgcactgattttaaaacaaaaatcaatccttttgtggtcagtagaaattatgaaataccaatatattcttttggctactgctaatgagattcttgatgtataacagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 631586 - DNA, 478 bp, Homo sapiens
aagcagttaatacaactcaccctcctaggttcaagcgatcctcccatctcattctcttgagtagctgggactacaggcgcatgtctccatgcacagttaaattttaatttattattattgggtagagatagaggtcttgtcattgttgcccagtgttggtctccaacacgttgggctcaagccgattttccgtgcctctgccttcccaatagtgtagattacgaggcattgagcccactgtacaagtgtacaagctcatagctcatgccaatagccttgatcttaggctcaagcccatcctacttgcctcaagcctcccaatgtagctgggactacaggtatgggccaacatgactggcttgtctctagtctaacttttccaattttatatggctagaatcatactatatggtaccttgtgttactgtgtcttcagtgtaatgttagagtctgtattaactgcttggggtccgagctc

SEQ ID NO: 631587 - DNA, 1440 bp, Homo sapiens
  misc_feature (57)..(57): n is a, c, g, or t
  misc_feature (178)..(178): n is a, c, g, or t
  misc_feature (213)..(213): n is a, c, g, or t
  misc_feature (491)..(491): n is a, c, g, or t
  misc_feature (494)..(494): n is a, c, g, or t
  misc_feature (1326)..(1326): n is a, c, g, or t
  misc_feature (1369)..(1369): n is a, c, g, or t
  misc_feature (1416)..(1416): n is a, c, g, or t
tgcacgagcatacatctatttttctgtaaatatggttatcgagagagatactgcttnaataatgtcctctggaggtgctcattctttcagcttgactacttcatacaaattaaatgaggtcattcacactgaattattgtgtttaatctgttttatagacatcttcaccactcatcanccaaaattcaagtatcagataacataaagatttgntttcagctcttttaaggaaatcttaaataaactattctttctcatttcacttgaaatatgcaaggtataactggcatttacatatattaaacaaataagatttagatgtaaagaaatcaaaggaatctgaatatgctttcttatatttattgaattaaacaatatagatacattgagaaaagcatagagggctctcaaggagttcgcctccttaaaataatagtagactaaatagtttttcatcattctttgtattttatttctctaggagacatganggntgggtacaagggaaggaatagtggcaagagaagtggtaatggaggtaaaaggagaataaagaaaagatagacagaaaaaaatggaactttatacatggaaaatgtttttctgatccattatactctttctttaaaaaggtaatattttcttcttaccaactcaaatttctagtatagtttctgttcatttacattctagtagttcttggtttttcgtgaaaaggggaaaggaaaaacccacattttttagcgcttcccactttaccatatctgaacttccatatagtcttactctgcttctaccacttaccatagttaaggattattttaccttctactaacttctaaaacttgttttctgaagaaaaactaaatactgacattctgttattacaatgattaggagcatgctttgcactgattttaaaacaaaaatcaatccttttgtggtcagtagaaattatgaaataccaatatattcttttggctactgctaatgagattcttgatgtataacagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaaggtgagatgcgttgtcttaaaatgattttactatcaggttagcgctttttgattttactttgtttctanaacactttagagatactggtgtagaaacagacttgtcctgaantcatatggttgcttcaaagtgtttttccaaagcttcagtcttttagnaccatctatactttcattactacg

SEQ ID NO: 631588 - DNA, 1232 bp, Homo sapiens
  misc_feature (57)..(57): n is a, c, g, or t
  misc_feature (178)..(178): n is a, c, g, or t
  misc_feature (213)..(213): n is a, c, g, or t
  misc_feature (491)..(491): n is a, c, g, or t
  misc_feature (494)..(494): n is a, c, g, or t
tgcacgagcatacatctatttttctgtaaatatggttatcgagagagatactgcttnaataatgtcctctggaggtgctcattctttcagcttgactacttcatacaaattaaatgaggtcattcacactgaattattgtgtttaatctgttttatagacatcttcaccactcatcanccaaaattcaagtatcagataacataaagatttgntttcagctcttttaaggaaatcttaaataaactattctttctcatttcacttgaaatatgcaaggtataactggcatttacatatattaaacaaataagatttagatgtaaagaaatcaaaggaatctgaatatgctttcttatatttattgaattaaacaatatagatacattgagaaaagcatagagggctctcaaggagttcgcctccttaaaataatagtagactaaatagtttttcatcattctttgtattttatttctctaggagacatganggntgggtacaagggaaggaatagtggcaagagaagtggtaatggaggtaaaaggagaataaagaaaagatagacagaaaaaaatggaactttatacatggaaaatgtttttctgatccattatactctttctttaaaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttatccaaatgatcttcagttcaatattctaatgagatttacagttgatcagacccagacaccaagcttaaaggtgaaggttgctatccttaaatacatagaaactctggccaaacaga

SEQ ID NO: 631589 - DNA, 85 bp, Homo sapiens
gggaggcgcgcgcgaccggcggctctttggcgctgattatggggtctcggcgagggagtcatcaagctttggtgtatgtgttggc

SEQ ID NO: 631590 - DNA, 312 bp, Homo sapiens
caggtcttttcccctcaaaaaaaagatgcagtttatctgccatcttaaagttgtatttctaacacatatatttgatctattactccgtttaaatactctttaggtcaggagcgttggatcatgcctgtaatcccaggactttgggaggtggaacgtgggtgaatcacctgaagtcaggagttcgaggccagcctgggcccacagtgacgaaaccccgtctctactaaaaatattacataattagccgggtgtggtggtgcatgcctgtaatcccgtcttctcaggacactgatggaggagaatcgctttaac

SEQ ID NO: 631591 - DNA, 252 bp, Homo sapiens
  misc_feature (46)..(47): n is a, c, g, or t
gatctagacgatcgctatactgtggtgtaccgtcatccatttgtcnnaaagatgtagaagacggaatggaacgatgggtgggaggttgggttcaatgacctctagagtcccttttacctctaggattattcaattctggactaccagggagctgggcacctcagccagccagggcacatgcagaggtggggaatgagcagtatcctaggaggctctctctcctgcccttgggggtcaatgaactctaccctc

SEQ ID NO: 631592 - DNA, 153 bp, Homo sapiens
ggggttttgggggtttgctttaaagtttttgaaattgtaaaagttgggctttgtattttaatgtaaactgagcaaaaaggcattttagggcctgggccccaaaaaaaagcttgtaacgcccatggatttgaataaacatgtccttgcttttga

SEQ ID NO: 631593 - DNA, 294 bp, Homo sapiens
gtcctattgatccatctgacggaaaatgcgccttctctcgggatcctggacgtgcgtcgagacctgatccctgttgacacttaattactggttcgccgtaacctaacaggtccatgttgtcgtgcttttcgacctctgatgtgaacgagttaaggctgctccaatcaccacttgctgacggtcgcggttggacaacgatgctgcacagtccgttcatggcggttcatgatggggtagttcttccccttgtagtgattgacctcctggtcaaagtgtaagcccgcgatgatggga

SEQ ID NO: 631594 - DNA, 360 bp, Homo sapiens
aatcacagtactatgggaggcaaggtgggtggatcacctgaggtcaggagttcactaccagcctgacggatatggtgaaacctcatccccattaaagacacaaaaattagccgggcatggtggtgggcgcctgtagtcccagctactcaagaggctaagacaggagaatcgcttgaacctgggaggcagaggcaatagagtttactggtatatatgtataccaatttgattggggtttaatttccatttaagccttaaatttggctccaagtaattttactctaagaatcttctctctccataacatgcttagcacagtgtctagcatttgtaggtactgtaagtcatagaaaatatctg

SEQ ID NO: 631595 - DNA, 376 bp, Homo sapiens
  misc_feature (318)..(318): n is a, c, g, or t
agaggatccccctcctacgagcgcctatcacaagagtctgtacacccttctcaacaacttccttcacatctgcaggctgcacaccaggagaatgctcagttcctgtttctctccaatcccaagtccgactgccccctggccatactttgcagtccttataggttgtattagagccttttactttcatttgcccccatgataaggaagcaatttcaggggaagtcataaggaacttcactgaagtcagatgcgagccaactggtcttggacttcccagcctccagaaccaccgcactgtctcctcaaagttgcgttccnaaacggcgcagtgctctgcccgcacttacgctcccagcgctgcttcgggatctgcgta

SEQ ID NO: 631596 - DNA, 332 bp, Homo sapiens
  misc_feature (274)..(274): n is a, c, g, or t
agaggatccccctcctacgagcgcctatcacaagagtctgtacacccttctcaacaacttccttcacatctgcaggctgcacaccaggagaatgctcagttcctgtttctctccaatcccaagtccgactgccccctggccatactttgcagtccttataggttgtattagagccttttactttcatttgcccccatgataaggaagcaatttcaggggaagtcataaggaacttcactgaagcaccgcactgtctcctcaaagttgcgttccnaaacggcgcagtgctctgcccgcacttacgctcccagcgctgcttcgggatctgcgta

SEQ ID NO: 631597 - DNA, 170 bp, Homo sapiens
ctcaagatcacaaaccattccccacttactctctacaactctcataactttcaaaatctatttttctcctcacacttgaagcatatactttctgcccgactccttcaaccgtactcactgttcattgaaattcctacaattaccattattcctggcacagacttcaaccc

SEQ ID NO: 631598 - DNA, 377 bp, Homo sapiens
  misc_feature (9)..(9): n is a, c, g, or t
  misc_feature (104)..(104): n is a, c, g, or t
  misc_feature (232)..(232): n is a, c, g, or t
tgctgggantataggcgtgagccactgcgcccggccttgatctgttggtttctaagagacatagtcctattcttccctgagctgggtccctggtgtcactaagntcaccccttctcattcctggaacttccctgaggtcatagggggctctttcatcctatctctggctcctgtgggtggcttctatgcccaagcaagaagtgactcaggcaagggtatagatacaaaatgnctcactctccatccccagggatgtgattctggctcagtgcatggatctgctcattgagtggcctaggggtggagcagagtgtccccaaactgtagtctacctctcttccccaagaggaaccaggtgcctgactttggggactcca

SEQ ID NO: 631599 - DNA, 81 bp, Homo sapiens
cgctcaggaccgggcctcaaaatggccacacgcgtacccccgtagcggaaaaaccgggttctttggggagccggatgcctt

SEQ ID NO: 631600 - DNA, 758 bp, Homo sapiens
  misc_feature (9)..(9): n is a, c, g, or t
  misc_feature (69)..(69): n is a, c, g, or t
  misc_feature (71)..(71): n is a, c, g, or t
  misc_feature (77)..(77): n is a, c, g, or t
  misc_feature (79)..(79): n is a, c, g, or t
  misc_feature (83)..(86): n is a, c, g, or t
  misc_feature (95)..(96): n is a, c, g, or t
  misc_feature (98)..(98): n is a, c, g, or t
  misc_feature (108)..(108): n is a, c, g, or t
  misc_feature (116)..(116): n is a, c, g, or t
  misc_feature (128)..(128): n is a, c, g, or t
  misc_feature (149)..(149): n is a, c, g, or t
  misc_feature (162)..(162): n is a, c, g, or t
  misc_feature (181)..(181): n is a, c, g, or t
  misc_feature (188)..(188): n is a, c, g, or t
  misc_feature (197)..(197): n is a, c, g, or t
  misc_feature (199)..(199): n is a, c, g, or t
  misc_feature (203)..(204): n is a, c, g, or t
  misc_feature (206)..(207): n is a, c, g, or t
  misc_feature (210)..(211): n is a, c, g, or t
  misc_feature (213)..(213): n is a, c, g, or t
  misc_feature (217)..(217): n is a, c, g, or t
  misc_feature (223)..(225): n is a, c, g, or t
  misc_feature (227)..(227): n is a, c, g, or t
  misc_feature (231)..(231): n is a, c, g, or t
  misc_feature (233)..(235): n is a, c, g, or t
  misc_feature (238)..(241): n is a, c, g, or t
  misc_feature (245)..(251): n is a, c, g, or t
  misc_feature (260)..(260): n is a, c, g, or t
  misc_feature (265)..(265): n is a, c, g, or t
  misc_feature (272)..(272): n is a, c, g, or t
  misc_feature (281)..(281): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (307)..(307): n is a, c, g, or t
  misc_feature (314)..(314): n is a, c, g, or t
  misc_feature (322)..(324): n is a, c, g, or t
  misc_feature (330)..(330): n is a, c, g, or t
  misc_feature (333)..(333): n is a, c, g, or t
  misc_feature (343)..(343): n is a, c, g, or t
  misc_feature (353)..(353): n is a, c, g, or t
  misc_feature (359)..(359): n is a, c, g, or t
  misc_feature (373)..(373): n is a, c, g, or t
  misc_feature (378)..(378): n is a, c, g, or t
  misc_feature (380)..(380): n is a, c, g, or t
  misc_feature (422)..(422): n is a, c, g, or t
  misc_feature (427)..(427): n is a, c, g, or t
  misc_feature (495)..(495): n is a, c, g, or t
  misc_feature (512)..(512): n is a, c, g, or t
  misc_feature (515)..(515): n is a, c, g, or t
actaggggnaggggaaagagacatggaactcgagggcagcggtgaagagaccatgcgtgtgctgggagnanccagangnagcnnnngcacaaacnncncaggtacgantctctgtntcttccccggcnttatgtataaatttagagtanttgacgccttctntcccctgctctcccttccnctccgtnctgctcacngnggtnncnnttnntntttncacatnnngngganannntgnnnngttnnnnnnnttttttttnttttnttatttnttccacatncattagnttntngntntttttttttnttttttntttttttnnntgtttnttnggtgcttggnggtccttttncatttnttccaggataaggngcatngntgggtcactcatgatctgctgcacctcagggtcggccatggntcgtngcttcacatcttcggggctgtcgtgccggttgtactgcgccatcatacagcgctggtagccgtctgcngcctccttacagctggngtncaggtctagggccttctggtacacatccatggctttggtgtagtccttcatcgcttccagcgcaggcctttccgtgtataacccttgatgaaggtcggctccagctggatacattcctcacagtccttgagtgccagctggaactccaggagtttggtgtagcaggcagctcgattgctgtatatattggcatctttcgggttccttttgatggcttctgtataatgcttcatggcctgggga

SEQ ID NO: 631601 - DNA, 905 bp, Homo sapiens
agcggctcggggtcccgcacagctgtgaggagccccgaagcacggatgtcgaccggactgaggcagagcgcctctgctctggacctgtccctggactccctcattaccgtcgaacagcggagcgaaaccgagagcgtggagcgggctgggccagattctgacgtaattcaccatggaggccctggtttcttttattggggaacggtattagacacgaacttctgggtgctagtagagatggggtttcgccatgttgcccacgctggtctcgacctcctgacctaaggtgatctgacggcctcagcatccacagtgctgggactacaggtgtgagccatgcacccaaacaagaactactatatttactgttgagtggactgtcatggccagatcctcggaccagtgaagatgacagtttcatggcatgtgggaccacggaacgacaacatgtggctggacagggaccccatggccatccaagatgaggagaccccaccaagtattggaagcgctgaagagagactcgacataataggtcccatgtcgcgagcttgacagaagaggttaggaagatatatccatgttacattactctcaccgatataggaacacaaaaaatgaggacattgatattggaaacaggggtatagcattatcacaggtgttgaccattaggttaatcaggattcaatgaagggtgagcaaggaaggaaaaattaagatgggagagccgacactaatcttatatggaaccaaataatacgagaataggcaaaaggatgtatatgatgaaacacgtagatgtgatgagggcggacagacaagtgaaaaggagtagagactagtaaatgtacataaaaaaaaaggaatgagatggatcggacgagtaacaagagagaagaaaa

SEQ ID NO: 631602 - DNA, 89 bp, Homo sapiens
  misc_feature (10)..(11): n is a, c, g, or t
tttcagattnngttagctttcagaggcatcagggtcgttggggcctgccagtatgtgccagtgagatcgctaccacccctgctctaatc

SEQ ID NO: 631603 - DNA, 103 bp, Homo sapiens
ccccccacactcacacagattcagcgctgtcaccgggcggtgcggtcgttattgccgaggatgatgaggccggtgccggcacctattggtgatattgtggttg

SEQ ID NO: 631604 - DNA, 248 bp, Homo sapiens
tggggagaggcgcgtgactggcggacattcgggcgttacttgttgagttcgcggacgcgctcgatcatttcggcgcctgaaggagatgtacgcctgctgcgccacgcgagtgcgcggtcgtacacctacgccgtggcatgccatacgctggtcgcttcgtgccagaccgctacgttgcgctgccaccactggtcttgaaggaccttgtctgcctaagtgcgattcgcagctgctgcctgacacctggt

SEQ ID NO: 631605 - DNA, 150 bp, Homo sapiens
ggtcatccgggaggacaaccagaccaaccagcctgcaggaggctctaaaccgtcttcaagagcatctggaacaacagaatggctgcagaccatctctgtgagtctgttcctcaacaatgcaagaatctgcatcgctgagaaaagtcttgc

SEQ ID NO: 631606 - DNA, 134 bp, Homo sapiens
ccaggtttccgaatgagccggagctcagcaaacgagccaagtcagtgtctgtggaacttgtatggcagttgttagcctggtgggcccgcctttccttttgcagctcctttcagctcccgctggcctacagcaca

SEQ ID NO: 631607 - DNA, 181 bp, Homo sapiens
tgatctagaggtcccctagctgtttcttattttacaggctcataggtggaagggacttgccttgttcagatgagacttggacttggactttgagttaatgctggaataagtgaggacattgagggactgttgggaaggtatgattggattttgcaatgtgagaaagacataaggtttggga

SEQ ID NO: 631608 - DNA, 496 bp, Homo sapiens
ttaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttataccggtgtcagatcagaatttttaagagttatctttcagtgaaattttataacaagtttaagtgaatagagaaaaaattctgaactgatcataatgagttaaaagttagcttttcacttatgaatcatgggagtggtaaactgttaacttttgccgtattaggagacttgaaagttattactaatttacaaactttgtaaaagaatgggtgctggtcattttaaaatgggaaagaaaccttttctttttttgaaccatagggacccatattttaaaaaaggcgcttttcttttgtagaaaaaaaaaagttcaaattttaatttagctttggg

SEQ ID NO: 631609 - DNA, 226 bp, Homo sapiens
cgccatttacaactatctcaattttgtaaagtgggccaaggacgagaaattaacgagactctaatgacaggtgaccatactgaaagaggcacagcatggctagtaaccaggaagagggaagattaaaccacagtgtgtaacactgtgttacacacccacataaagggtgtaagttgacagttgcaagttttggtgggggtgccaggaaacaggagctctctggcaa

SEQ ID NO: 631610 - DNA, 558 bp, Homo sapiens
  misc_feature (299)..(299): n is a, c, g, or t
  misc_feature (398)..(398): n is a, c, g, or t
  misc_feature (528)..(528): n is a, c, g, or t
gagggggcctgtggcccagcgtccttggccctccggagatggaaatgggggcagggaccttccttacctttcccaagatttcccggccccccccaattgtttccccccaaaactttttttgggttgggggggttttttttgccccctttttaaaaatttaaaaaccccccctttttttttccaggagttttttttccgggggggttttttttcccccccggggggcgcctcttttttttaaaaaggggggggggggacccccccccccttttttttttataaaaaaaaaaacccgcggnggggagaacgaaagaattttatatttttttttttttttttgaaaaaaaaaaaaaaaataaatttttttttttgtttggggggggggggaggttgttttnttagaagaataatatatcccccccccgggggccgccgggggggggggggggagagggtgttctttttttttttttttttttgggttgcgggccccccccccccctccctactttcttttttttttttttnggatctgatccgttactgagagtacgtctg

SEQ ID NO: 631611 - DNA, 352 bp, Homo sapiens
atagtatagtggcacacaccctaatcccagctactcagagaggctgacgtgagaggattgcctaagcccatcgaggttgaagttctggcttggaagacccttgggcgacaccaccgcactccagtctagaaaacagagcaagaccccatctcaaaaaaaaaaagaaaggaaaaaatacaagatatataaaatttgtcagatgcagctaagatagtgtccatagggcaagttttagatttaaatgcttaaattcaaaaagaaaggtctaaaatcagtgacctaaaggtccacctcaaaaagctggaaaccaaaatgggtgaaagacctaaatgtaaaagttaaaaactctgaa

SEQ ID NO: 631612 - DNA, 167 bp, Homo sapiens
ctgatttgctagattagatatctcagctcctcatagctctgtccatttttgtcttaggtgagcggtgcgtcttcaacgagaatgtacttcagcactctgtgtggcctcatctgccctcagtttggcttcagagaccatcttggagagctgttccacttcagccaggg

SEQ ID NO: 631613 - DNA, 210 bp, Homo sapiens
aattcgcggccgcgtcgacctcgcccttggtggtggcgccttgcatgatgttggtcgccgccggcaataccgtgcccatcggatccgaggggttgctgatccgcccctggcgcgccgtgaagcccaggtcgcccaggccggccgccttgatggcatcgttcagcggagtctcgaccgccttgaccttgtcgttgttccagtcgggctctt

SEQ ID NO: 631614 - DNA, 103 bp, Homo sapiens
gtgacttagaggatcttgggatgaggaacgtcacttcagagaggtttctgggttccggcgacgccctccttcaagcgaggccgcagattcgaaggcgtgcact

SEQ ID NO: 631615 - DNA, 656 bp, Homo sapiens
  misc_feature (129)..(129): n is a, c, g, or t
aggaatacgaaagagtatagaaataagaatgtacataaaactaaaaaatctgcaatattaaataaataatgttatatagagtgtcaaacattaagtcatatgattatatatcgagtagcagcgtgagtntattatagagagatataaagaacactgtcagcttgaaatatagtagagagagttatattaaaaaccagacacaacacgttaaaaagtaaactaccttgaagaggactcacacatgtgtcacaagataccttcaaagcaaaccatagagaattgtgcacgaatcacgaacgaatataattaggcttattagccaacatgtaatcaaaacgtcctggagactcagaaatactccttacacaagaaccagagcctgaatgttatatactatcgttggtagtacaattaaaacaataatgtctagaatcatgtcggataatactaacagatatagacccacacatacaaaatgctaattcactatctagatacataacaaatctaacaacatgactactaaacttaaaatcaatatcttaccataacagtatcactctctatctaaatctctatctctctctctctctctctctctctctctctctctctctctctctctctctctctctctctctctctctctctctctc

SEQ ID NO: 631616 - DNA, 879 bp, Homo sapiens
  misc_feature (18)..(18): n is a, c, g, or t
  misc_feature (25)..(25): n is a, c, g, or t
  misc_feature (41)..(41): n is a, c, g, or t
  misc_feature (84)..(84): n is a, c, g, or t
  misc_feature (265)..(265): n is a, c, g, or t
  misc_feature (290)..(290): n is a, c, g, or t
  misc_feature (304)..(304): n is a, c, g, or t
  misc_feature (339)..(339): n is a, c, g, or t
  misc_feature (352)..(352): n is a, c, g, or t
  misc_feature (358)..(358): n is a, c, g, or t
  misc_feature (428)..(428): n is a, c, g, or t
tatcactggacattcagnaggcaantcaatcttttttattnccttataaaattaactcttcaaaagccgttaaacagagagttntcttaatttttattgcagtaggaggaaatatatttaaaatatttgtagatttatagcaaataaaaactcgttatttaaaggttaaataacaatttgttcttttgttgtttttgccagtttagggcggtggctgcttgtgtcataaatgtcttcctaccacatcaagaatgctgcttttaanatttttgtttataaattgagaaggnattttctctctatnagtttctgtcattggacaggtcaccattaaaaagnatattagaatccngcatgnagataatggctaataaaaatgagggacatactttataaaaccattaatcagatttgaatgaggaatgctncccacaccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgcccttt

SEQ ID NO: 631617 - DNA, 123 bp, Homo sapiens
actgcaggctctgtctcccaggttcaatcgattctcttactcaggctcctgagccgctgggattataggcgccgtaccaccatgcctgacttctatatgtggttatacctctcagtttttcta

SEQ ID NO: 631618 - DNA, 959 bp, Homo sapiens
  misc_feature (18)..(18): n is a, c, g, or t
  misc_feature (25)..(25): n is a, c, g, or t
  misc_feature (41)..(41): n is a, c, g, or t
  misc_feature (84)..(84): n is a, c, g, or t
  misc_feature (265)..(265): n is a, c, g, or t
  misc_feature (290)..(290): n is a, c, g, or t
  misc_feature (304)..(304): n is a, c, g, or t
  misc_feature (339)..(339): n is a, c, g, or t
  misc_feature (352)..(352): n is a, c, g, or t
  misc_feature (358)..(358): n is a, c, g, or t
  misc_feature (428)..(428): n is a, c, g, or t
tatcactggacattcagnaggcaantcaatcttttttattnccttataaaattaactcttcaaaagccgttaaacagagagttntcttaatttttattgcagtaggaggaaatatatttaaaatatttgtagatttatagcaaataaaaactcgttatttaaaggttaaataacaatttgttcttttgttgtttttgccagtttagggcggtggctgcttgtgtcataaatgtcttcctaccacatcaagaatgctgcttttaanatttttgtttataaattgagaaggnattttctctctatnagtttctgtcattggacaggtcaccattaaaaagnatattagaatccngcatgnagataatggctaataaaaatgagggacatactttataaaaccattaatcagatttgaatgaggaatgctncccacaccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaatggtcgcattggtgtcatatttacatgagaaagtatcttacgcaatttaccaaagtagaaatgtt

SEQ ID NO: 631619 - DNA, 460 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (278)..(278): n is a, c, g, or t
  misc_feature (381)..(381): n is a, c, g, or t
  misc_feature (406)..(406): n is a, c, g, or t
  misc_feature (416)..(416): n is a, c, g, or t
ccgaaancnanacactttaaaaatgatttatgctcgatgcagaatccgcagtggcatgaacgcatcatttccccacacaccctggtgtataccggtttccgttggcatgtccgtgcctattgccatcagagcaagcagtttaaggactttttactctccagaattgatcgcacacctgttgtggtggcgattgatacagtagaccctgttcaggatcaacactggcatgaagaaattctactgacgctgatccctaatccaaaattgaactcatcacnacaagcgctggtcgaaaaagacttcggcatgcctgatggcagattacagattccggtgaaaaagcctggctcactatactttgcagcgatatcagccgcgatnacgctggctgaggcggatgatgccntgaatatccnttggtactacaacgctcagatatcgaaaagccgtcatcttacct

SEQ ID NO: 631620 - DNA, 821 bp, Homo sapiens
  misc_feature (18)..(18): n is a, c, g, or t
  misc_feature (25)..(25): n is a, c, g, or t
  misc_feature (41)..(41): n is a, c, g, or t
  misc_feature (84)..(84): n is a, c, g, or t
  misc_feature (265)..(265): n is a, c, g, or t
  misc_feature (290)..(290): n is a, c, g, or t
  misc_feature (304)..(304): n is a, c, g, or t
  misc_feature (339)..(339): n is a, c, g, or t
  misc_feature (352)..(352): n is a, c, g, or t
  misc_feature (358)..(358): n is a, c, g, or t
  misc_feature (428)..(428): n is a, c, g, or t
tatcactggacattcagnaggcaantcaatcttttttattnccttataaaattaactcttcaaaagccgttaaacagagagttntcttaatttttattgcagtaggaggaaatatatttaaaatatttgtagatttatagcaaataaaaactcgttatttaaaggttaaataacaatttgttcttttgttgtttttgccagtttagggcggtggctgcttgtgtcataaatgtcttcctaccacatcaagaatgctgcttttaanatttttgtttataaattgagaaggnattttctctctatnagtttctgtcattggacaggtcaccattaaaaagnatattagaatccngcatgnagataatggctaataaaaatgagggacatactttataaaaccattaatcagatttgaatgaggaatgctncccacaccttgaaagaaaaactgtggcttacgttttgaagtattctgagaatgaagtattaagatccaatttctataagcaagatcagacttgttaagtatgccgcaagtaagagctaattcattcattccatgtgaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgcccttt

SEQ ID NO: 631621 - DNA, 98 bp, Homo sapiens
agagaagtcttggagccagagaatctgaggcctccaagtgggagtcctagcccctcccttgatgaaatatacatatactcagttccttgttaaaaaaa

SEQ ID NO: 631622 - DNA, 629 bp, Homo sapiens
  misc_feature (387)..(387): n is a, c, g, or t
tgcccctcatttacataaatattatactaggcatgtaccatctcgacttctaggaatactagtatatcgctcacacctcatatcctccctactattggcctagaagggaataactagctatcggctggttcattatagcgtagctctcataaacccgtcaacacccagctccctcttagtcgcaatatcgtgcctaattgccatactagtcgtatgcgcgccggcgaagacagcggtgggccatagccctagtaggtctcaagtctgccaacacattagtgggccgtcagactcacgtaccataaccgtaaaccatacgtccgagattgcataaaacttaagtgcgtcccgaacaagttatattgactgaccgagtgactagtgacntttccaagaaagaacacataagtctgaatctagaatcaagcagccaacagccgagattattagcatcatccgctctactattatgctagaagcaaagtcaacaagcaagcgtatttagcgtgttccccaaacctgtttcgtccgaacccccttaagataccgcccgtcctaagtacgtaacgtacgctgacgtcctaccccgtcacaaagtcatggtcaagccaaggccactttatccagcg

SEQ ID NO: 631623 - DNA, 359 bp, Homo sapiens
  misc_feature (359)..(359): n is a, c, g, or t
gtggtttgcccttttggcggtgttggcgggccacctatctaccatgttcacattagtgaacaaaagtctttgctctcagagattacatactagacagagtaaacaaataagtgaattatctgtaaattgagcattcctaatttgaaatactccaaaattcaaaacacttctggtcctaatcattttggaggatactcctccatcagtattttagatctagacagttctgttgctgcttgtcctgttttaggaatggaggaaatagcaattctcagagctcctaactagattgtaccattttgacatctgaaggaagatgagatgaatcctccttttgattatttgctagtcatcggtgn

SEQ ID NO: 631624 - DNA, 420 bp, Homo sapiens
gaactcggcgagctccacttcaagaccacatccccatccacagccacgtctactcggccgggatagtggtagtagctcctaactgggctctcggcttccagttatctgcacattcagatgaaccttttatacacataaatcatatcacttttattctcttggagacgaagtctttctctggctcaggctggcgtgccgcggcatgatcccggctcattgcaatctccacctccggggttgaagcgattctcctacctcagtctcctgcgtcagctgggcactacaaggcacacgtcaccacgcctagctaattttggtattttctagtcacgagggggtttcgccatgttggcgaggctggtcttgaactcctgccctaaagcttcccaaagtgcctgcctcagcttcccaacgtgctgg

SEQ ID NO: 631625 - DNA, 159 bp, Homo sapiens
tatcagctcggtcccctaacatcttctccttacacctagcaggtgtctcctcatatctagggccatcaatttcatcacaatcaattatcaatataaaaccccctgctcataacctagttacccaacaccctcttcgtctgatccgtcctaatcacagca

SEQ ID NO: 631626 - DNA, 993 bp, Homo sapiens
  misc_feature (3)..(3): n is a, c, g, or t
  misc_feature (264)..(264): n is a, c, g, or t
  misc_feature (285)..(285): n is a, c, g, or t
  misc_feature (292)..(292): n is a, c, g, or t
  misc_feature (294)..(294): n is a, c, g, or t
  misc_feature (304)..(304): n is a, c, g, or t
  misc_feature (317)..(317): n is a, c, g, or t
  misc_feature (324)..(324): n is a, c, g, or t
  misc_feature (326)..(326): n is a, c, g, or t
  misc_feature (332)..(332): n is a, c, g, or t
  misc_feature (337)..(337): n is a, c, g, or t
  misc_feature (344)..(344): n is a, c, g, or t
  misc_feature (363)..(363): n is a, c, g, or t
  misc_feature (366)..(366): n is a, c, g, or t
  misc_feature (377)..(377): n is a, c, g, or t
  misc_feature (381)..(381): n is a, c, g, or t
  misc_feature (387)..(387): n is a, c, g, or t
  misc_feature (394)..(394): n is a, c, g, or t
  misc_feature (402)..(402): n is a, c, g, or t
  misc_feature (422)..(423): n is a, c, g, or t
  misc_feature (446)..(446): n is a, c, g, or t
  misc_feature (460)..(460): n is a, c, g, or t
  misc_feature (464)..(465): n is a, c, g, or t
  misc_feature (990)..(990): n is a, c, g, or t
gtncggaattcccgggatatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccangcctcgagctacttcattganagctgcnanagtcgacganagtgagagagtanaggtgcnanaaaaanctctncaccctnagtgacccggtgcagctanaantccatatcggntggntgttgntccaagnccctcggngggtgttcaaggaggaagannctattcacctgaggtgtaaaaantggaaaaaaaatgntctnnataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctggagtaacaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaacccatcatcctcaggcctctctacaagcagcaggaaacatagaactcagagccagatcccttatccaactctcgacttttccttggtctcagtggaagggnaaa

SEQ ID NO: 631627 - DNA, 883 bp, Homo sapiens
actcgtgcctttggggtcccgcgctggtgggcctttttcggcgtgccgcggggcgcttgggcgcggacggtgtcccgcggccggcccctttttctcgtccggcaggttggaggaccattcttgtccgacggttgaccttcccccctggctggcacaaggggccatttgggtgggaaagggatccttgcctcccggaagaagaatggtgggttcattgacccgcccccgcgaggtgtcccgaacgttccgtgtcttctcctaaggaattatggggtcaccaaatcctctggtattgaagaggtggatattgtttaccaagcccaggagcacgtgatccccgtggagccaccctgaagttccaggcatctttggcagcggacactttcgacccgtacacggccactgctgagacccaacgcaggctgaccgaaatgctccccgcactttgtgaacccgcttggtgcggatagtctgagctagttttacgggggactggccgagctctgccccaaccatctgtgggtggagaaagccccccttgctactggagaggatgatgatgatgaagcttcccgatcttgtggagaattttgatgaggcttcccaggatgagcgccaactgaattgagtccacttctggagataaacctgcagaagtttctgggggctgctattttatattatgactgctttttgagcaatttttgtttatggatctgataaaaatctagatttttaataatttttaagccccagcccccctggaccctgcagcttttttccgtttttgcttatacaccattcattctttgcagctaattaaaccgaagaagcctgggaatcaagtttggaaccaagattaattaagttctttgcctagtta

SEQ ID NO: 631628 - DNA, 117 bp, Homo sapiens
caagctgcggactgggtgtggactgacctccaagctctctgtgactcagttgtggaggacccgccccagtgcacggtcggcgtcaaggtggagaccactgaggacctggtggtatag

SEQ ID NO: 631629 - DNA, 533 bp, Homo sapiens
agctgattctagaggatcaacggcagcatatgacccagaaacctattttccagaacattccagaaggagcaagcagcaggtacagagaggcaagaggcgggggacatcgtggcagaagcagcaggatccctgggtggctggagcagaggtatggagaggaagtgttgcctttgtagaatgttcagaacattcttccaggaaggcagctgagcctgggcagaagtctctgaatttctctttgaccacagcattactccgtcccctcttccacaactttggggcgtggaaactctccttgggaagctcagctaggagtctctttacttgccagccacttccctgagtgtgagtttctgccctaagatgtggacggtgctaaaataaatacatgtgccctcagatctctctcagcacaactcaaggatctactaacagcgtctgcattcaaatagcaacatttccagaaggcgaacgagcctctgcgtgccttgcagagagctgagcgtttgccggccaagccctgctagccttcc

SEQ ID NO: 631630 - DNA, 195 bp, Homo sapiens
cccagcacttcttcgatcacgaccaccgagacccctcacacagtactcccagcttaacttctttgatcaccaccaccaagtccacctcacacagtccttcaagcttcacttctggagatcgccaccatgaggaccacctcacacagtactcccagcttcacttcatcgatcaccagccccgagaccatctcacac

SEQ ID NO: 631631 - DNA, 359 bp, Homo sapiens
tacagagtgaatgtacttttttgttcacggtatagtgcaaatagtttggcgtgcaattattaacaacgtctacttccgaatcttcaattaactcgtctacactcccataaaaattcggaatggaaaactgttctgccattcgtttcgccttttctaatgtgctgccgctgatagcaaccacttcaacgccacttaatcgccttaatgcttctatatgcgattttgctgaaaaaccagtaccaataatccccactttaatcagcgacatatgcttcctcctattttttcaatgtttttcttccaaatgccactgctataataataatgagtccttttacaatcatttgttggctaacatc

SEQ ID NO: 631632 - DNA, 148 bp, Homo sapiens
actgcaggcccagactgggccgagaaaggacatggcacatcactacacgctgacagtctgagatcgtcaggttctatcgcagaggctgcttccgttatatactgattgaactgtgtctccacgtctgtggacaattgagtggtacctt

SEQ ID NO: 631633 - DNA, 448 bp, Homo sapiens
  misc_feature (189)..(189): n is a, c, g, or t
attagaggaggggtggattggcatttagtgggcaaaggccaggggtgctggtaagtaagcatcagataatgtacaagacacgccccacaacagagaatcatccagcctggaatgttaactgtgtcaaggctgaacgatgttctccttgctttgcttcccctatccagtgatagtggagcatgtgagtgnggcagtcatgcaattctcccccctccccccacttttttttaaagatgaagtcttgatttgtcacccaggctggaacaacctccgcctcccgggttcaagtgattcccctgggaggcagaggttgccatgagccgagatcgggccactgcactccagcctgggagacagggcacgactccatctggtgaacatttgctccccttcccttctaactgtctcataaggtttccagtgggaattgcatcttcttggcggccgc

SEQ ID NO: 631634 - DNA, 204 bp, Homo sapiens
gctcagaccctgtaggaaagacctctacctcatctagtgaaagtgctctacttagactaagggggtattttaggttttgctgcactcacggcatgctcgagtaaagcctaatttgcccagatcctcgggtgggggccaaatccttgagccttaatgttctagggaagggaggggggcctcaataatccttcagggtgtagtaga

SEQ ID NO: 631635 - DNA, 987 bp, Homo sapiens
  misc_feature (315)..(315): n is a, c, g, or t
gataagcattaatagactcgctgcgggtcttcagataaccgtgataagagatctgtaagcagcggtaagctagtatagatcatcaggtgcagcaggcttgtgccctaggctgtctagtattcctgacctggcgacgggtgtattatcaagtgtaacgaactacggattgcttccgtgccagtggggacatagacttctccactatgagctggagctagtgctgtgtagcgccttaagcggccatgtagtgatgaggctttcctctcctgctcagtgtcagtgagacccgttaagaggaggctcaggaattgggtnctaagcgcttggcgatgcaaggctggcagggagtcttagcatcgaaaaaccccttcagatagcagcatacgctcaaccacacggggcagggctaggctaccatgtacctcgtcagcgcccggacagtcgagctcagcgcatacgtctatcaggccaaatcttcatgggccatgagtcatctctctacaaatgcttttgaaatctatcctccatagggacttgtctttgacgtaagggcgaccctctctcgacctcttcgactcattacagtatcacaaattccatgcggaacagaggttcccccaatgcaaacgctgacataatgaagaggggtccttccgaggacattcgtcgaaccaaacggtgcccaaatgaacaacgggggacacactcaaacccctacaggcatactgtctaacctgtggaaaccccagactcctacagtgtaatggcgccacaggggaccctcttgaagggcatggtccatcgtttaagaactcagcaagtacacagcaaccaaagaattggggggacagatggggaccacgaacggatcaaaaggccgagcgcagccaaaaggcgaatacacgggcaacaaggacgcagctaacggatccagaggacgcacggcccggggggaaagacgacaagcgagtagcacagcgcatagat

SEQ ID NO: 631636 - DNA, 514 bp, Homo sapiens
  misc_feature (194)..(194): n is a, c, g, or t
  misc_feature (211)..(211): n is a, c, g, or t
  misc_feature (283)..(283): n is a, c, g, or t
aagaaacagctcttatcctgatccaaaatcttgagccacgggactctaaccgaagagaaagaaaatgaatctactgcctcctccgaagctagtccttcagatactagaagacaattatgccctctttatcaaaggccctacttaaaccagttcagtgataatctatcttctatacccgtttttcataaataganccatgtgttgtttcttncataattatagaagtgttcaagagaaacgaagagagtgagtggcaggaccatggtgtgatgcaggaggaagngctcttggctagaatctgctcccaactctccaactaactgtgaatcattgaattgttacttaatgcctctataaaataaaggctcatatgagatgatctctagggtagttccagctctacttaatatttggtttctactatagccagaaaaagagcttaatttcacaaatagctagacttttcccaatgaaataccctaactcttcatcctaagtcctctttttttgaaaa

SEQ ID NO: 631637 - DNA, 144 bp, Homo sapiens
  misc_feature (83)..(83): n is a, c, g, or t
gccgggtggcaacaaactactttttcagagctaaataggaacatgtaattttaaaaagtgattgacagtttgcccaaattaangttggtggggccttatggaaaaaaatttggggctcaaaaaaaaaggcccacccctttgttt

SEQ ID NO: 631638 - DNA, 137 bp, Homo sapiens
aaaaacgacgctatggtgtcagaataaggatattggaagtcctgagaagataatgactcgggaaaaggcacaaggggagctttgggagatgttacaataggttgccatttctattcttagaggctgtggtacagcat

SEQ ID NO: 631639 - DNA, 470 bp, Homo sapiens
gttaatgatctctgccacaaacatgtctcctaattttttctagatttttcttctaattttagtccacttatcttagaaccaattcagtaaagaaccattaactaactactcccatctccttaaagcactacctacactacagtgcagcaagcccagagtcacagctgggagatggcttgaatgtgaaaggccagtaatgacctctgccatcagggagaggacggtggttcatcgtattctcatgcccagttgtgtcatctaggattcctggtaaacctaacctgataaaccatttttagtgacttgactgctgtataaaaactatagtatgattctcaattatatggccatactccatgtttgccctaacccaccttgttttaggagtttagtatttgatacatatagaaaatacgtcataccttttacaaagaataatagtaaacactaataaaaccattggctaaaaa

SEQ ID NO: 631640 - DNA, 258 bp, Homo sapiens
gacattcgtgtgctgcttagtgcaaatatgaccctggacagggctttgtccaccgtgaagccctgcagaaggtgcaatggaggggttctggggccacagaggagagcccacttcccaccaggacccccaacatgaagtctaggcctcaggggctcccgcccttcttcctccagcagcgggaactgccactgctctcccaggccctgttctggaggctaaccttggttcctggagagtgtgcccctccaccctccctcc

SEQ ID NO: 631641 - DNA, 405 bp, Homo sapiens
  misc_feature (1)..(1): n is a, c, g, or t
  misc_feature (385)..(385): n is a, c, g, or t
nagtcttgctctcttgcccaggctggagtgcagtggcatgatcttggctcactgtaacttccgcctcccaggttcgagcaattctcctgtctcagcctcttgagtagctgggattacaggtgcccaccaccatgcccggctaatttttgtatttttagtagagatggggtttcaccatgttgggccaggctggtcttgaactcctgacctcaagtgatccacccgccttggcctcccaaagtgctgggattacaggtgtgagccaccgcgcccagcctaaagtggcaattttgataaaacagtattctagttggaagtatgaaaatcctcaacgcttaaataagattttccacctttggaatttttaaacctttggttttaaggnaattcctttaaaatccagga

SEQ ID NO: 631642 - DNA, 1589 bp, Homo sapiens
cataggagatcacaaatcaacatctcacttccgaaccggggcacagaagacaagcaaacacttacactgacagaactggcagctctcaactatcacgcaacagctactggacagctacaacttactcagcgacacgactatcgcgcgacacttgctgcgcacttctggcctctcagcctgcacggctacgcaagcacccactgactggccacgcacaggctgcactgctgcgccttggcgcaacgacttgacttgacttgactgaaccgaagtgaattgcactttccaacccgtgaaatcccttgcacacaggttccaaggaatgcaactctcctggaaatagggcggaattccaggcacgctccacggaagcaaacacgcaaacgaaaactccctgcccctgcaccaccgaaatcttcccacacggccttgacctggaaggccaaccccctggaacctggaaaggcttggcacgaggcacttcccccctaacacaaaaccaaacacacaatcacgaacttggccacacacacaacgaccacaacctcttaacttaagaccacaattggccacttggattccgctgggtacctgaacacaaccttcccccaaggcctcggggagatcttccaacgtttaccagccattcgcctccaaaaaataaccacgggcccatctaaacgacattccggttctctagataggaagttacctttttcaaacacaccaacggcctttacaaaacgaccaacgattttcaagcttataggaacttacctaaccccaaaaatctattggacccatgccacaaacgtcgttggccgccaaaggaggaacaacccctattgggccgcttacttcaccctcttaccgggcaaaagggacacaaagcccaacggtgaaaaccccccatttattcttgaggcataaaacttttctctacgctgtaggcaaagtatattttatcacacattacacgagcacgacatacaaaggaggaaccaccccccacgatacacccatcagaacaaacaagcagttaacaaacatgtatgaaaccccaatcaagcaggcgtagagagacattggactttacacatgggcccagattgcttagtaccacaaaaccgacatttaggcccccccacaatatggaggacgcgctttaataaccccacacccgttactatacactcaaaactctgagcgcaggcacccaacacctgtggacaacccgcctatacacctttacacgaagccccccaacactgtgctacccaaacacggggctatcacaacacacacggtgaaagggcctaaacacagggctaacagaccataaggggctcaccctactacacccccgctagccttccaccacgcggccaacaccacacctccaccaacacccattaccaccaaagggcgatcaaacgccacaccacactaagcaccatctcaccaccagtacacacgcacccagaccccttcataactttccaccatcggcgcccacaacttctccaaaaccttcaccgacaaacaacccacccccctatacccttttaaaacaagtctatcacaaaccc

SEQ ID NO: 631643 - DNA, 416 bp, Homo sapiens
  misc_feature (87)..(87): n is a, c, g, or t
  misc_feature (147)..(147): n is a, c, g, or t
  misc_feature (152)..(152): n is a, c, g, or t
  misc_feature (182)..(182): n is a, c, g, or t
  misc_feature (185)..(185): n is a, c, g, or t
  misc_feature (200)..(200): n is a, c, g, or t
  misc_feature (203)..(203): n is a, c, g, or t
  misc_feature (349)..(349): n is a, c, g, or t
gaacatcaaggacatcaccagcagcatccacttcgaggcgtaccgtgtgaagcgcctcaacgagggcagcagcgccatggccaacgngtggaggagaaggagccagaagccccggagatgtagacgccgcccttttctttcccgggntcctncccccaagtcatttccctttctccctccangcnctcccatcaccccantanattgaatatgattttctccatttgtcatcgttccccaccccttcgacatgctgccaggaaacaagggaaggggcctccctccgagtgagtcagtgatgaggccgcggctccccgaggttgtggggaggctgcactggagccacagnaaggggtgagagcacccactgaaattgacatgaccctctgtccccaggcctggctccccgagggctc

SEQ ID NO: 631644 - DNA, 152 bp, Homo sapiens
ccaggctggtcttgaactcctgacctcaaatgatccacctgccacggctcccaaagtgctgggattacaagcaggagccactgtgcctggcctagtttggcggtttaaaagcagattttctgatttcttccaaagaggatgttttaaaatcg

SEQ ID NO: 631645 - DNA, 1745 bp, Homo sapiens
gtcctgtggtggaagaaaaatccacagtcaagaacgaggggaggttccagatggaaaacacagatgacctgataaccgctgtatcatcatggacgtacagaaacaagatggtggactttataccctgagtttaggggaatgaattcggatctgactctgccactgtcggaatatacgatattcgatccatattaagagggcctgtgcccttgatactctacactcattcttaactttgtcgcaaacgtgttcacgcgggactaatctgtctgaagctgtaaatattgtagagaggaacggaataagagtagctgtcagtatcaacctagaatgagtcaacgttcacggaatattcatttcaatactttacataatggttgaccgtaagtaataataatacagtcttgcgagtgacatgtacatacggtatatagccggattaacggttatcaagtgtggtaccatcttatttcatgacatgtacaacgtaagtatgaactaacgtgggcgaggagaaagttcttatggaacgaatacctggtcaacgtgtatcacccttggggctcaagcatacggtgacgtctacgcatgctcagggggtggaaaaaaatcccccttgaagaagttctgggccagccaaagagagggggggggcacaacgggaggggccacaacaacggaggtcgcaactgtggacggggcgcgtgggatacccccgtcacacctacggccacacgcgcgagaccaccatacagcaacacacaggaggacagcatgcgagcaaaacacacagccaactaatatacatcctaccttccttcttgtttctattcttggtatatttattaagtttctacgtacctcccaactccacaacctaccacaccaaccacacaccccatcaccacacccatcacaccccccaacaacccacacatacacaccatcaccgctagtccacactagaccaccatccaaccacacctcactaaccacctccacctacacgcctatacccactacccccagctatcaaccgcaccaccatcccacacaccacacccgagcacacagtatacagcaggtccaaagggactgtcaactatgagaaggcgatgagcacagcacgcaaagctcacagacgctagagactaggacaaaagcagcagccacagaggcatcgagggcgagggtgaagtcgtagagaatcagaacgcataagcagagcgatcgaaacggtaacagccaacagacggacagataacaacaggataagacagaggaaacggaagacgcagcgcatgaggaacgggagaggagacgcgacacacacatgcaggacaagagactgcagacaaccagagagaatcacacactagcagagatagcagcagacgaggagctataatgatgacgcagtctaagggaggagtactggtgaaccgacaacgagacaagacgcagcgtcgaggcagcggagcggaggggtacgcgtgaacgggagacgagggaagaggctatacaagaagtaaagatacaacggaaacacaagcgacagagaagcagcacagaagtggaagacggagagcgcaagcagagatgctaggacgagcccacaggggacaagcggcagtgagcaggcgacacgcgagagagcagatgagtcggagatcaggcagaggaaggagtgcaggggagggacaaggagagtgagggagaaaaacagaaaacggaacgtcaggaac

SEQ ID NO: 631646 - DNA, 299 bp, Homo sapiens
  misc_feature (44)..(44): n is a, c, g, or t
  misc_feature (47)..(47): n is a, c, g, or t
  misc_feature (50)..(50): n is a, c, g, or t
  misc_feature (107)..(107): n is a, c, g, or t
  misc_feature (110)..(110): n is a, c, g, or t
  misc_feature (241)..(241): n is a, c, g, or t
  misc_feature (274)..(274): n is a, c, g, or t
gggactacccgtgcatgacaccctatctggcccttgttttttgntgntgntgttgttctttcttttttcacgtggtttcgcacttgtcacccaggctggagtgcggnggngtgttgtcggctcactgccctgtctctcgggttggagtgattctcgtgtctcagtcttccgggtggctgggattgcgggcgtgtgccaccacgcctggctgatttttgtatttttagtagggacggggctncgctatgttggcaggctggctcgatttcctganctcgggtgatctgccccctcggcct

SEQ ID NO: 631647 - DNA, 154 bp, Homo sapiens
taattccgtgaactatatattcagaacatattattagtaaatgagcataaccccttctttgatttgaaaagtcacctgcaaaccttgtcagacacatgaacttgtgcttgtgtgtcagggccccagctaccctgcaggaatgtggaggggtggc

SEQ ID NO: 631648 - DNA, 823 bp, Homo sapiens
cagacactaatagagctcctcagaatagctcgtcctgttttccaaacatcatactgaaatatcagtgtcaactaatgagcaggcaattgctgtagcagaatgcggttactaggccgctatgtgctagccaactctatttctacgaagatcaggaaaatatttgtaacttcacatcgaatgagaaatccagggtaggttgatgaagcagcccttatcctgagtgctaaatcctgaagaagtttctccagaaagttcaggaaatagtgacatcaggtagtagacaagaaggatgcataggccagattttccaaacgagaagagtatacgtgtggaaaagatctctagggccaatgattgtaactcaagaaacctcttgagaatatggaagaagcacaggcagtgacaatatgaacggattacgtaagctctgggcacatcactatacacttcaggtgagaaggaactctgacagctctgcttctactagatcttcctgttgaggaaaagtccagcgtcaaggccacgaatcttgttttcaaaatataccaactctaaaataccttatttgccttgttgttctgatatgtcttataaactgttctaccattatgagcttaaatgaattggcttgacatttctacggtttgtcattggtcctgggtatcctggggaaccacaggctggacaaacaagagtcctggtctagaaagagttacctcccgggaaaaatcttctcttttaaaaaaagctaattaaacccccaaattgggtgggggcaggggcattccatggggccaaaaccccggaggccccgaagagacta

SEQ ID NO: 631649 - DNA, 453 bp, Homo sapiens
actggggccagtggaagatgcttgatatgtatttgcttaatgaatacacgggttaaggaaggaaaagctgctaaacaggagctaagttcaaggggtccagccagagtctggctcttcagggagcattcttactggactgagctgataaacagggcagggacgcctacctgggcaacagcagtgccctgtggaaagtatgcagctgcagagttagcagagaaccatggttgtgggtcttgggcctgtttccccatctgtcaaatgaggttagtgctttgccacctctgtctctgaagtcagctccagatgatatcgtgctttgaaatattaagccacgtgcgagcgtgaggggctgtcacgctccaggaggtcctcatgcgagcccaggagcacctccctgtaacactgggaactgtcagcacctccctgtaacactgggacctgtgagcttca

SEQ ID NO: 631650 - DNA, 270 bp, Homo sapiens
  misc_feature (254)..(255): n is a, c, g, or t
cggtccggtcccatgcacagttcagtgctccattacaaacggatccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaagggaagagtgtgatgaacgcacctgtgnnagccataccagttcc

SEQ ID NO: 631651 - DNA, 140 bp, Homo sapiens
gcggccgcctactactactactgctcgaattcaagcttctaacgatgtacggggacatgggaaaaaaaaaaatcctgtcttgttcataaattgacaatgtcaataaattgaaatatggttcactgtcaaaaaaagaaaaa

SEQ ID NO: 631652 - DNA, 376 bp, Homo sapiens
  misc_feature (77)..(77): n is a, c, g, or t
gacagcattcggctcggatgctcctccgggccttagctggctcgcgctctctctcttttgcctggggctatccagcngactccaaagattcaggtttactcacgtatccagcagagaatggaagtcaaatttcctgaattgctatggctgggttatccatccgacattgaagtgctactgagaatggagagagaattgaaaagtgggcattcagactttctttcagcaaggctggctttctatctttgactacactgatacccccactggggatcggcatgtagcagcatatggggttgaagatgccgatttgattggagaattcaattctgttgctgcttttaaattgaatgcctaacacttaccttatgccaca

SEQ ID NO: 631653 - DNA, 963 bp, Homo sapiens
gactcccggcgaagacagctgacgcgcgatatggatgcgcactcctatactgactgctttggtgccggggtggtgaagccggagtaatagttaggccgtttgcgtacctttggagcattatctataattcggaaggatagccctgaggaggaaacatgcatcgcgcgtaggccgggtgtgcagtcgcagggttgcaagcaaccggttggactggaagacttttgacggctggggcgtctcaaagttgtagtctaccggacgatcgaagttttaaggtgaatcgtgtggtcagacccattattctcgaggagcgtacataggtaccccaagatggcactcgagggttcgggacatatgtcgagatttggatgagttggactgagtggtggggggtgcctattgggtggagaaaagaattgggggacaaaaacttgagggtggtgagtcactgggtggggagaatgaacctctgtggcaagataccaacgttccgtagttgttgacttctagaacaaatagccagagggggttagggtggctaggatgaagggggtatcttgatggcacgttgaatgagcaagtatatcgtaaagcgaagggatttaacctgttgaagtaaggggaatatgggtggggcagtctgaagtgcaaaaacagttgacgccaaggcaggggagacaaaaggtataaagtgggcatccgggtgggtacaggagtggtctcctaccagaagacattctttggattcgacgtacgtaacggtccgggcaactcgctgggacctgcgcaagaacgactgtggcctgtcgaaggagtttgtcatgggatcaccatgtccggacggaatggtggggggagtccagaatcccctcggtcacccgggcactccacggggggggggggaacaaaccactcggattggattccgacctggggaaacatgtggcggggggacggtccaac

SEQ ID NO: 631654 - DNA, 384 bp, Homo sapiens
tatgatacatacataacacatgtttttatccatggaaaaatccaatccaagttcatccatccaatgaacatgagagtgtagatatctctttaagatactgatttccgtgacttcagagctatactcagacttgggattgctggattatatagaagttttatttttagttttgtaaggaacctccataccgttttctatagtagctataccaatttacattcccaccaaaaatttgagacagttttcatttatccacatttttgccaacgcttggtatcttttgatattttttattagagacatcctaacagatgtgagattatctctcattgtggttttgatttgcatttccctgatggttagtgatgtttagtaccctttcct

SEQ ID NO: 631655 - DNA, 529 bp, Homo sapiens
  misc_feature (34)..(34): n is a, c, g, or t
ccacgcgtccggttatctaaatcacattttgtanaagcagttagatgtagtaagtctcttaaaactatattaactcactagaaacagccaagttatcaaaacagaatatatgtaatggaaattaccatttttttcaactataactaagttacttttattttaaaccaaaagtaacttagttatagttgaaaaaaaagagtttccctcacagaaaaagcatgtttatctgtaaaactgttagctgagcaaaataactagtgttgccagataaaagcaagctaccgataggggtatataaaataggacatcagaaatgccattgcaatattttatcaattctgtgatgcatgtaattttacattaagttatgtaaaattaagtgatgctatagttaaattgacagcattttttttcctagtggtaaatgaggtatgtcttgtaatgaatagtatcttagattttatgaaacacaatattactgaatttagactggaaacgtgttttaatctcctaaagttattacaaaaaa

SEQ ID NO: 631656 - DNA, 176 bp, Homo sapiens
tggtgatgctcccatctccacgagaagtataagaattagcatgggctatggtaactggtgcctgtagtcccagctacattgggaggctgagatggaaggatcacttgagactgggaggtcaaggatgcagtgagccaagattgcgccactgcactccagcctgggcgacagagcaa

SEQ ID NO: 631657 - DNA, 440 bp, Homo sapiens
attgccctaatgatgaaaataatttctaggacaaaagagtgtgtacattccaaagcagatgttctctattgcatctctggctggcctcaaactcaccctgtagtctatgttggccttgaacttgaatcctcttgtctcagcctcctgatgctggaattacaggcctggctgtagagtaaaatttcatcactaaattggatgaaggcgacaaggcacacacacatgactgttctgtcctgggctcctcagactgttactgaggtttgtgcttgaggtttgttttttgtttgtttgtttgctttgacatatttcaacaacacatgccaaggcaacttgcttcccatgggttaaagcttttccttccacagggtcttgtgtgaggacagcttcggtatcatcctcgtcgacgcggccgcgaatttagtagtagtagtaggcgg

SEQ ID NO: 631658 - DNA, 300 bp, Homo sapiens
gacacttctggagtcagctccctgccacaggaccaccgttggtgcatcagttgtaccaagcaccttaagctaaagctggattcgctctagcatccctcctctcctgggtccacttggccgtcttcttcccaccgatcggtgttccccacatcttgggcgcttttgggttggaaaccaccccacacttggaatagccaccttgcccttgtagattccatccgcccattccgtccattcatacattcctccctcggtgcactgaacttaagagcagtttccatttctgccccgcccatattt

SEQ ID NO: 631659 - DNA, 388 bp, Homo sapiens
  misc_feature (58)..(58): n is a, c, g, or t
  misc_feature (86)..(86): n is a, c, g, or t
  misc_feature (245)..(245): n is a, c, g, or t
  misc_feature (284)..(284): n is a, c, g, or t
  misc_feature (308)..(308): n is a, c, g, or t
  misc_feature (347)..(347): n is a, c, g, or t
ggtgggcagcttctctctgcagctgctctcccatcatctggctgaatatggggctttnatgggcctcaggggaggaagtgtgtgcnaaatggtccgtgggcaaacatgggcgggcctggaaaaggcaccacaagttcccaccccagtcagtaggatcagcagtctgacacccaggcttcaggccctccccgacttgaaggtggtgcttcaccaaggactcacccactcctgcccaggagcttgtntgcctcctgctgccatttatggtgcccaggctgtttgtnccaaggagtgtctgtgggccagcnctgagctgccctcagcacccccttggcctcttttctgtnctcattggtgcccaaagtccgcagcaggctgaagtggcagg

SEQ ID NO: 631660 - DNA, 236 bp, Homo sapiens
tacacaggacaaattatagaagaagataaaatgtattacataagcaccatacacagtgaaatcatgcttatattacaaaaaataagtgaagctatgtttggaccttatttccttgcaagagcagtaccatatccttagtaaacaactaccatatttacaagttaattacgttaatacttagcatagaattgaaagccagaagaaatcatggaaaagtgagctttgaaataatcttt

SEQ ID NO: 631661 - DNA, 1991 bp, Homo sapiens
  misc_feature (238)..(238): n is a, c, g, or t
  misc_feature (510)..(510): n is a, c, g, or t
  misc_feature (1142)..(1142): n is a, c, g, or t
  misc_feature (1482)..(1482): n is a, c, g, or t
gtactagtcatttgtgtactcgtacgagctatgatgttgcttgataacagcgcaagtagtggtgtgctgcagtaccacgtaacgtacaaggaaacgaatgaaagaagacatcaatgaacgtacatagttactagtggacttggcgggccttttacgtatcatggaaggtggactccgtgtgacgagagtaatctatctcagacgagacgacgacttggtcatacttctatcatggggnactactctcgcccacgcactcctggctcctgtactcatgggtcgtaggcccgtaccttgcgcgcttcacgcatacgtgcctccacacgtcccacaagcgttttcaaccgctctcaatcaataatcatgtggaatatacagatcgtttcccgtctctgcttgcgtttgcgtcgctggaaaacaactgccactctagtgtctccaagtaaatcgcgagtttgcaacaagtttgagttacgctggagatcttcgtctcattcaactgttgttttntttaaccacaaacggtcttttgaaacaggtataataggccttgcggaacaatgctcactgtgccacgaacctcaagttgttggctatggatgttgaacgtcgcacgaccttgagaggtggtcccacacatggtgcgcgttgcatactgtgaaatgacgctcactgtgaagaattccctcttacgtgggtcgtttgcgcatggaagggaactctcacgaacaatgagcgatcacaattttcctataatgcgctacggtgtttcataaccttttgcaaaatataggcataacaccgatattgccccgaatttacacagacgtgcactccacactgggagtattgccaaacaaatacaactttgggtactaacccacaacaaggtgcgcggtacttacaacccttatagtaccccgaaccgctcccagagcggcaagcacaccacggggggggtacggcatttggcatgttacggagagcggttcgttctaattcagtgccaaggagggcagtagaggtgttaagccccagctgtcgcgctttcctgtagggaaattaggttggcccccaaaaaaaaggattgtaacgaggccctgacaagacactcacagttgtggagggggtgttgcacttcntttcgaccacacggtgtgtcaactgtcttttgggcaacatataagagagcttcccatattaaacattttcctcgcatttttctattttctaacccttggtatagacacaccaggctctccagttactatcaatctggtgtcaacataagttatccggcgtcaacagggagttgttcaaacaccgaatctaaagtaaaaaactacaacggggtggacagggggacctctaacaaaaagagccgttacttaaatattccaattgggagtcgccactattggttacaagcgtgacagcacgaccgtgtggccaaaacgtatcttttcaaaagaacgcgcgttngcagccaatatgcccttcgtaaagccttatgggggagacaaccacagtgactatccttgcccagacaccctgtaatatataccaacagggcgggcgacaagcctctgtggaagagccgcaccgattatagaccacaccggcgagttgataccagcacgagattaccagcagggtgcagccgggagaaacacaccactcagacagtgcgtgcgtctagttacacaacacaaacaccccacgccagctaatctactgcgcacggagcccacaacaccaagagaagcaccctcagtcgcgcaaccatccgtgtcgtaggcactcacaccacgcctcggtgcagctgagccgagactaaaagtactacgtgactgacgtagcagtaccccatactacacagaacactgacccatacagccgaaccgacaaaacacaacactaagatatcgtagctgcaagtcgagagagcgatcaccgccgatccagagaccagagaagaaggggagaggggc

SEQ ID NO: 631662 - DNA, 392 bp, Homo sapiens
ggtcaggaacgattaactcactcacgctttgtagcttcagctgcctgcactgtggctcggtatgtaatagttgagtataagaatggatgggaaagaaaggagtatgagaataagctgattgcatatttcaccgctttatgttttaaacttaggtcagctctggatctgtctctgtttttagtgtttctggttataaacaaagagatgggccaagtggtgagtaaactgagaacttatgttccatacctattgggcaggatactagtattcaatactgcacagggtcataacttggcgtgcatattcattttgttacacatttctatttgattattaccagagtttacatttaatgtgggaagaattatcttattaagcacgtctgttcaatt

SEQ ID NO: 631663 - DNA, 605 bp, Homo sapiens
  misc_feature (33)..(33): n is a, c, g, or t
  misc_feature (126)..(126): n is a, c, g, or t
  misc_feature (189)..(189): n is a, c, g, or t
  misc_feature (194)..(194): n is a, c, g, or t
  misc_feature (240)..(240): n is a, c, g, or t
  misc_feature (272)..(272): n is a, c, g, or t
  misc_feature (292)..(292): n is a, c, g, or t
  misc_feature (319)..(319): n is a, c, g, or t
  misc_feature (339)..(339): n is a, c, g, or t
  misc_feature (342)..(343): n is a, c, g, or t
  misc_feature (349)..(349): n is a, c, g, or t
  misc_feature (393)..(393): n is a, c, g, or t
  misc_feature (398)..(398): n is a, c, g, or t
  misc_feature (404)..(404): n is a, c, g, or t
  misc_feature (412)..(412): n is a, c, g, or t
  misc_feature (428)..(429): n is a, c, g, or t
  misc_feature (433)..(433): n is a, c, g, or t
  misc_feature (435)..(435): n is a, c, g, or t
  misc_feature (451)..(451): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (509)..(510): n is a, c, g, or t
  misc_feature (512)..(512): n is a, c, g, or t
  misc_feature (516)..(517): n is a, c, g, or t
  misc_feature (532)..(532): n is a, c, g, or t
  misc_feature (574)..(574): n is a, c, g, or t
gaattctatttcaattaacaaccaaggcaagtnaagcactttacctaacttcagaaataccaccagaaaccattccacttctgtaacagcttcttcccctcactccagcacaaatatttaaatgcngtccttaccttagtccacaaaagcaaaacatgaattacaaagctaagattaaattagaaagcngccgncttaaatatgacaaagtttttttagccttaaaataagaactaagtnaaatacattcaacaaaagtaactcttaaaggnaaatttttttcttatttggngttttcttcccttcccatttaaatttnagactcaatttttaataatnttnntatgtncatttttctaaataatatatcctctttaaaacaatacagaatgnctagnggtgcnacctatgngtccacataaatatgnnaccngncacataaataaaatangggggtttttcggtctttttttccggcatttgtcactgccaanccngcnggccccccnncnaggnntattttggggggggnggggggggggggggggggggggggggggttcactgtgtgggntccgtctttatgggtgtcctaaaaagtagtg

SEQ ID NO: 631664 - DNA, 1169 bp, Homo sapiens
ggtgaaggtctctctgtctgtcgggcgtctttttcctaccaagggtctcacatcctcgtgtgtttctggcccgcccccctgggtcgcccggcgccccgttgtacttttgggcgggggcgttcacccgtatagggaccccccgtccccggggtgctcgtctggcgggcgtttttgttttcccggcacatcgtacaaattgccgcgtgttgatctgccggccccttttgcgcccccccccggggcccccggttctttgtgttgcccccccccctgtcattgtgccgggcctctctccggcggtttttccacgaccagccgtccgggtctacccgggctttccccgccgatttcccagggtcccccgcccgaggcggaggggtgagccccggattccctggaatggggagtgcccatttccccagtttcccccggtattttggggaacactctgtccccacggggctaccgcccccttgatggggaattgaaagaattgcgaaggccccttgggcacaggccacaaacccgccccatgggccccccccccccccccgccccggagtgtgtgcacaacgcgcggggagcccccctgacctccttgggggaacttatatgaggctctcttttccttgggagaggctcgttggaacgccacaaaacacccgctggcacaggaggttttccctcgaaaagctcgggcttttaggttcacaagcctcggtgccacagaagtttccccctcgctggagcttccactcacccaccacactccccccacgcctttcaccctcggaccctgaaggaccctctttgagccacaactgccctcgtcactttcctaaccttacccttagagtccctcccccccatgcacggccacctttctcctccctcctctctaaatagtagtcccctctcctcccttctaaagagccaccatatccttaccccatatagtctccagaaaattgtttttaagccaccagcccccaaatagctggctgccccccagccccagaaccattggggcccccctacctgcctggccctggctgatgggcacctctgttggttcccatcagacccgagctctgcccaaggcccccccagatccctctccccggaggaccctagaggccaattaaatgatgtccctgttcccttggcca

SEQ ID NO: 631665 - DNA, 915 bp, Homo sapiens
tttacacttatagtagactttatttagtgaatccaaatgacatgtgataattgtttggaaaggcctattgattttatatctgatcattcaatccagagacattaaattcagttgattaatggagttccccaactgtaagacttctttacgagattattttcaagctttgaaaagatcttctgagataaaggggatcagcaaacagtaagagtgtgttgctatacccaagcaaaagaaataaatcttaatctctcagcaaatcattcaaaatgtcagaaatgttagtgtttctatatcttggtaaaatggattgattgagaagtatgaaaagtataacagtggcatgcagaatattgtttttatgaatattcagaatttcagttgtttacataattatgtatctttatagtaaacgtaaccacatttacttgtgctgtgctttagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaaggtatgagtctaggtgggacgggcatggtggcccaatactggctatacatgttcatctgcttcttgtcctagtgccttagactactgctttagaagttggaataaattggggaagtttgagctgaagaccatcttcgcactttacagtaagtttttcttctctgcctcttgtctccattaaaactctgtcctcttcatctgggcctcaggaaccccgagctcatgggaaaagtcttgaggatctccccatcaggaaggtcacggagggactgcaggagcagggagttgctagaaggaagatg

SEQ ID NO: 631666 - DNA, 572 bp, Homo sapiens
ccaaaagggagccatgattcttataatttaagggaagcaggtttaaataatgtaacttgtgtttgtctcagaggttggaaaaatatcctgaaagagtggaagcaaactgccatcatgaggttgatactgggctggtaaattattactggtctggttgctttcctctagttttttttctcagacaacagtacctataaatttatgaacctgcttttcttctgggcagcatgcatattaatggttcctaaaggcttctctttttatgctgcagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631667 - DNA, 627 bp, Homo sapiens
tggctactttttatttgtttccttggaagcatttgttcaaaaagacagtatagatttatgagttttttgtggttgtaggagttatgtcatccctacatcgtattgttataaattccgatttgctatggcttttgaaagtcatcttttgcccatctgcttgtgattattttactagtgtggtatgaagaatagcacttgaatgtcctgtccatacctgtctctctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631668 - DNA, 156 bp, Homo sapiens
tagtcaggctcggcccttattctggcagcagtctacagagacagctgccagatgaagccagttttattaacgtagatggaaatttttacatttcttcacgttttccatagtttccgtggcagctgaggaagtggtggtcgcaactggtacggcggg

SEQ ID NO: 631669 - DNA, 99 bp, Homo sapiens
tataacggctgtcgagaagacgacagaaggggaattggaaaagcgcagaagaacccttttggagcaactggatgatgatcaataaattataccaaattc

SEQ ID NO: 631670 - DNA, 1094 bp, Homo sapiens
acctcctaccccacgaggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagcgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631671 - DNA, 593 bp, Homo sapiens
gagtgatcgctaagagatttgaacacgaagtagcaattggattataccaaggaattactgttaatttgcttagatgtgatacagccctgtgtgaaatcagttgtccattaaaagagatgcagataagtttctgagatttgctttaaaatacttaagcatatacacacccaacactggagcacccagattcataaaacaagttattctcggcttacaagaagacttagccacacaataatagtgggggacctcaggctgggtgcggtggctcatgcctgtaataccagtagtttgggaggccgaggtgggtggatcacttgaggtcaggagttcaagatcagcctgaccaacgtggtaaaaccctgtctccactaaaaatacaaaaccagcttggtgtggtggtgcatgcctgtaatcccagctgctgggcaggctgaggcaggagaatcgcttgaacccaggaggcacagattgcagtctttttttttttttaagtgggtaatccccttatggagcggactcaaataggtggctgtgattaaatgtcccaagcaaggatagggaaggggaatggttgagcctctggagatcat

SEQ ID NO: 631672 - DNA, 1167 bp, Homo sapiens
acctcctaccccacgaggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagcgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631673 - DNA, 1053 bp, Homo sapiens
ggttatgtaagaactgtttgtaggtgaataaatgccactgtaataaactgatactagggaatggatttgtctttgacgataatctctttgtttctggcagaaaagatttgggcactaagaaacgccaggataagtgatgcatctgcatgctggtttaaaaagcagcgtgaaagatgcagaagtgtcatcctgtcaatactcatcaggtaaagcaacattggaaagatcaagtactcaaacaatagacaaaagttagcaaatgcaagtacacttgcaccttctaatgaatttttattgtctgcagtatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagcgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631674 - DNA, 756 bp, Homo sapiens
acctcctaccccacgaggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcatttgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631675 - DNA, 915 bp, Homo sapiens
tttacacttatagtagactttatttagtgaatccaaatgacatgtgataattgtttggaaaggcctattgattttatatctgatcattcaatccagagacattaaattcagttgattaatggagttccccaactgtaagacttctttacgagattattttcaagctttgaaaagatcttctgagataaaggggatcagcaaacagtaagagtgtgttgctatacccaagcaaaagaaataaatcttaatctctcagcaaatcattcaaaatgtcagaaatgttagtgtttctatatcttggtaaaatggattgattgagaagtatgaaaagtataacagtggcatgcagaatattgtttttatgaatattcagaatttcagttgtttacataattatgtatctttatagtaaacgtaaccacatttacttgtgctgtgctttagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631676 - DNA, 1327 bp, Homo sapiens
acctcctaccccacgaggaaagagacatttagccaacatgatgggagaagatccagaaactttcactcaagaagatattgacagagctattgcttaccttttcccaagtggtttgtttgagaaacgagccaggccagtaatgaagcatcctgaacagatttttccaagacaaagagcaatccagtggggagaagatggccgtccatttcactatctcttctatactggcaaacagtcatactattcattaatgcatgatgtatatggaatgttactcaatttagaaaaacatcaaagtcacttgcaagccaaaagtctgctcccagaaaaaactgtaaccagagacgtgattggcagcagatggctgattaaggaggaactagaagaaatgttagtggaaaaactgtcagatctagattatatgcagttcattcggctgctagaaaagttattgacatcgcagtgtggtgctgctgaggaagaatttgtgcagaggtttcgaagaagtgtaactcttgaatcaaaaaaacagctgattgaacctgtacagtatgatgagcaaggaatggcctttagcaaaagcgaaggtaaaagaaagactgcaaaagcagaagcaattgtttataaacatggaagtggaagaataaaagtaaatggaattgattaccagctttacttcccgatcacacaggacagagaacagctgatgttccctttccactttgttgaccggctgggaaagcacgacgtgacctgcacagtctcagggggcgggaggtcagcgcaggctggagcaatacgactggcaatggcaaaagccttgtgcagctttgtcaccgaggacgaggtcgagtggatgagacaaggtatgagtctaggtgggacgggcatggtggcccaatactggctatacatgttcatctgcttcttgtcctagtgcctgaagttcgtaagaaaatatatagttacatatgtaatatttcacttcgctgtcttctttcttgctacagaaccataacagtatttctcagatttgatttctacaaggtgagcttgaattagaaaaaggggagaactccccacactgattatttgagccctgctaaaatgttcagttccaaggtcagggaaaagttaattttggccttaatgcataaccttttatccagcttaacaaagtgcttagcttagttatatttaagagacaaattgcttgtttttgttttatcatagaaatgtgtgggttttttgtttttgttttttaaacagtctctctctgtcagcctgggcaatagagggagactccatctcaaaaaaaaaaaagaag

SEQ ID NO: 631677 - DNA, 1110 bp, Homo sapiens
  misc_feature (997)..(998): n is a, c, g, or t
  misc_feature (1035)..(1035): n is a, c, g, or t
tttgtgtagattgtgtgtttgttgtcccacgtggtgtggtgttcactatgtggcggttgcttgcgacttttcgggcgtgtcaaatgaattgggcacctttaggggctttggctttgtggttagccaggtcccgtgcccttttgctgagatgcattgtgtgccctgcccttccgttccctattttttgagttttctagttccctccgttttggcccttttggtccctgtattagcggctctttccctatgattcctcccgtgtctttgtattgtgaggtccttgggttctgttctcgctctcctctttggcagggcccttgttcgattgtcttggccacagcgtctcgtgtgtttgcccttggcgtgcaccgtttgaaatggggggcctgggagttttctaaatgggctccccttgtgaactatcgtatatttttggccaaacaccattccacgtacttctagggtgttaaaagtttgcccgactctttttagaccaccgggttttggaacttaagagtggttgccctagggtaattctggtgatgctgccttcttgctgccacttctgtgtgtgctcccttctgggtttctactgtaattttttttctcgttaatgccctgggggtggctccagggttcacctctgagttgttctgtgaattttctgggcgtgggttttgagcaaaggactcagcctcatagtagccacgaataaggggtggtgggttcatggcgcgtgtgttgaccctcacccagagccacatccctccccacgtaactttgtttctgcaatgtgtaaaggtctccccacttttttttaacgcacacccttgtcccctttttcctaccccaccacaggtcttgttccacatgtaaagtgtgccacaacacgttgtcacctgaaacacgtgggggaaatgtgatggttttggcaagacatcttcacgtattgagggggcacgtttgacttacctttgagggtgtgatgtctgtagcnnatgtggaaggtaaaaatagtggtgtgatcatgaaccnaaggaatttatgttttgtaacttgggtactttattttgcattttgttatactattaaataattttttccctgtta

SEQ ID NO: 631678 - DNA, 425 bp, Homo sapiens
atatacccgatgtttatatgtgttagtgtggtggcaggtagtgtagctggagcaatatgattggcaatggcaaaagccttgtgcagctttgtcaccgaggacgaggtcgagtggatgagacaagctggactacttactactgatccacgtgtgagggaacggaagaagccaggccaagagggagcccgcagaaagtttacgtggaagaaacgctaagggtttgctcccaggaaaggagaggaagagctatatatatgtgccgacatgtggcagacacacagtaaataatggctgaccagcatgagggcagtactgtcagaaatttctttgagctgtgagatggatttatttttaaatgctactttgtaaaggtgacctttaaaaaataaaaggaaaataaagaatgttagtttcaaaaaaaaaaa

SEQ ID NO: 631679 - DNA, 102 bp, Homo sapiens
atcacagagagccagaatcctcagtactagcactcagtcctcccatgcagctgaccccaactcagaagccataatggtgatggagcagcagatcccatgaga

SEQ ID NO: 631680 - DNA, 279 bp, Homo sapiens
ctcggcccactgcaacctccctctcccaggtccaagtgattctcctgcctcagcctcccaagtagctgggactacaggcgtgcgccaccacacccagctgattttgtatttttagtagagatgggggtttcaccacgttggccaggctggtcttgaactcctgacctcagtgatctgcctgccttggcctcccaaagtgctggaattacaggtgtgagccactgtgcccagccttcaatatgagtttttaaaattcagtaaaaatttcctaaggctgac

SEQ ID NO: 631681 - DNA, 207 bp, Homo sapiens
accaaatacaaaagaacacatagctgtaacacagctgtagtagactagaatgctctgtatactttatattaaaaaatgctagcataacttccagctgcaatgcaaattcatacatggtgtcccacctatatgtaatgatggtacaatttacaatcttagtcaacttctgtagaaagttctctctatgacagttttgctgtctgaaaa

SEQ ID NO: 631682 - DNA, 348 bp, Homo sapiens
taggagttcctggtggtgatacagtgatgtatttactaaacagagacctgtgcagaaattacatactatccatctagataggttgttacacttttgcctattgatggaatagttccatttatcacagttttataacatcaacaaagcttttgaatgttcaccgagacgtgtccacttaatttcaccctctgaacaaagttggcatttacatttcagcgacttatattttacatgcattaacaaagcttatgcattaagggttgcttctctgcacaaatggcattgatgcagacagagctggagtcccattatcacgcaccagagaattcttcccgcgtaccgcagctc

SEQ ID NO: 631683 - DNA, 199 bp, Homo sapiens
atgctttagaggcacaaggaggcagaggcacaagtaagggggtgagggtgaagcagcgtccagcttgtgaagttgcttgggcagggagaggggatcttccagggggatctgtgtccacactggggggcctcctaggcctgagctggggctggcgcagcctcatgttctgtggtgcagaaggacctggctcggtggggtg

SEQ ID NO: 631684 - DNA, 104 bp, Homo sapiens
ggtatatacaagtagtgaatctatgaccaggaccatagtggcacatcaactgtctgctttgagtgtgaaaagaccctggtggtgatcctcttagaagctcgaaa

SEQ ID NO: 631685 - DNA, 273 bp, Homo sapiens
  misc_feature (27)..(27): n is a, c, g, or t
  misc_feature (39)..(39): n is a, c, g, or t
  misc_feature (59)..(59): n is a, c, g, or t
  misc_feature (135)..(135): n is a, c, g, or t
  misc_feature (198)..(198): n is a, c, g, or t
  misc_feature (248)..(248): n is a, c, g, or t
gaaaaaaacaaagtttgagaacctctncttctttttttnttcttcatcctctggaagtnccaggccttctttggtgactgacactaaagtaggcctggaacttccagaggatgaagaagagaaaaagaagcaggnaagagaaaaaaacaaagtttgaggaacctctgcaaaatcatgaaagacatattggagaaaaangttgaaaaggtggttgtgtcaaaccgattggtgacaatctcccatgctanattgtcacaagcacatatggctggg

SEQ ID NO: 631686 - DNA, 109 bp, Homo sapiens
ctggaagtggctcgagacagcgaaacgctgtattctccgtgcgcgtgacacggtccacttgtccttcctcagcaaagttcatccatacccaggatggcaatcatatcct

SEQ ID NO: 631687 - DNA, 713 bp, Homo sapiens
  misc_feature (111)..(112): n is a, c, g, or t
  misc_feature (141)..(141): n is a, c, g, or t
cccgctttaggctgcatcagccggggattgccggcgccaggcatctgcatctgggaccgacctcctggtgctggctgatcaaagaggaagcagcagcaatgtctgctgtgnngggctgcaactccatacctgcatcatccnggtgatagtcacatgtggcctgatgtgagtttcttgaggggcccagcttcctccagaggtggcagcaatgtgccctggctactaggtggacctagacagtgagcacgttcagaaagttgctgaagtttgtgtgtcagcaagcctgcagtgtgggatggactgcctgagaggctgtgcagctgtacttggtggtcagccgccaacctgccggaggagcagctgggtgccctgctggcagtgcatgcacaacactgctccagcaggccctccgtctgcccccacaccagactgaagcctgacaccttcagggaccaagctccaggagctctgcataccccaatgaacctggtcggggacttggccaagcgtggtatacgggagccagcggccactccttgattcttgtgagcccaagcagcagggggcctggcttgctgaatgaatgctgaactatacggtggacggggtggatgtagcaatctccaccagtgccctggctacgtccctgaactcgcgcgtcctgatgcagtgaagcatacaatgggtaacatacggttgaggcccaagccaga

SEQ ID NO: 631688 - DNA, 1576 bp, Homo sapiens
  misc_feature (1006)..(1006): n is a, c, g, or t
ttagatgagatcccctcgttgtgatgaggatgtgtctttctcgcccgcgctcctcttgtgtgatggatgttgtttctgtgccgccgtgtctatcactcgcccgggttgtcctgtgttgcctccccctcccctcccactagtagtggcgctccttggtgtctgtttctctctttggtggcccccccacagatgagatgggcgcccccccccccccgttgtgtgtggtggaggtgatgccccgcgagtgttgtctctcggggagtgggtgccccccctcgtgtgggcgtcccccgaatgaaaatgacatcgtgttgtgtaagctcggggggctccccccgccctgaaagagtaagtgtggccctttggttatctcttcactccccagcgtggtgtataccaccgtggtgttggagaagaccgcccacaacgggtgttttttttgtgcgcgcccacagcaggatatattgatagtagaacttcggatatttttctggatgaatgggttcatacattcctcggggggggagtgcgtaacacctcaacgaggggggccaccaaaatgagaggcggctaattccccaaaaaaaaagggggggggttcctaccaccccccaagaataccttgctgttgtgggcggccccaccaccaccccaattggaagaataggcttcttgcccccccccccgccgtccaatggtagcccccccctcccctcggagagcgccaccgttggtcgtcgacacactacaagaggtgtggtcgccacccttgtattataatttttgtgggggcggcgactattggtgccgatattctcatctggtgtgtcctcgtattgtttaacagccacccctttcctcttctattgtgggggcccagccccgcgctctcggggcgcagagataaagagggctataagcacactatctcaccgccactctcgtgagatgatttcctctacacccagatgagggagatatttttatataaagagatatttgggcnccctacgcgagggtctgtacccctctgtatatcacaagaggaacgcgccacaagaatcttgtgatttcacagaggaacccacacagtgcctctcccacctgtgaactcatgtgatcctcaattctgtacacacagagagagcactccacacccctctctgtgggtgggctctttgtgtccacatattgtggtgtaaagtggacccacacagggaactttgtccaagcttgaaaaggcttgttgttggttgggagacccaagagaaccgggtggcctccacccctctccgcaaagtgccctttgcgttggtcccaagaccgagaaccggccgggcgttttggagagaaagagttgagcccttaaagttctacattgacacccaccctcccaagggttggccacatggccggcttctcagagcccatggagagagaagaaagaaaagcaattcactgggagcccctgaaagaaaagagcccgacattgccaaaggagaagaaagagcttaatgcccgggaccagattttgcagattggtggggtttccaattaaagattattttccccctga

SEQ ID NO: 631689 - DNA, 427 bp, Homo sapiens
  misc_feature (40)..(40): n is a, c, g, or t
gctttttgatagttgaataatagactcagcaacacagcanctacaaggaaaaaggggatgatgtaaggtgagataccaacactgctttaaagcaatcctagtcaggacccagcatggctaaagcacatagtggttttgctcttattgggttttggctgctttatttttgttatgattgtttttttctattataagtattattttgtttgaggcaaataaaatgtcttctttatatgacaggtgttaaggtggttacttttgcttttagcaaatgcataggaggaaaatctaagctacattctatgaaaaagagctaattttgaccaaatatcgagcagctacgtcatgagtggagttagcatcgctgatgggtctctacactagggatagttattttggatctgctgctgcgttgttgcatagggaa

SEQ ID NO: 631690 - DNA, 148 bp, Homo sapiens
cctcgcttagtgctccctggagtaccctatcgttgaaatgccggcatgccaaagtcaagtagtcctgcggcttaagatacccgctccgatattcgacctcattaatattgaatgcaaagttccatgcaatagctggcatgctagtgca

SEQ ID NO: 631691 - DNA, 192 bp, Homo sapiens
tttttgctttgacttgacgtaatggcatcacatggtacagttaggtgccatgttcattaggcagttggaaatacgagcttatagctcaggagagtgtttggacgttgttctgggactctgaagcatctggctttttagtcctagctctgccatgcagctgttatctgtgacaagtcaagtagtttatgctgt

SEQ ID NO: 631692 - DNA, 702 bp, Homo sapiens
  misc_feature (438)..(438): n is a, c, g, or t
  misc_feature (523)..(524): n is a, c, g, or t
  misc_feature (527)..(527): n is a, c, g, or t
  misc_feature (551)..(551): n is a, c, g, or t
  misc_feature (585)..(585): n is a, c, g, or t
  misc_feature (599)..(599): n is a, c, g, or t
  misc_feature (614)..(614): n is a, c, g, or t
  misc_feature (616)..(616): n is a, c, g, or t
gcgttcatacctgatagagagggtgcagttttcaggtgagtcaccagtgcctagtgtcacttcctgttcaagcgatggtctttgcatgtgtcccattcaggtaagttcttgattcccataattaataatagtcatccttaggctaccacttccctttccactgggatagttctgcattgaggcctattatgtgtgtttgaactacagactgttaaactaaggagtatcggattgtatttcgtgtggtactaggaacagaagctgtggatatcagctgcagatcacgtcgaagtacatggccgaggacaaatctacataggacgagaagcagctctagatggcctcttggctgacttagtccctccttattagtgattggcgattcaggccatgtcatagggcctttcagacaaaaggttcttatcccagtcagctggncaaaacattaactttggatttcttaccctgctacagcatcttctagaaaggcagcaagataatattgtggcagtgcacagataanntcnagggtagacttgactggagaaaancaaattctgcgcttgctcctgtgtgcccccatcncagctgtgcatgcncacacaggacacctntntagtatgaagaacttgcatcaatgtcatggcctctattgagtcacccccttctagaaaatacttccaaaggtattaacatgtgaac

SEQ ID NO: 631693 - DNA, 677 bp, Homo sapiens
ccattttttattaattgaagcacacagaaaagaggcaacttgattaaagaaaggatgttttctacacattggcgtggctttcccccaccgcactttagaaaccgaagaataagcttgtgatcttcattttattcaaattattctcatggaaagctgagatgcgactaaaatgtgaagttatgcccctcaggcaaattgccttgcaacagcaagattggtaccctcctcgggggagggggtctgcttaatataagacttgcggtatttctatacaaaagaagggctggcatgcatcacagctttcatttgatcttttgttggctagggcaagaggttcacaagcttaacacgcgcacgttggcaattgaattgtctctccttctcagtaagcgggcatatacctgcctggcacgagaatagttctgctttggactctttaggaaccgtttgtttcacgaccttcaccaatggaaaggatgggcacccggttacccaaggaaacccgcaagaattggctgcgtgtttacttggtggcgtttaaccatggcccacacattacctggtgttgaacagggggagggccgcctcttcccacggcaatagtattttttaaagtagtttccaaaacactgcgccgactttttctttggtttttgggaacaccttcataggtgtgt

SEQ ID NO: 631694 - DNA, 317 bp, Homo sapiens
tctcctccatccagcaaactcgtaatgatccgccaaggcccaaatcagatacattctgctggtctgttcccctctctccgggtttgacaaagaatcctccttccattggactgtcacagtcatttgaacattcattcaacatgtatgtactgggctctcccactgttcacccggcattgttctaggtgatgggggtacagcatgaccaagacagagtccctacccacaaggcaggattcagtctcatattactgtctttcccatcaccaagcactgtgtggtcctgtgtgtcactgaaggaataaagggttgggccg

SEQ ID NO: 631695 - DNA, 888 bp, Homo sapiens
  misc_feature (438)..(438): n is a, c, g, or t
  misc_feature (523)..(524): n is a, c, g, or t
  misc_feature (527)..(527): n is a, c, g, or t
  misc_feature (551)..(551): n is a, c, g, or t
  misc_feature (585)..(585): n is a, c, g, or t
  misc_feature (599)..(599): n is a, c, g, or t
  misc_feature (614)..(614): n is a, c, g, or t
  misc_feature (616)..(616): n is a, c, g, or t
gcgttcatacctgatagagagggtgcagttttcaggtgagtcaccagtgcctagtgtcacttcctgttcaagcgatggtctttgcatgtgtcccattcaggtaagttcttgattcccataattaataatagtcatccttaggctaccacttccctttccactgggatagttctgcattgaggcctattatgtgtgtttgaactacagactgttaaactaaggagtatcggattgtatttcgtgtggtactaggaacagaagctgtggatatcagctgcagatcacgtcgaagtacatggccgaggacaaatctacataggacgagaagcagctctagatggcctcttggctgacttagtccctccttattagtgattggcgattcaggccatgtcatagggcctttcagacaaaaggttcttatcccagtcagctggncaaaacattaactttggatttcttaccctgctacagcatcttctagaaaggcagcaagataatattgtggcagtgcacagataanntcnagggtagacttgactggagaaaancaaattctgcgcttgctcctgtgtgcccccatcncagctgtgcatgcncacacaggacacctntntagtatgaagaacatacaatcaggtaggccctagattgcacacccccatggtagacttaagagcatctactaacacacggtctgcggagttcaccgcacgtcttcttgatatgtgataagcacgagtgacgatttcagtattgttatggatattgatatacagtcaagtggtaaggactagcttgcgattgaatgaagggcactaacggaaggttcaaaaatatggggtagatgatcgatccgtgacctgtgaaagtaggtaccgagctcga

SEQ ID NO: 631696 - DNA, 400 bp, Homo sapiens
  misc_feature (21)..(21): n is a, c, g, or t
  misc_feature (143)..(143): n is a, c, g, or t
  misc_feature (224)..(224): n is a, c, g, or t
  misc_feature (328)..(328): n is a, c, g, or t
  misc_feature (340)..(340): n is a, c, g, or t
  misc_feature (380)..(380): n is a, c, g, or t
ttaagacagagtctcggtctnttgcccaggctggagtgcagtggcgcgatcttggcttactgcggcctccacctcctggattcaagtggttctcctgcctcagcctcccaaatagctgagactccaggcatccaccaccacanctccctaattttttgtgtttttagtacagacagggttttgccgtgttggctacgctggtctcgagctcctgggctcaagtnacccgcctgcctcggcctttcagagtgctgggattacaggtgtgagccactgcacgcagccatgttttcagttttcttgagggagattcctaggagtagaattnctgggctgtgtngtaacttccagggctccttaaaaggtttagcctgggactnggtagagcatggttttccac

SEQ ID NO: 631697 - DNA, 112 bp, Homo sapiens
ataatcgcaggtgtgaccaacagttctcaggttccagtagcacagttctcgcatgcacagcaaaccaccaattgcagcattttgttccagtgcatcaacaatctgccatcat

SEQ ID NO: 631698 - DNA, 174 bp, Homo sapiens
gacttggacgccccaaccactccatcttactaccagacaaccttagccaaaccatttatccaaataaagtataggggttagtccttgctatattatcgcttggttataatttttcatactttcccttggcggtactaatatctatatggcgtccacaaggtcaggggtgaccga

SEQ ID NO: 631699 - DNA, 726 bp, Homo sapiens
ggccagagcagagggtactcagctaggtttgtgagatcactaactttacacacacacacacaccccatataagacagagcacactactcgacaaaacagcacatacagacactcatgtgcatcacactgtctatgttgtaccaggcttcttagcgtcggttggagcatcaaggagtactacaagttgatgtagtgtaaccatcacctgagacttttaccacatcacacacaacatccacctcatcattgagcatgagataccacttactaggaacatactaggattaagagagttcctagagtgtgcgactacgaaattggcctcttgcagtactagttatttaattccacttatgagtatcacacaaagataaagatgtgagacgaacattctgctagtaacgaaaggatttattcacactttggatgaaaagtagatacagatgatgaggaggagtaaccgcgtcgaggtttattatgagagcatacaagtggttcgtggatgttgctccggaggaagtggcctatataagaccagttacttttattaggagtctatgacttatcatatattaattaataatatagtgatgaagagagcgtgccagcaaccaagaagttaaccaacgaaggtagcatcattagttgtatgtgaggaggagcagagggtgagtgatgaacaaagcgcgaatatcataggtatgatattgcagtttggaccataat

SEQ ID NO: 631700 - DNA, 122 bp, Homo sapiens
tagaggatcccacacacaggcagaaaaagtgcacacgttcagccccacaggcccacccggtaccaggcctccattccaagtggctgcagggttggatcgtgaggcgaggtggagccggggcg

SEQ ID NO: 631701 - DNA, 285 bp, Homo sapiens
  misc_feature (33)..(33): n is a, c, g, or t
ctcggctatctcatgttctacatctagagacgngcccgagggtgattaccttgcgccgtagactctagtatatgttaaagatctgccacctgcacaggtgttgtcgaaagccaggtaaggttatctttgtgtccccctttctggtaatacatgataacagttcgcgagtctttctcactgccttcgttagaatagagtggctcgtcctcactggtctacactggtcgccgaataaaattgtattcctaactgttttgtatatgctgcattgagacttacggcaat

SEQ ID NO: 631702 - DNA, 819 bp, Homo sapiens
  misc_feature (47)..(47): n is a, c, g, or t
  misc_feature (49)..(49): n is a, c, g, or t
tacatgataacattaactaccacccaagcaaacaacaaaaacactgnangtgcactgactctcttctcaaccaccgaacccctgacctgccaggagcctggagaagatgaaggcatccgcggttctctccctccttggctacctggtggttccaagtggtgcttacatcttggggcgttgcacagtggctaacaaactccacgatggaggcctgcatggttgcaagctgtagccgcctgcatggcccctgcagcactcaccacttgtattttgtgaatgaaggtgcttttctgcttgctgcttcagtcaatacttctgatgatctcaccactctaacagttccacatggaaacagacacaagcttgctccatccggggatgccggattgctaaattaaccatactagttactcatatcaaatatcaagcgatgcggcccgttccctttactgccggttatctacgatactagctcactgactcccttgtcttcgcccgatagcttgtgcctctgtactcaactcacttctaggctgtcattatcgttttcctcaaaacaacggatcccctatgacccaacctctttccttacgccaccctaccgtcctcacccatctaatgccccgcttccgcccgttctcctaacctttcttccccttgcgaccctccccacaccgctgctaccccacactttgccacacccctctgattcacacctctacaccgctcccacctgcaagctccttccctcccttttctcccacccccattttctaagccccggccctcctttccactctaacggcgcccttctacacc

SEQ ID NO: 631703 - DNA, 1092 bp, Homo sapiens
gatataagctctgatacctcaaaatatcaagagataagcatgatggtctcagagttgagaaaactgcctaaactatgatgctgtaagtgtaatccatgtgcagatatgaataccgctgtgaagcattcaaatccacgagctaaaagcctaaatgtgaaatgctaatgacaagcctgagaaggtaaactgtgaatcttcatttctatcattgatctaaacttgcacagtattcggatcagagtatatactatggtggtatttgcaaatgctatggtaggagtcgcactagtactatcaagactatcaggtcgtcctcacaggttacaaatacaccttgtgcattaattgcttactcctacttcctagtataacagttgtcaagttatggcccgttttatgtgtagaaacgccgacattttcacccagatgtaactttcccagggaataacttaccgggttaaacattgctacggcagtataaacaccgagcccataaaatgccaggtaagtaaagtacatgctaagaaggatgttgggcttggattgctagtattgggaatccacgactttaccagtttgacgggcgattcctaatatgtaacgaagaatacagagcctatttaacgatgtgggataaattcaattaaacctctactcttcttaactactcctcggctctcaaggaaccaccagcggtggaccctgttgggattctacccgaatttcacccctgggatacagaaaactaaaaggcctcaaactgaaggttccctttaagacccactcgagctgctattgtgtgtgcgccgctagagaacagtgatatcgcttggaaaatgtttttcccccaccagagtgggtccacaatgattgatcccccccgagatttctcacagacgggcgtcaacctgaacgtgtgcgttgttactaaggacaatatccccgggtgtcgcataggcgccaacgcaatttataccagcgacacacttaattgttaccggagaggtttaaccccggggcaatgaaaacgtatttgaaccccagtgtccggcataggacatccttccacgaacaccatttgcggggtccctt

SEQ ID NO: 631704 - DNA, 203 bp, Homo sapiens
  misc_feature (3)..(3): n is a, c, g, or t
  misc_feature (141)..(141): n is a, c, g, or t
  misc_feature (143)..(143): n is a, c, g, or t
  misc_feature (181)..(181): n is a, c, g, or t
gcnccttgatgattacgcatgactggaaggagggaaggggcccagatcaaaaaaagcaccataagcctgaccaggaaggacccaaaggccccaatcacttcctcccaaagaacacccaagacaatgactgggtttctcagngnccctgaagcaaggaaactcacaaaaaaaaaggccaaancggaaggggaatcacaatgggg

SEQ ID NO: 631705 - DNA, 214 bp, Homo sapiens
aaacgcagtgcacctgaatgcctgatagtcgtctctagagtatcaccttccaggcttatagcgggtcacagcgatctctatcgatagtcagctaaattagaattgtgaacgatataagtgtaacgtgaaggttactgtttgatattgctatcggtggcgcttccaattacggtgcataatctcggtagcctgcaatcaagcctggtacaggggc

SEQ ID NO: 631706 - DNA, 1414 bp, Homo sapiens
tctgtggtatgatgagttgttgtatccataagttttagtatgtcgtccactgtggggtggaccgtgtgctgctctcctcttctgtggggcgtattttctggatcttcggagctatttcgcggggtgttgttcctgtgtcccgcccctccgcagtgtttacaccgtgttgtggccgaggtagcttgtcttctgcagcaccccacacaccccttgggggcacgtgcgattgtgccctttcattggggggcacatctggtgctattgttttgggaccatttggctctccccggaccgtttgacctttgcgtgttctctcttagccttttcgccgtagctttatttgcgcgtgcggttgggccccgggtttgtgtgcgccgccctttccacacgcgttttgtctttgggcgcttttttgcgcgggggcgcccgcccacaaaagggggaggccgctcgggccacggggggtttcccacgagccgcgacaccctgtgggtggcgcctgacacccctgcggacaggtaccagcgttgccccaccgtggggcgcaccccttaatgtgccaccccaacgtccacgtccttttggccacggaaaatatggccgtattttctctcccgatggccacacctgttccgggttgggcaaagaagagttcaccccccaatgggccctgcgtttttgaggactctgtccccaaaccccaagataggttttaaaaagtgttgtgattaccccccgggccccccggcacaggtgaccactatgcgcctatgctttgcgctctgcctgtgtgaacccgctgtggagaaaatattgggtgggccccccaaagggagattcccaaacggcgtgggcccaatttgggcccgcccccttcacaggacccacatgcccgcacggcctttccacgtgttttgtggaaccttggtggccccccccaccgggcttttcacaaggttttggtgagtcacacgctatccccgccctttccccccctctgttggtgcgccctctggggggttaccctcgggccacaaggtgtgcaacagcgtgtgcccgtgtgtgggcacttgtctttgaggcgcaacaccggcccccccactttctccccgaagggctctcggggccccccttgggagccaccacaatttccgacccttgattgtatatgccacaagagggcctttgtgcacactggtaatgtgggtgaagggcactggaaggagggtgagtttctccgaaggcccgctgaggaatattggctgcccctggaagaaaggaattatatgaaggaaggtgggcactcgaactcctatatgaaggaacgaggatgagggagaagaatataaccccctgcctggagcctattcactatgtttattgccaaatcctttcgaaattaaccgtttccttg

SEQ ID NO: 631707 - DNA, 444 bp, Homo sapiens
ccttaagagcaaccacatgttgcagaattcagtcaatttgaagcatttgctgcgtcaaaggtaaacgacgaacaagatatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacacacacaaaagacgggtgtcttagctgctgttcttgcatcacaaccttctattcccaggatgttcttgaggagagaatttccctggaagttcaactggaacaacttcgaccattctctcacctataagccaattgccgttaactgtg

SEQ ID NO: 631708 - DNA, 153 bp, Homo sapiens
  misc_feature (22)..(22): n is a, c, g, or t
tttttttttgagacttactcgnctctgtcgcccaggccggactgcggactgcagtggcgcaatctcggctcactgcaagctctgcttcccgggttcacgccattctcctgcctcagccccaaatataatttttaaaaaattatttggccatag

SEQ ID NO: 631709 - DNA, 1371 bp, Homo sapiens
tggaaaaattcatggagcccagtggggttgtggctttaaaaccagctttgggggggtttcaattttcttctccttttttgtgttcataaatttaattgttatctacgggtttcttcaaatgtgttggtggataggggtgggggcgcatctccatattagttcacctccaggtttatatgtgggagggttccttctcatactatattatgaggaactttcgcgcctttcgaaagccgaagagagcttatcctcaaatctccgtgacacaaatcttatttaaatattacacgtggcgtgtttagaagaaaaagtgaatgtgaacccatacgaggactgtaataggaattgtgttcacagtggtgggtgtattgtgcatatgcgggggttaagctcgcgaagataaagcgtgtgcgaggggacatatatccgagaaatagaggcgcaaaaaaagaggttgtggtctgcacctgacaattttgattgggcccccatagaaatataagagagagagagacacaccccgagactaagggtgcgataagaggagagaaacaattgggggtgaagcgggaagcaacgagagaaagagaaccccgggggagaggaacgcaaggtacccctggaaaaaggggggaccggcctaagcacacgggcaacccccctggctccccgtagacccgcaggcccctacaacaataataagccaagagcgccgaagccaggagacaaactagcgaaaaaaaaggggggaggcaaacagaactttcaagaaagaaaatagtgtaggaaaaaacaaccaggacaaaaaacgcccaaataacccgggggggggacccacgcgataataatcaaggggggggaaaacagcaggcaacagaagagacaaaaagagccccccccaaacagaaaaagagaggggcgattcagcctcgtaggagcaggaaactacataccacaaaccgcatgtgcccagggaaagacaaaaagagtggagacaaaagcggtggagaaaccaaaaaaaggggtagacagaggagcgccccaccatcaagcacacaacaagggagaggactaaagagggagccagtgacgggcagagacaagtcgcgagcacaaaacacgacactcccgcacaggcagaacgggggagggggaagaagagacaaggccgccggcccaggctgacacaccatcgagaagaaggtgggcgaccaagaagacgtgcgagcccagctcatagaagagtagagggccggcgcagacctagggagaaaaagaggagagcaacgacgcacgaggaaggacgaaagaggaggaagagagagaaagaactgggaggagcaaaaggaagtgacgggcagagggcgccgg

SEQ ID NO: 631710 - DNA, 883 bp, Homo sapiens
  misc_feature (524)..(524): n is a, c, g, or t
  misc_feature (883)..(883): n is a, c, g, or t
gatctcagttgccttccctttgaacaggattcctggagggaaattgcatacatgaacggaaccggactcttacttaatagtgaattcaagacattgaacatgtcccaggtggcattttttcccttgaggatgtgaaacatttaaattagccatgtttaagtaagcaccgttgctgtcaatcacaaatgcaaacctggacttggagtagaaacaaaacaaagacttttattctgcttttccaataaaatggcttcttactataaagccataataaatacctactgtttcattttttagtaagagtattagagcaattgtctgtaccatcactgctgttggttggtaggagatatgggccagaaagagatcatataagtgaggggttacaggctcattggccaacccaacccccaattgaagatgtgatggtcctatgataacgggctttaattggctgcttaaaatgacaagtaagtttcgggttggtaggtagtagtttttgagacagactctcgctctgtcanccaggctgcagtggtgtggtctcggctcactgcaacgtctgctttcctgggttcaagtgattctcgtgtctcagccttctgagtagctggggactacgggcgcacaacacataacagctatttttttgatttagaaaaaggaggtcccatggggagtagattcggaaccggaccgcggataaccgccggacatgggggcacgggggggaacatgaggcgatcgaaacacggcacggggaacccgttctaaacaaaaaccgggggggcgcggcaccccgaagggggaaaaaccgcgaggaggcgaggacaccacacgggagcacaaaaaaaggccgcgatcgcagagatgtaaacagcan

SEQ ID NO: 631711 - DNA, 115 bp, Homo sapiens
  misc_feature (5)..(5): n is a, c, g, or t
cccgntcaattgcagcatgccgggggcaataggattcatgtgcattcaggcagtcagggttaggcatgcagatgggcaagcaagcacagcagcaggcacagtcaaagtttcaatt

SEQ ID NO: 631712 - DNA, 119 bp, Homo sapiens
gctctgagtcctatggaaacaattgcagcagccggagacgaaagggccaggaacgcttcaacctgctggttctgacgggcatgactgtggccggcgtgttctgctgggctcactcttca

SEQ ID NO: 631713 - DNA, 374 bp, Homo sapiens
cgagtcgatcccccggggcagaccgaggaagtgcaagccatcttctgcattactgacacgggtgcagatccggtaatgctcgagacccttgatgtgaaaaagacccagttcagagggctgatcgagctggacgaggacgactacgacgaagacgtcagcgaccaatacaacgagctcgaacctgtgatgacccctgatcgctatgcgctgatccagcgcatagcagcgaattacctggcccaggtcggccaggacgacaggaggactgcatgaatccgcgcgaagagctagttgctcatcaggccgctgtggaggccaagtatgcgtcggtgcgtcagcgtcatctcgacggcttggctcgggaggccggcttc

SEQ ID NO: 631714 - DNA, 416 bp, Homo sapiens
ttgagtgttttttgtgttttttttcccaaggatgccgggcacggccggttctaatcagtttctataacttcgggtcaaggaaccaatgggattcttcccacttggccctgcctcgtggggcttattttctaaccatacttccattttcatacccaatgaaaagaaactcaattccaaaggatctcacctttcacaaaattctccccttaagtaccctaaagcagtcctatatcatcgggtgccgcaagaatttgggggcagtcacaagtttctaacagcaaggcagagtcttaaaagcaatgtggagatatataatcggtgtccagatgccccctcatcgggggtgggtcaaagctgtcatgaggcggtgtgcctgtgtggaagggagatgcccgaacctggtggccaaactgtct

SEQ ID NO: 631715 - DNA, 751 bp, Homo sapiens
agcggagtcagaatacttgataatgatggtaaacaactatgtactggttatttattagattatacttaattgtatattggagtgttaataacttattaaagagagaaaaaagaaaaagttaactgtaaaacagcttcaggaggataccagaaggagacactgctatcatagagatgatagctccatgcatgttatatgcccctgaagaccctccagtggaacaagatgtggagatggcaagacagtgacattgaggatcctgaccctgtgtagacctaggctcattgtatgtggatcttaatttttaacaaacaaagtgaaaaggtaaaaaaccaaatagaaactagtttatagcacataatgatataaagaaacagctttgtaccagatgtacaatgtgttgtattttaagctaagtgttattacaagagtcaaaagtggaacaattttaaaagtttataacgtcaaacaagttacagtaagttaaacattactttattatcacacagaaagacattttaaaatagattatagtgttgcctaagtatccaggtttatgaagtactacagcggtgtaccactaatgtcctagggcttcgcattcagtcctcactcaatgactacacccagagcaactttcaatcctagcagctcccatgcatagtaagtgcccctataccaggaggctcctattgacaacaagaatcattcatacccatatataaactactcaccaaactgtaagcatacc

SEQ ID NO: 631716 - DNA, 811 bp, Homo sapiens
ggtgatgtctatcccatcgttcggagttgttgctgtctctcactctctctctcgtgtgtttgatcaaattattttgtgagtgtcccacctcgcactctactctccgtccgcgtcgaggctgacatcccttaccacacttcgcgtgccgcgcagctcgctgctcgcaccaacacggtgagacagcgacacaccaactcgcgcgatgtcgttgtcgtatgtcttcgcgtcttctcgtcgtagagaacacgacactctcgcttcgcgcgcgttggtgatggagagcagagcgcgggggtcgcgcagctcacactcgcgcgcgagcgcgagtcgtggagcggacgacgcgacgcctgggtcgctcgctcgtgcgcacacacgcgcggcgcgagagcgagacccacacacacacgatgtcgtagtggtgtgtgtgtgtgagagtatgtgtttgggtctgtttcgttaacatccactcccgccgaaggaacaaacgatcatatctgtatatatactattagaaacacacacaagacagattatgattctccacaccacacgcacgcgcgcgagagagagattctctcttcctcgtacgtacacacacacaaacagatccagactcacctcactgcgtgatggagatgatctctctctctccatctacttctttatgtgtcgatagggccaccaaccaacacatcaccccagcgtgtgttgtttgtgtgtgtgatactacccctccctcgcacacaatcaaaacacatccaggtgggccacgccacaacacaaataataaagataataaatataaata

SEQ ID NO: 631717 - DNA, 343 bp, Homo sapiens
cctcctgaagagagcctcatcaggctgggagagcagactgcacccaggaaactggagcccagcacagtgtgggacagggtcaaggttgagaaatacaacagaggaaaactgcagaagctcagaggaggaaggatccacacctggctggggaagggaggtacggggagcagatagcaagaatgactggcaaacgcttcctgaaggcagtgggggtggggggctcgatgatgaagtaggcaaatgtgggggctccccctctccagtggccgggggacccaagtgtagccaggtccaggcccggctggccaggcgtctcgttgcaaacacagaaccaggtctggta

SEQ ID NO: 631718 - DNA, 1691 bp, Homo sapiens
  misc_feature (770)..(770): n is a, c, g, or t
  misc_feature (778)..(778): n is a, c, g, or t
  misc_feature (790)..(790): n is a, c, g, or t
  misc_feature (792)..(792): n is a, c, g, or t
  misc_feature (801)..(802): n is a, c, g, or t
  misc_feature (806)..(806): n is a, c, g, or t
  misc_feature (813)..(813): n is a, c, g, or t
  misc_feature (828)..(828): n is a, c, g, or t
  misc_feature (834)..(834): n is a, c, g, or t
  misc_feature (994)..(994): n is a, c, g, or t
  misc_feature (1033)..(1033): n is a, c, g, or t
  misc_feature (1090)..(1090): n is a, c, g, or t
  misc_feature (1101)..(1101): n is a, c, g, or t
  misc_feature (1114)..(1115): n is a, c, g, or t
  misc_feature (1120)..(1120): n is a, c, g, or t
  misc_feature (1202)..(1202): n is a, c, g, or t
  misc_feature (1209)..(1209): n is a, c, g, or t
  misc_feature (1233)..(1233): n is a, c, g, or t
  misc_feature (1237)..(1237): n is a, c, g, or t
  misc_feature (1239)..(1239): n is a, c, g, or t
  misc_feature (1247)..(1247): n is a, c, g, or t
  misc_feature (1250)..(1250): n is a, c, g, or t
  misc_feature (1275)..(1275): n is a, c, g, or t
  misc_feature (1285)..(1286): n is a, c, g, or t
  misc_feature (1302)..(1302): n is a, c, g, or t
  misc_feature (1310)..(1310): n is a, c, g, or t
  misc_feature (1326)..(1326): n is a, c, g, or t
  misc_feature (1335)..(1335): n is a, c, g, or t
  misc_feature (1346)..(1346): n is a, c, g, or t
  misc_feature (1367)..(1367): n is a, c, g, or t
  misc_feature (1381)..(1381): n is a, c, g, or t
  misc_feature (1391)..(1391): n is a, c, g, or t
  misc_feature (1396)..(1396): n is a, c, g, or t
  misc_feature (1401)..(1401): n is a, c, g, or t
  misc_feature (1422)..(1422): n is a, c, g, or t
  misc_feature (1438)..(1438): n is a, c, g, or t
  misc_feature (1443)..(1443): n is a, c, g, or t
  misc_feature (1464)..(1464): n is a, c, g, or t
  misc_feature (1466)..(1466): n is a, c, g, or t
  misc_feature (1484)..(1484): n is a, c, g, or t
  misc_feature (1492)..(1492): n is a, c, g, or t
  misc_feature (1507)..(1507): n is a, c, g, or t
  misc_feature (1535)..(1535): n is a, c, g, or t
gccatgacttctcctccccccgtcagttcttcaatcactcccaccaatacaatgacttctatgagaactacaacctattggcccacagccactaatacattatcaccactcaccagtagcattttatcttctacacctgtcccaagcacagaaatgatcaccagtcataccacaaacaccacccctctatccaccttggtgactacactcctcactaccatcaccagatctacacctacatctgagaccacctaccctacttctcccaccagcattgtctcagactccacgactgaaatcacctattccacaagtataacaggtacattgtccactgccactactctcccacccacctcttcctctctcccaaccacagaaacagccacgatgactcctaccacaaccttgataaccaccacccctaataccacctcccatagtacccccagcttcacttcttcaaccatctactccacagtcagcacatccacaactgccatctcctcagcttcccctacctcaggtaccatggtaacttccacaaccatgaccccatcttctctgagtacagacacccctttcacaacaccaacaactatcacctacccttctgtgggctctaccggtttcctgactacagcaacagacctcacatcaacattcactgtttccagttcctcagcaatgtctacaagtgacatcccatcttcccctagcatccagaatacagaaacctcatcccttgtcagcatgacctctgccaccantcccagtntgagaccaactntnacaagtacnnacancactctnacaagttccctcctnacgacnttcccaagtacatattcattttcatcttccatgtctgccagcagtgcagggaccactcacacagagactatttcctcacttccagccagcaccaatacaatccacacaacagctgaatccgccctggcacccactaccaccacctcattcaccacatccncaacgatggaaccaccttcaaccactgtagcgactacangcacaggtcagaccaccttccccagctctacagccacattccttgagaccaccacantgactcctacnactgacttttctnnagaanctctcacaacagccatgacttctactccccccatcacttcttcaatcactcccaccaatacagtgacttctatgagaactangacctcntggcccacagccactaatacgttntcancnctcaccantancattttatcttctacacctgtcccnagcacagagnngaccaccagtcatacnacaaacancaatcctgtatccacnttggtgacnacactccccantaccatcaccaggtctacacntacatctgagaccncctaccctanttctnccacnagcactgtcacagagtccacnactgaaatcacctatnccacnactatgacagagacatcatcnantgccacctctcttccacncacctctnccttggtctcaaccncagaaacagccaaaactcctaccacaancttggtaaccaccaccaccaagaccacctcacatagtaccaccagcttcacttcttcaaccgtctactccacagccagcacacacaccactgccatcacttcagttcccactaccttgggtaccatggtgacttctacatccaggatcccatctag

SEQ ID NO: 631719 - DNA, 744 bp, Homo sapiens
gccatgacttctcctccccccgtcagttcttcaatcactcccaccaatacaatgacttctatgagaactacaacctattggcccacagccactaatacattatcaccactcaccagtagcattttatcttctacacctgtcccaagcacagaaatgatcaccagtcataccacaaacaccacccctctatccaccttggtgactacactcctcactaccatcaccagatctacacctacatctgagaccacctaccctacttctcccaccagcattgtctcagactccacgactgaaatcacctattccacaagtataacaggtacattgtccactgccactactctcccacccacctcttcctctctcccaaccacagaaacagccacgatgactcctaccacaaccttgataaccaccacccctaataccacctcccatagtacccccagcttcacttcttcaaccatctactccacagtcagcacatccacaactgccatctcctcagcttcccctacctcaggtaccatggtaacttccacaaccatgaccccatcttctctgagtacagacacccctttcacaaacaggaaagagataagataacgttctgtgggttgtgccggtttccagactatagcgacagaccgcagatctaaattcacggttgccagctgatgtagcaatgaccacagaatgtacagttcatgtatctccgcagcatgcagaataatggaacga

SEQ ID NO: 631720 - DNA, 416 bp, Homo sapiens
ctgctcttttgtactgccccccgactcattaaacagctcccccaggcctgagtgcactgatgtccgcagcgctgccctactgtgtcagtgtgtgtgggagtgccagtgcacagcaccatcccccagtttgggccgactggggagtggcctggggccacgacatgtgagaacacctgtggcgaggcctgtaccaagaatgtgctgtaccctttggagactggccctcgtggacacggaccacgacccctcaaccaagctcaagtctagcagagggagacatcatgaagtactctagtgatacgtggacagcaggaaacgacacaacgactaccgaacaactcacttcgttgcgacgtccacgataataccacccacacagatataatgacgaactccgtcgcaccgagcaccagggc

SEQ ID NO: 631721 - DNA, 552 bp, Homo sapiens
ggttcctgacgacggaaagtgtgccctgcttggagcccgagctttctttctaccctcttttaaaggggggggggtacactccctcatgaaagggtgtagaaacccgggacaacaaacgctccgggggaagacacagggcggccaaaacccccctctgctcacgcggagataaccgccgcgtcagccgaccccgaatggctgcgccccccctgggagactactggtaacctgtgcttttcgatagaaagccctttgtgaccgaggttaaaacaagatcatttctaaggatacatattttacctcacagagagagacgatgatgaagagcctagtattacaattacgccccccatctatcccctgatgatacagcattatgcccgcagcacaaaatcactcactgtatatgcctttttcccaacagagttgcctgattagccaacacccaaacagaaattttcagactctcacgagcatgaatcgccatgtgaaccgctctatcattagtttttggggagccctcaataaaaaattctaatcctgtccaacaaa

SEQ ID NO: 631722 - DNA, 867 bp, Homo sapiens
gttatgataatgcagagagcaggttcggaaagcttgtgtcttctgcctggtggcggtacatgcggtaagtggtgatgaattaaatccacgtctcagtcaacttactgggctggaaccatgaggctactgattttttactttatacgtgcggattgatagggttctggaggagcgtgatccctctactgggtgtttctggacaaagattagtgaagactcagtctaggagtgaactcagagtgtttcgaaattagcaaaggacaagatgagatgctatgcctcatgtaatgaggtaggaagttgtctaacacatcctttggaacttactatgtttcccagttttagtttttgttcgtgtgcgttgtggtattgttctgtaacagaggactatcctcagtctgcatgtaacttttatgatagttattccaaattcaagaagaagcagtattaacatcaagttgatcgacacaaagtgaatttttaatgtaattcatcatttcacatgtttgtactttgtcttcccattaagctttgccagtgttggtgattgttagatttttttacatgctggttaaagaggaatgcttaagctttaaaagttagcagtctaagacatttgcttggatcaaggtgacgaataatatgttatgggtacttgagtctgcccgggatcagtctatgtcgacatatttggtggggtgacacgcggggctatttgacacagagggtccgttggggggggatacacggataagggacctgggcgggaagttggaaagaaccccggggggtgaaaacctttggaggatgtttggggcgcgtataaagctttatttcaagggacgggttgttttaaaaagggtgtgt

SEQ ID NO: 631723 - DNA, 132 bp, Homo sapiens
ttgtgtcttgtgtgtgtgtgctgttgtctgtgtggggtgtgttgcgtgtggggctcctctcacgtcgcctgccggactccgcttggcctggcgtcgtttaccccgtcgtgcctgggccccacggtctgcccc

SEQ ID NO: 631724 - DNA, 286 bp, Homo sapiens
cgtgggatgggaaacgacgacagtaacttttcccccctgtagaaccgataggcgttttcacctggaatgtcctttttaactgattgatgcctggccccaacgcccccaaccaagtctgaacctgagcaataccaggcacagagaggtgtctacttgtaaccccaacacttgacaaaaaacaaaactgaagctgtgattggtttaggcagcaagtggccaggtgcaacttgtgtgtttataattttgttttccccaacagtaatgagatcacttacacttttgggga

SEQ ID NO: 631725 - DNA, 461 bp, Homo sapiens
tctggtctacaggtttgagccactccctggggcctgtgcagatggagggagagagggcgcacatcagtgttgactctgagctacagaagcttccatcaggttcttccagcaaagaggcaaaggcccagggttgacttttaaaatcagaactactcagttcttttttaaagcaaatttttccatcttaaacatcaatgtgatgcttcttacagtataatgctaaaacacttttgaaaaaaaaatcattatctgaaaagccagaattagaagttagcgtttcagtttttgaaaaacggaaaaaaatggttaaattcacaagaagctaacaatgaaagtgcctgatacaaataaatgagaaaagccaacatcacagactgtaaaaacaatgacttcgggaggtcgaggtcacttgaggtcaggggttggagaccagcctgagcaacatagcaaaaccctagctc

SEQ ID NO: 631726 - DNA, 901 bp, Homo sapiens
ctcttgtatggagtaaacactacgggggaaaacccgtccaccaaaactatgtatgatatttctccctctctctgcttagaataatgtgtgtttggtatgcgtgttgtggcttttgagacagcgtctcactgtgtgccgcaatctggagcgcagcaatcttggctcactgcaacctctgcctcctgggctcgagcagtcctcccacctcagcctcccgagtagctggggctacagctgctcgccaccatgctcagtttaatattttaaggtttggtagagacgaagtctcactatatgtgcccaggcgtgatctcgtcaactccgtgggctcaagcgatcctgctacctcatcctcccaaagtgctgggatttacaggcatgagccaccacaccagactctaaaatgattttatacaagtggacttcatctcttcccttggtatctgtaaaaattacaagcatacggaaaattggccccattttcttgtctctctctctctctcgttcttgtgcttattggtagtagtgtactgttggttcatctgtatcatctgagaggaagtcgcaatcagtgagcatttggccccgtaaaatacttcagccctatatctctttacaaggacattctcctttatgatcgtgatacaatcatactgggatcgaaccttaaaacagtatcaaggttcatatacagaccacattcagatttccccagtgtctcaattctgtcatttcaggatagccagttacaaaacaactccggggtccaatcgaggatctgcactggtactgcgactgtcttgtgaatatcttattcccagcagccatttcactcagggtttagaatcccttgacgactccttatcacgagcttactggcctacaaacgcggcatcatacc

SEQ ID NO: 631727 - DNA, 718 bp, Homo sapiens
gctgtcaggatgtagtgttagctgtccagcaagtcatggtcctgcatgtgaggaagagacctaagagtgttgagtgtgtgtccacactacccgtgcatgcctgggtacctgtgcgacactatggatgctcctgacacacctgtgtacaactgcacgcctgtgtatggccatgcatgctataccccatgtaaccgtgcgtggctgtgcatcactcgggatctggcagtggggcagtccaggcataacaagactcctgaagaactccttattgggaggaattgtgtccattccgtggtgacaagtgaaggcatgcatattgctcaatcgcacagagtctaggtgtatagaatggtcaagatttttacttggccatgtactggagatcgccgttctacatcgactacagcaaattacaagaaccgagtgcccacccggttgcgtcgcgagtcctgatggctagtgtgctgtgtaggctgtgctggtgcgtcagccatggttagctgctcctgagtcgcactttgtccctccacgagtaacgaatgactctggggttgatgtgggcggactctcaggggtggctagtagattgaccaccaggagcttgctgtgcaccctcgtggactgctttgttcatccgctgggcggtctgtgggcaccccgggggttccccttcagtcatcaaacggatgggtcccggatatggggttgtcctaggaca

SEQ ID NO: 631728 - DNA, 90 bp, Homo sapiens
cacgagatctactatgcatcattgtctgactatagttaataacactgtatattttaaaattgcaaagagattgcaaatggtctcaccacc

SEQ ID NO: 631729 - DNA, 290 bp, Homo sapiens
  misc_feature (73)..(73): n is a, c, g, or t
ggtatctagagatcccctccatatgtgtgccagaaatatcagaatgtccttgaacaggatattgtgatgtgtngttctttgttactcatttctgtatgcataatgagatggttggtcagagaggggaaggaagtattaaagaatgttatggggaaaaagcaaagtacaacaggaagaacacttgggggaactaatagaatctaaggactcaaggatgggctccttggaggaaataccagcttagaacaaagggagaggaaatgagaaggtgattgtgattggcggtggga

SEQ ID NO: 631730 - DNA, 171 bp, Homo sapiens
tatgttgggccatcagtaattcgtgttcttactcaagtcagcccgtcgatggtctctgctacgcccctacctgatgcaaggagagcccgtgacgagggctgcctggagtgctgtaggagaataaaataagacaagtaagacaagcgagaggggtggcatgggaccgacgta

SEQ ID NO: 631731 - DNA, 384 bp, Homo sapiens
  misc_feature (23)..(23): n is a, c, g, or t
  misc_feature (112)..(112): n is a, c, g, or t
  misc_feature (245)..(245): n is a, c, g, or t
  misc_feature (248)..(248): n is a, c, g, or t
aagcccgaatgtcaccccgagantatcaaatcattggtggtcgagaagctgaactgttcagcggagaaagggcgagtcagcgcttcgggcgctagacgcaagctggcagcancaggatcaggcatcgggcttccttacatcaggcggggcagatggggcattctggctcccggttgagcgctctggcaaggcgcgctttcgggaaagcatagccaccgcacgcgtcctgcaaaaaaatcgcccgncantgaatgtttataaaaaaacacggaaccctgggaacgtgcctaaactccaaactgcgcgggttggactaataactggcccctagggtgcgttgagcacctgaacccttgtccattggtttgcacacaaagagaacaa

SEQ ID NO: 631732 - DNA, 161 bp, Homo sapiens
attaactatacaatgagagctcacacattcaaggatgtactaagcactacaggctcacagaacagagatcccatctttgagttttcagtaccccatgggggttaaagggttttgaccacgaatgccaaaccaccaccacgaggagatttttttccccttta

SEQ ID NO: 631733 - DNA, 661 bp, Homo sapiens
ggctgtgacttcacaccacacaaacaaaaaaagtgtctgggtcgaacgtttcagcatgccacagaccaaattgagtaaagaaatgtcgtactccagattaaaaaaaaaaccttacatgaatcagatgagtgtaaaaatacagaattaccattaacatggtgtacctccacagctcaacatcctgtggggcttcatacacgccatcctcagttagacaagggccatgaattcgactgatccctgacggaagaactcccgtagacacagagacccttattaaaacgactggaatagtagactgatcatcaatcttagagagaacaccaaagaagtacacaagacagaaatgacagaaaccacccgacaggaaccaagcataccaaggcaacacaggactgctggcccatgaaagaggaccccgtgatacaaagtacaccagggtcacgagccaacagattcagatctactaacgaagaaaagcttcaagggccacagaaggacgaacatcctagggcgacaccaaggttccagtccccttctatggcaaaccaggtggactacggacgatggtcacccagatacagggacgtttggcaaggcatcataacaaccaacttgacttgtgggatgcccccccttttcaaaccaagcagcagtaaca

SEQ ID NO: 631734 - DNA, 618 bp, Homo sapiens
gcccggaagcacccgcctcccggcatggtgctcaaggccttcttccccacgtgctgcgtctcggctggacagctgggctgctggtgggacggtgggtgccggagcatgagcagcgccgtggtcctggctggtcctgcactttcccttcatccccatccatggtcaatgcagctcctggcccaggtgcggcaggccatgccaggtgggctgtggccgtgctgggcacctggtgccactgccggcaggagcccgaggagagcctgggcctgttcctgggagatgcctggtgtgcgtgtacttcaccccattgagcccatggctagctggcttgtgcctgggatgatgatggctggcactgttctaggatgctgcgaggccacccacctggcaagctgcccacttgacccctggttgcccctggtgaggaccaggtcatgctcatcttctatgaccagcgccaggtgttgcttgtcacagctacaactgccacctgtcctgccacgacctgcaggctggagccaccactgacagcactggggggcctggcttgcctgtcttcgacacggtagcacgcagtgaggtgctcttcctgcagtgaccgctttgatgagggcccga

SEQ ID NO: 631735 - DNA, 173 bp, Homo sapiens
  misc_feature (117)..(117): n is a, c, g, or t
ggagtagtccaatgcagacatacattcactatggtcggtttcaggaattccaaagaaatctgacgtcaatgcgatatccattatatacaagctataaaaatagaaacaggcatcatntccaaggataacagtatcaattcttttgaagaaattggttttaacggaaacttcgg

SEQ ID NO: 631736 - DNA, 222 bp, Homo sapiens
cacgaggggcaatgctccttcctgcgcgctgcactcaccggccccgactccgcggatctcgcccgagagaggatgggatttgaatctaccgcggactgcatcccggagtgtctatacctcaaccacggcatggagctctcctgcaccggttcgcggtgaccggtgcaagagcatagtgcccgctgtgagccgcaaagcacctgtaccgcccaggagctgcta

SEQ ID NO: 631737 - DNA, 126 bp, Homo sapiens
cgatggctcgagtaagcacagcaacatagtgtaacttcatgcttcttcaaagaagatgatcagtaactcccaggaaacatgcgccacggtcccgcgaagtcgcccacccctagatccccgcgtcat

SEQ ID NO: 631738 - DNA, 189 bp, Homo sapiens
tctggccttctcatgacctctgctggatcctcctctcctctcctgatcgatgccttccacgctctgacctctcactgttgatgccggacctgtggatctccgtgggactccgagcaacggcctgaacgagagagggctgaaaggctgcatggggcatgccacctcgctattcccgataagatgtaactc

SEQ ID NO: 631739 - DNA, 192 bp, Homo sapiens
atcgagatcaagtacggaagcaatgagatcacggtacgcaccatagaatccagtccggccttgctcaataggttaaggatctggcattgctgagagctgtggtataggttgcagacgcagctcagatcccgtgtgctgtggctctggcgtaggctggcggctacagctccgattagacccctagcctgggaa

SEQ ID NO: 631740 - DNA, 264 bp, Homo sapiens
agaaaaaaccaattttttattatgatggttctccatatttggcattgctgtaaatggctaacatttactgccaattcgggtcaaatggggggtttggtaatccccgaacccccaatttaaatgaaaaaataaaagttaaacctttccacccaagggtttacagtttgacctttcactgggtaggtaaaaaaacactttttttttaactaccgattattattccccctgaataaaaaactccaacttttatttttaaacaggagt

SEQ ID NO: 631741 - DNA, 406 bp, Homo sapiens
  misc_feature (7)..(7): n is a, c, g, or t
aagcaancaagttagaacttagaataaaatttagacaactgtataactagaataaccaatacagagaagagcttaaaggagctgatggagctgaaaccaaggcttgagaactacgtgaagaatgcagaagcctcaggagccgatgcgatcaactggaagaaagggtatcagtgatggaagatgaaatgaagcgagaagggaagtttagagaaaaaagagtaaaaagaaacgaacaaagcctccgagaaatatgagattatgtgaaaagaccaaatctatgtctcactggtgtatctgaaagtgacagggagaatggaaccaagttggaaaacactctgcaggatataatccaggagaacttccccaatctagcaaggcaggccaacattcacattcaggaaatcca

SEQ ID NO: 631742 - DNA, 287 bp, Homo sapiens
gcagaaaggatgctatagaaaattttataagtcgggcgtggtggctcacgcctgtaatcccagcactttgcggggctgaggtgggcagatcacctgaggttaggagttcaagaagagccagaccaacacggtgaagcccagtctctactaaaaatactaaaattagccagcatggtggtgcaggtctgtaatcccagctactcgggaggctggggcaggagaactgcttgaacccaggaggcagagtgtgcagtgagctgagatcttgggcatcctttgtggcagca

SEQ ID NO: 631743 - DNA, 115 bp, Homo sapiens
aattcagactactatcactacagaaatatgcagtcagtccacatttggggaaatcgcaggagtcagcacatccggagtgcaatggatagagctctcgccctggtggtatcagggc

SEQ ID NO: 631744 - DNA, 358 bp, Homo sapiens
ccagcgtagcaagctatcttgcgtgctcacttcaaggccgggacagtgtggccaaacagacggctatgtgctagaggggaaggagttggagttctatcttaggaaaatcaaagtccggaaaggcaaataaatcctcgttttgtcttcacccatgtaatgaaggtgtatattgttctgttcccaaaaaaaaacccaaaatacaaaaataacaaaaacaaaaaaaacaagtaaagccagtgaaattcacccaggaactcagcaaaaaagagccctgtataaggagaagcagcataaggaagaaagaaaattaaactcctaaattttactcaggtagaaagtttcatttaaacaatactga

SEQ ID NO: 631745 - DNA, 136 bp, Homo sapiens
agcggctctagaagcggaaatggcacactagacaacctaatgtgcctttgcctgagaggtaatgaccataaatgctcagagggcctcgatctgcaccatcagcatattgccctggcagctccctaggactggggct

SEQ ID NO: 631746 - DNA, 453 bp, Homo sapiens
  misc_feature (103)..(103): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (162)..(162): n is a, c, g, or t
  misc_feature (211)..(211): n is a, c, g, or t
  misc_feature (216)..(216): n is a, c, g, or t
gtgtgtggtccccagccccagactggattggaaaagtgtatggtgggggctttggggttgtccccatgttgtccttttgctataagtttgtggggcaagaggntgtaatattctgtattgggtgtttgggatgttaacttggcntgnttaggnttcccaccntgtgtggggcacacccccaggaagggaccctggacacggctcccatgtncaggnttaaggtggatgcacttcccgcacctccagtcttttgtgtagcagctttaacccaggtttgtctgtcacgtccagtcccgagacgggtgagtgaccccaagaaaggcttccccgacacccagacagaggttgcagggctgggggtgggtgagggtggcgggcctgcggggacattctactgtgctaaaaagccagtgcagacacagcaatatcaacatgtcattttccaaagcagaa

SEQ ID NO: 631747 - DNA, 894 bp, Homo sapiens
gagaaccgaggaccgacttcttgctctttaccctcatggcgcttctctcctgcaagtccgcctctgggccctgccgatctcttgagacttaaagtgcatcctaggggcattttaaaaatcatgtcaagctcagttgacccagaaaaagtgggcctacaaggacagcgcaattgtgcgcttggtgtaacgtcacatagagaccacgggatttgtggccagttcattattatctgaaacccaagaggtgtgcagcgcacccaataggtgcttgctcttttacatctgctttggtatcaatccacactctgatacatgacaagttctgtgggggatttctctatgtggacagtttggtcccaccggggcgcatcttttaccaaggagggcaccgaaacggctggactggtggtcctggcgtgcccaattgtggtccctggggatggacaaccaaatgtggtttggtggattggtgggacaaacacttgtgttccaccaggggcactattaacccagtaccaaattgttggcttttggcattggttttaacaggttccaaatttacagggagaggaaacctctttcacaagggaattcttaccattggtcctaatgggccgaaaaccacaagataatgttggctcattaactcccggcaggctggttttaacgacaggaacacgttttaatgtgaccatttgtagtggggcccctcaattcacctttaatggtctacacaaggcatgtcgccaaggggcagggccagaaacaacataatttaaaggggctgccagaagtaccacgggtcccaattctcccatggaccagattgtatgggagaagtctgtcctttgaggtaggttccacacagaaggcccttgtgacccaggccaatgg

SEQ ID NO: 631748 - DNA, 768 bp, Homo sapiens
caccttgcatgatcacgcgctcataatcattttccgttatctgcttcctactgctgtatggccctttgcctaacactcacaacaaaagctaagtaatacataacatctcagacgctcaggaaatagaaaccgtctgaagctatcctgcccgccatcatcctagtcctcatcgccctcccatccctacgtcatcctttactataagcagacagaggtctactcgagtgccctctcttactcatcgaagatcaagtgggcgcaccaagtggtactgatacctacgcagtacagcgcgactacggtggacgtaatcttacaagtgcctacatacttcccccaattattcctagaaccaggcgatctgcgactccttgaagtagactatcgagtagttactcccgatcgtaagtcccctcattcgatataagtgaagttgagcatgcacaagacggttctgtggcagctcatgaggctgttgcccaacattaggctttgagaagatcaggaatgcaattcccggagcgtctaagatccaagacccattttccagcgttacacgagccgggggtatactacggtcaatgctctgaaatctgtggagcagaaccacagttttcgatgccacaatccgtgcctaagaatgtagattcccctgaaaagatcttttggaaatggggcctcgtattttacctcttatagcgacccatctcttaaccccgtctaggagcccaaaataaaacaagccaagcggggccaatgccaaccaag

SEQ ID NO: 631749 - DNA, 499 bp, Homo sapiens
  misc_feature (79)..(79): n is a, c, g, or t
  misc_feature (146)..(146): n is a, c, g, or t
  misc_feature (187)..(187): n is a, c, g, or t
  misc_feature (243)..(244): n is a, c, g, or t
  misc_feature (255)..(255): n is a, c, g, or t
  misc_feature (275)..(275): n is a, c, g, or t
agtgtttgaaccccccagggttacctccttcattaaccagcaaaggatttgaagaggtttaatatctggaacaagttcntatctggctagcatgatggagttctggtttgctgaaaattttttaatgtcccaaaaccctccccccnggaagccagaatctttggtgtaactaccagagtttcttaanctaatacctgttaagaaataagggtatagtagggaggcatggtgctcaaactcttnngggaaaatccncagagatgtttgcaaccccntatgcctcgtgaacaacccccaagctgggaagtcctgaatcaaccctaagaggcccccagtgatgtgcacgaaaaatcttagggtgaaggtaaggggttcagtgggccagacccggtggctcacgcctgtaatcctagcatgttgggaggccgaggtgggtggatcacctgaggcctggagttagagaccagcctggccaacatggtgaaaccccttctctact

SEQ ID NO: 631750 - DNA, 169 bp, Homo sapiens
tcccactcgtcggtgtccgtgttgtacacctgtacgatgcccgtgacgttgttgagacgccagttgtagcccccgacgatgtagatcttcctctccagcaggcaggcccggcctctgactggccggcccgcatgggcgtcacactggtccactgtccgtctccggcaca

SEQ ID NO: 631751 - DNA, 206 bp, Homo sapiens
  misc_feature (34)..(34): n is a, c, g, or t
tgatcatgaactttcattcgcattttgttttttntttaattttattttgggtctttttttcttttaggccatgcccttggtatatggaggttcccaggctaggggtccaatcaaaactgtagctgtcggcctacatcacagccacagcaactcaggatctgagcctcatccgcagcctacaccacagatcacagcaatgccggatc

SEQ ID NO: 631752 - DNA, 190 bp, Homo sapiens
aggggtcttcaagagacactagggcttgatcgaggaggggccctggggctctgcaaatcctggccaaaccctaaggctaggctgtgactgtgtcccccggaacacaggaagacacacggagacctcagaatgctctgagcgttgagaaccaccgtggatacctttaatagggacgggggaagctagaggc

SEQ ID NO: 631753 - DNA, 433 bp, Homo sapiens
  misc_feature (423)..(423): n is a, c, g, or t
gacgccgagactggcaaaaccctgagcgtcggcgctggccaaggacgtcaccggcttcatcgtgaccaccatgacgttcgccgccaccatgagaaggcgaacccctcctccgccaagttggaccgcaacggcgtgccccgctccatttcgtcgctgctgtacgacctcggcgaggagatcgacaacgccctcgctctcgccgcgaaggcagtcgccggtcgggaagaggagggcaaggtcgcggaatactacaacgacctcaccacgccgccctacgatgactccgccgcgcccggtgaccagcccctcatcgtgctcaactcggtccccatcgatgtccgattcttccggaccgatctctccaaggcgaccaggcttgccaaccccttcaccccgacccgggattgctccgtctatcgcggngctggcttcg

SEQ ID NO: 631754 - DNA, 128 bp, Homo sapiens
taataaatgatacagcaaagagtcagcaaattatgacctatgggctaaatctggaaagggcctataagctaggaacggttagtaacatttgtgaaacgttgttaaaaaaatgtatatatatacatgta

SEQ ID NO: 631755 - DNA, 1398 bp, Homo sapiens
tctgcaagagaaaaagaagagacacccacaagggggggggtcccaccaacgcgcccccccccccctgcggtgtgtgaaaaaccctctcttcgcgtcggcagaagaaactgtgcgggagaaactcccctcccccctcggtggggagcaccccaccccacaaaaagggggggcccactacgcgcgcgcaacacaaccgccgtaataaagttctccggcagggggcgtccctccaaccaaggggccccccgctgtgtggggcaccacacagtgctgtcaagaggtgggcggccgccacaagacgacgcgtgctctccacacatgggaatgagagggtgagcgtgcgtcccccccccatcggggggggaccccaccacccacaacggtcgtctgagtcttgcgtgtgtgttggagtagacccccccccccctctggtgcgcccaccaagtcgtgtctcgttgtgcgccccccccacacaagagtgtgtgttgtgttatatgatgtgtgcgcccccccctcgtgtggcaccaccgtgtgcgctcttgtgtggtggccccccctcgtgagaggggcgcccgacccgagaggggggtgtcgtcgcgtctctcacagagagagtgtgcggggggcgacacaaataagaccgtcgtcctccgggcgcacaacaccctcgcaacacacacacgtgggtgggcgccccacccgtctcggacaggagtggagagagcgcgctgtgtcggcgtgcaccacaacgcggaggacacacacgcgcgagagagggggcgcaccacacacacgcgggctcccagcagcgtgtcacacagttgtgggctgtgtccacacccgccacaggcgcccactctctgggggcgctctctgctccactcgcgcgcccgcggaaacacccccccggggggggcgcgcacacactgtgtggaaagagcgcggcgccaccgcacacacacaagagaacgccccacagagggcgcgccgccccccgcgcgcacacacggtggggcgacacacacagagtatagagatagaactcgcaaaatgtgttgagaaagaggcgtgtgggacaccccccccacgaatcccacagcgagggccccacacgggaaacgcgcgcgggtgtgtgaataaaagagagaggagagtgtgccacaaacacacccgcgcgccccaccacagaaaactgtgtggaaagggccccggcccccgcggaacacacaccccgcggaggagagacccccgaacacccggcgggggggtgaggggaaaaacgcggggagagggagagggggccccccgcctcccccgcggtgtgagaaaaaacccacaaggcacaaagggggcccccccggggggggggcccaaaaaaaaccggggccccccccccca

SEQ ID NO: 631756 - DNA, 202 bp, Homo sapiens
gagaaataaggctgttggagagaaagtagtaagagatgcatttccggaggccattatcgtaaagccgtcggacatctttggaggagaggatagattccttaatcttttgcagtatgcatcggtttggtcctatacccttggtccttggctggagacagttaacaccagtatatgcgtgatgatcaagaattgtaatgcagta

SEQ ID NO: 631757 - DNA, 329 bp, Homo sapiens
  misc_feature (5)..(5): n is a, c, g, or t
  misc_feature (11)..(11): n is a, c, g, or t
  misc_feature (47)..(47): n is a, c, g, or t
  misc_feature (125)..(125): n is a, c, g, or t
  misc_feature (167)..(167): n is a, c, g, or t
ccagncatttncagttgggaaagtccagtgaagagatggttcaccgntggagcatctattcgtgacttcataaatcagtactccatacagagacttcaaatcaagtgtttgggtgtcattcttanatatgaaggtaatccaagaatcactaaacatttgatgaatgnctccaaaatggtaaggaaaacacatacttagaactaagagggacctggagaagtggagaccatgcaaggagaaggcaacttcaaaaaaaactataataggccaggcatggtggctaacacctgtaatctcagcactttgggaagctgaggtggggggatcac

SEQ ID NO: 631758 - DNA, 287 bp, Homo sapiens
  misc_feature (3)..(3): n is a, c, g, or t
cangtcggatgtggagtaagaggtaaactcgatggaaggagttaaaaacccagaatagggtgattggatgtgaaagcttccggggattggtcacggggataatcaatttaaaaccttcttcccattggctttcttttagcccaactaacgtaaggggaaaccgtcttgggatgtgttttgggtggcttttaatattttctaagtctcccggaatttactggaaatccttccggtaagtccattcaatccctttctccttcttacggttaattccacatccgtccggg

SEQ ID NO: 631759 - DNA, 270 bp, Homo sapiens
gaattccgcgtcgaccacgatcgagttcggcgtgaagccgttcagcagcgccgtggtgtagacatagggcttgaacgaggagccgggctggcgataggcgtcggtggcacggttgaactggctggcgccatagtcgcggccgcccaccatggcgcggatgccgccgtcgagatcggccaccaccgtcgccgcctgcgtcgcgtgatagtcgcggccgaactggcgcaattggttctcgaccgcgtcctcggcggccttctgcacgtaggt

SEQ ID NO: 631760 - DNA, 182 bp, Homo sapiens
gacatagcagtataccattggacatcaatgtcaaaagtaacttcaaatctgaggaacgcctcgggttgcaggaggtatgcctgtaagtacaaacttgccaagcaggtagtaatcctatggtacatggcacgctacgctttacataaacctagaatacagcacacccaggctaggtatgtcag

SEQ ID NO: 631761 - DNA, 1279 bp, Homo sapiens
gcaagtcaaccaagcaagtcattatgtaccctcactgtcaagcgccaacacaggcgatgctcatagagggaaaggtggaaaaaagagtaaaaggaagctcgggtaaatcgttacccgcgccatgtttactcaataaacatcaccatctagcatcaggcagtgattcagagggcaccgatcgtgtccctaggtgactaggatgtgtgtaactggcacgcggttgagcactaaacgcgatgtcaaaggataggcaataactcacattgtctgccgtgtaacttacgggaccgtgtaatgaagtggggtaccacgaggggatatcagactgatctgctagacctgtattataccagctgaaactagagctggccgcggtgaaggaggacgggcagtgagcaacaggcgagagacgacgaagacgccgtagtgggatgctttacacttcgagttaatggcgacaaacagtaacacgtaaccaagatccctacaggggtcactacaagctagcacaaaacacgtggcgatttagaacacattctcagcgtctaggagggcgaaccctcgagaagcaagaaagccgcataggtcctccgaagccaaggtacatggcgtaagaggaaggcttcatccaatggtccacaaaggacgaatcatacttgataagcgtcgaactggaagtcgcgagataatcttgaccgagacgggacacagagtgtacgcctagggcataacagtcgcaagtcgctattcgtagcagtccagtatcagacaatcaggggttgtacgaaccttcggatgttggagtccaggacatgccgtagtggtggccagacgcgtactggaaaggtgccgatcggtgcaaccggattcagaagtcactaacgtgatcctgaagattcaagagccgggagttaaaccagaggcgggacacaaactaaagtcaaatttcctcccctgggacgcaaagcggcccgaggaacgtaaggggctacgctaacaaagggccatgcccgggaaaggagatcacacaacataggagtgttataccacagacgacccacagaaaacagggtgtggcgtcgaaaaaggtggaaacccgcggaagcccgtagaagcactaaaaaagagcaggaggaacagaaactctcttgtaaaagaaccaggcggaaccagaaacagaggaggccactacagaaggaaggccaggcacacaaacatcacgtatacatactaggcacggtagcacacacacacagagaaatcagcaggtgagactaca

SEQ ID NO: 631762 - DNA, 606 bp, Homo sapiens
gctcgcactctgtttcttccgccgttccgccgtcgcgtatctctgccggtcgcaatggaagaagagatcgccgcgctggtcattgacaatggctccgggatgtgcaaagctggtttggctggggacgaagtctccccgagccgtgtttcccttccatcgctcgggcgcctcgcagtacaccgagaggcgtcatgtgatgtgagcatgggcgcgagaacaggactaccatacgttggtgcggacgtaggccacagagacaaagccgtgggcgcatgcttggacctcgtgaaagttaccgcctagttgagactatggctatcagtcgaccaaacgtagggacgaacaatggagcaagatcgtggacatccaaatcgaactatactacaatcgaagggctgcaggcctgttggtcgccccgggaaggatgccagcgccagtggctggctagaaccgaaggaccctcccttgaagcgctccatagtgccaagcagatgagaaaggatgactcaggatttagtctttagaggacccttacaatcaaccgcccgggcccatgtaacgtgggccattccaaggccgttgctggtcccttctaccgtcctctga

SEQ ID NO: 631763 - DNA, 580 bp, Homo sapiens
acaagattgaggtctgctcccagatggttcactccaggactgctacgctagtgctggcatttgtccaggcaagctcagcctcaggctgagggtcccaggcttcagtgtccctgtcctatagatctctccatgtacctgggcttcctcacagcatagcagctgggttccaatgacaagcatcccaagagagagacagacagaagccatatcacctcttagggcctagcctcagaacccacacagcatcatatgcattgcattttatttgttagaaacatatgactaaggctagccatacctaaggagaaggacattacactatacttcacgagggaaaaatatcaacggatctacagacacgttgtacaactacatacacacagtttcacacttactcacccacttcacctccattctgctcaactattcatcaaactgacacacctcaaacgcatcagcatcactgacagggacatcaaacacaagatattcactctggagctctacttctttaactgtatcctgttctcaccgctctcattaccttacttgcttctgaccatgaccttctccgccaaga

SEQ ID NO: 631764 - DNA, 921 bp, Homo sapiens
  misc_feature (516)..(516): n is a, c, g, or t
gtcggccgtaagggctgaggattttgggtccgttacgctcatgcttccgttgacctcaccgcgtgttcgctctcgccgaggtaacaagtcggttagtgaagcccgtgcgcaaacgagacatggctatttaaggataccggcaaaacacaaccgtggagctggaggtgtcaattcatcgaattcgaatcactcctatcaagccgcaagcgtaatatccttgtgaagaggttgtgtgctagacattgataagaggtagacaaatagaaaagagaatctcaaatgtgaataggaccagttcgaatgccattaccaagactttggagtaatcatgtacttatataaatacttcttgtggtgatggttctaagaggtgggatcgtttccgagatgagtaattcagaatagagtcatttgaattgcgagcagtcattctgagattgttgaagcacgattaattccatcacgtatttgattccaggacgtttgaaggttggaatgtcaccatttgtaagattngcttaaagtcaacgtattgttaataatattggattgatcaagttcgttatagaaaaaaaaagaagtgatcggggggcgcgcgtctaaaggtattgactttctgtatggggctcaagggggtttgacgctgttatccaaggttagtttgtttacaaatggtggctgtagaagtagcttgtacttataagcggtgagggcggactgtgagactagcatcatttagaagacgtgccaaaaggtggagaacctcgaggttgttgggaaaggaacttttgttgttgtgggtgtgccttaatgggagatcttgctaagagaattaaagcataaggtaattaagagttacgagtttgggtgtaaacgtggaatgatggtatgaaaatggaaaggtgtgtttggaatttttgt

SEQ ID NO: 631765 - DNA, 360 bp, Homo sapiens
tgatgtatcctccttgtctctggattcctctgctctatccctgatgtatagccatgctacaggactcacgctggtatgcactccccaacttcccagcatgcgtgtactaccccaccctgtcccagagcctgcttccacatcctgctgcctctccctcaagagtccctgaacccttccagatggggggtaaaggtcacacgaaggggactaaggtcatcataggcactcaggaaaacttcctccccatttacctcctcaactacaggcctggggccagcggaaactcacggaacaagcagctgagggccaggacaaattgtgcctcatccagagactggcagtagtacacccagaggcaag

SEQ ID NO: 631766 - DNA, 1319 bp, Homo sapiens
ggcacgagggaccagtctttggttatacatttggcaattacttgggagttgttttgaggccacctactaagaatacttgggatagagattacaaattaaacccataagccaggtagacgaggagcaaggaaatgtctgggaattcgtatttcatcggcatatatttaaaacatcttatgcttctaatttccggtgtgagtcaacctctgcggactgaacatcactaaaactctaaggaaacgtctctttttaatcctctgaaaaatcaatacatttaaaaactgcccgttgtgtcgacgctcggaaagagggtagaaaacagcgagtctaagggaaagaggtgcccctgcctccccaggcagccagggcccaggcccggtaacggagtcgtcctctttatgcccaaagccgccggacgggatgcaggtcgaggaccggccgcgcggcgcggagcggggatgcaggtaacagggcccgcgcgaccattccaccggctacggccacccgacacacaccccagaggcagtgtccacgcagccggggtcctggatggcttggcctcgggtcgtccggggcttctcggtgcgcccgcccccgcccccgctctgactcagcatcccagcctcccacagggggcgggagcgctccccgccgggcggcgcaggcctgaccgaccgcgccccgcgccgccttggcccctcagcccgcggccgtctcacttacccagccgggtctccgccgcgccaccgccggcgggctcccgcggcctcctcgagactcaggacacttccggcttcgcaagccctggccggaggccacgtgaccgacggccggcgcgccggtgcgggtgcgcgtgcgcacgcctatggcccgtctggtagtcaccacagccgcggcggcaactgccgagtcggcttccgcggccacggtaatgagggggatgtctggagacaccccgtccactgttgccctcgccctttactctaaaggggaatgaggagccctgagcagcgaacacagtaattgggattcccgcaactgcaaatcccgccccttccccgagcgctggccgacagtagggcggaccgacgctgagcaagggattacatcccaagatttacaggtgtgcagaacgtgggacacgtggggggcaggcacagacggccggcagagctgggagggatggattctatgttttaagggcccactttggctgcagtggagccagattatcgtctcgcagtaattcagactttacattgtttttttcattttcccatcacccagaaatacattaaattcttaatgtaaaaatgttc

SEQ ID NO: 631767 - DNA, 100 bp, Homo sapiens
tacttcattccagccaataaagatcctccaatggcaaaagtcaaagctaaagacttccaagaaacgggctactggggcagagatttcaacaataaaacaa

SEQ ID NO: 631768 - DNA, 989 bp, Homo sapiens
tacaacagcctctacctgtcgccccagggagaaaggggtagtgatacaagtctcatagccagagatggttttccacgtccgttctagatattcccgacacaagaggctgagacaggaggttattttcaatttcatttctggaattcaaatcatctaattccctttattactgttgtagtccctcacttggactatccctctgattttcacgatagaaatacgggaggtctagagcttctattccttggccataggtcacaccggagagctggcccagtcttcacaaacccttgcaacattgcctgaagattatggaataacgatgtattctcactcccttgaatctcaacgggcgtaactctggaagcacagcttgacctacatgctcatttcataccacatgcatcatcagagtgcacccgaggctcaagctccatccaaaaccatgggagctcatcccactacacacaggcacccgcgccacacacataccaccgcagtccgccacgccaccctcaagagctacacgccgccaattccacttggcacccgtcacttcttggtgctacctgacacacctctcccctcccaccttacgcctcctgccgtgcacacctcccacaccagaccacaacgaacatccttcactctccatcaccttcaccgcctggctcacacctggcgcaaaccacgcacacagcaagctagcgccaaagcgcccagctcgggacacgagcacaccgccccaagccccgcacaccaccaccacaacaccccaccacatccgcgcgggcagggcgcccgcgcggaggctagaggacatacacaacgcggcccccgccccgcacgcaacacagcacagcgccccacagggacgccagcccaaccccgcgcgcacacccatgaccggggggccgagacaaaacacacaccgacacccaccgcgcagaccaaccccagggaccgcgcaccgcccccgcacagccccc

SEQ ID NO: 631769 - DNA, 329 bp, Homo sapiens
tgcgggcggggggcagagtttcattgttgttgcccagggtggagtgcaatggcatgatctcgactcagcgcatcctctgtctccctggttcgagtggctctcctgcccccacctcctgaggagctgggattacgctaggcacccgccaccacgcctggctcattttttgtatttttagtacagacagggtttcaccatgttggtcaggctggtcttgaactcctgatctcaggtgatccacctgccttggcctcccaaagtactaggattacagactaggtgagccaatttttttttgtatttttctttttttcgtcgacgcggccgcg

SEQ ID NO: 631770 - DNA, 313 bp, Homo sapiens
ttcattgtgactgattagcctgtactgaaatgatatggtccgataaatattatcctattctcgtgaatctcactgcacttgatttcgctgtataacaggacaagtactccaatttatgaaaagaactagtccagcgcgcaggtggcgcacgccgtgttactctcatcacagttattaacctcctgcttgttatgttgttctcctccaactaagctcactaagtatgctgtgaccgctggtgtatgccaccaggtctggtccaggtatgacttcttaatctgggagacaaggccgccctatgtcgcctaggctg

SEQ ID NO: 631771 - DNA, 672 bp, Homo sapiens
gaatgtgaaataggtaggtgcgtgtagtcccagctactcaggaggctgaggcaggagaatcgcttgaacctaggaggtggaagttgcagtgagccaggatcgcgccactgcactccagcctgggtgacagagcgagactccagcacagtggctcactcctgtaatcctaccactttgggaggccgaggagggcagatagtgtgagctcaggagttcgagaccagcctgggcaacatggtgaaaccctgtctcttctaaaacacaaaaaattagccaggcgtggcggcatgtgcctgtggtcccagcgacttgggaggctgaggcaggagaattgcttgaacctgggaggcggaggttgcagagagctgagatcatgccactgcactccagcctggaaacagagggagactccgtctcaaaaaaaaaaaaaattaatctaagatttccttggggttccatttaagaataattaagggatatctcatattctggtaaaaaagactctagaacatagcaaagaaaatgggtattcaaggatttcaaaaggaactatttaagcggaaagatagttcatgtcctgggataagaaagctcaatatattcaagatgtcagtgcttctcacctggatctatagatgcagtgcattaccattcaaaatccagcagatattt

SEQ ID NO: 631772 - DNA, 1743 bp, Homo sapiens
  misc_feature (403)..(403): n is a, c, g, or t
tacactcccaagagtgccttcgggaacccctctccccactacccaaccagagagacagccccacgcccggcaagacgcaactccgggccacggagggcgccgcccgtacagcccggccgggtcagggggcttcgccgccgagcaccctccggcagccgccctcgggcctccgcggccgggcgggagggcgcctccccgaccacacttcggccgcttggcacccacagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgngctgtgcgcggcgcactcttcctccgcggggccgtgaaggcaccggcgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaagggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggagcgcactcgcgccgccgccgccgccgcgcccgggcgccccggagccgcccgccgcggggacgcggctcggcggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctca

SEQ ID NO: 631773 - DNA, 1164 bp, Homo sapiens
  misc_feature (408)..(408): n is a, c, g, or t
  misc_feature (962)..(962): n is a, c, g, or t
gattgtctgctgactgaccttagattacttatcatctccatcgtcatatacaggacgagatgttcattccacataggaagatggtaacacgggtatgctttgaagatggtatggccggacgggaagtgctatacttcgggaggtcaacaacatgatctcggaaattaatccaagatatcgttgtgtcgcaggcggtcattatgtcggtgcttgggggactgcacgtatacgcagaactatgaacctatttgacaagtactgtccagctgccagggcattcactcggtgctgatcggcgtatggttgccgtgaggcctctcgtcacaagtcttgactcaacgtaattcactattcctgtggtcacatctgcactgtaggtagtcatccgtgcgatatcagcggtggtgnactctgtagtaccaccgacggatgtgcattgaactgatgacaagtcgctggtacgacaatcgtcattcaacggtgagcaagatcgcgtggcattatagacggtcatgctaacgtctcactagtgtagatgccaccttgccaagtgatatagagccgactggtacatactcggagtggagtagcgtctactcactcgaccgcgtgagcaacatggctagtattcgacttctcacatgcagccatagtatagaattgtcatctaaaagaatggtggaagtgattatgtacgtcgagcttgcatctcagacggtgggtgccgtttccgtgccatgcacctaagtatccgctgtctgatacatatccctgtttagagcatgtcctggccatatagcgttgatctcggtggagcccttcccaatggtcgtttccgagggtgggccattgtggattggtgtgcgagagcagtagacctttcacgtgggagtcccagggctgatcgcctgtctcggcaggtctggtatcccgggtggggtcatgcgtgtcgggcactgganaccggcggttgcgccacgcgtttggcgccccaccactggtgtgccgcccaacctcgtgtaagtctcaacagagcagggggtgggacaccacttgtagggcgcgccgcgcggaggagcactcaggccggagaggcgccgacaggatgacggccatctcacgggtggagtaaacacgccctcagacctgtccggtagcaaagca

SEQ ID NO: 631774 - DNA, 2651 bp, Homo sapiens
  misc_feature (160)..(160): n is a, c, g, or t
  misc_feature (341)..(341): n is a, c, g, or t
  misc_feature (352)..(352): n is a, c, g, or t
  misc_feature (1311)..(1311): n is a, c, g, or t
tcatccctcctttgtgctctactcattttactttgcattatagttttgtgcccatttttctttccctgagtgctcaatatctcaagatactgaagacagggaccatgtcttggtcatcattccattcctctacacccgcaccaagcactgcgactcgctntagtatgactcaatgaatttattatttgattgtaagagaaaagaggttcaacataaagtccttttctaagccaggcatggtggcgcacacccgtagtcgaaataatcagaaggttgaggcagaaggattgcttgagcccaggaattcgagtccagcacggtcaacatagtaagacatttantgcagtggccnggaaccaaacttgcaatatctccaaggtaagcctgtcttttctgcagctgaaaggatcagaaggcagcatgccagctggtccataaaatatgatcaaatgaggattaaaattgtcacagatggtcaagatattgagaagataccaagcagatatccaagaacgactccagaacacttttagcagattccatccccctacaggtacagagctgggcctatggaagccctggctcctggctgcctgattgtgatggtgtctttggcttccttgaggaggaaggggaggcctgcgccatctgcaactcctaaaagcagctccagattcagtaacctctccaggaacacacttgccttcatcacaggaagagtaagcaccacagggttgtctaaagcgaagaagacaatattgcgacaagcagccatccaaaaagatgaaaagcgagaaagccatggtctttccgatgacagactcaaaagggctgagcagcacctattcaaatggtgagacaattctagagtgctgaatcctatccgcctcccagggacacgatcccgagggatacttgaaatttccagatttaaaggactgtaacccttagctcgaaatttactttgtgtttcggaactctctggagtgttaaggctcgtgtgttttctttgcgggtgtttttttaacgactcagtgggccggctccaagtttgtgaagatcctgttaattacctcctgcatttaccaccgaccaaggatgggaggcacgcggcacttgctgagcatatgtagagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgngctgtgcgcggcgcactcttcctccgcggggccgtgaaggcaccggcgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaagggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggagcgcactcgcgccgccgccgccgccgcgcccgggcgccccggagccgcccgccgcggggacgcggctcggcggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctca

SEQ ID NO: 631775 - DNA, 1887 bp, Homo sapiens
  misc_feature (403)..(403): n is a, c, g, or t
tacactcccaagagtgccttcgggaacccctctccccactacccaaccagagagacagccccacgcccggcaagacgcaactccgggccacggagggcgccgcccgtacagcccggccgggtcagggggcttcgccgccgagcaccctccggcagccgccctcgggcctccgcggccgggcgggagggcgcctccccgaccacacttcggccgcttggcacccacagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgngctgtgcgcggcgcactcttcctccgcggggccgtgaaggcaccggcgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaagggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggagcgcactcgcgccgccgccgccgccgcgcccgggcgccccggagccgcccgccgcggggacgcggctcggcggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctcagctgaaattttcaagtctgtttctgtccgtaagtgatttgactttctatgtattagatggtaatgaggaaattgcaggttttccagtctacatctatttttaaaattctgagcataaagaatattttattataaaaaaaaaaaa

SEQ ID NO: 631776 - DNA, 1067 bp, Homo sapiens
gggcaaactgtattcattcaagccatgggcgacctgtattcactcataacttttagctgagaaggcctaccagacacaagacataaaatcaatgtacaacacaaattgtgtgtcacaacgtgatgcagatactaagttttatataaaagaggttcataggatccccaaattagtattcactcggctcaatttatctaccctaagcacgtggtgaagttcgttcccagctccacgacgctccttggacgacccgtaagatggctcaagggtgagtactattgtattagaaatgaacttggtcgtcacgactttggagcctgatccgaagtagaatgtcttttccatgcagcagaaggtgggtaagggagatgggtcccctccagaaaatgcgtgagaaatggtagcaagacgggattccctctcttcggtctactcctcagatggcttccctctgtgagtgagatgaagcatttgtcccctcgatcccatgcacatctcgattgctagcgctgctggcgggagcctatgatccagtgtgtccaggatagagtccagatctgctccctccggtacgttgttctctctctggtaggatcgctgtctatagctacagatgagcaagagggcatccagggactgccagggctttcgttctcccatactctgtgggtgagaacgtggagaacagaacacattcagtcaggaggtcaatcccccatgcaattgctccagcttcacatgtgaggaaaacagctgggtcaagaagctggtgaattcatttattagccacttagcagttatgaagctagaagggcattctgtagcactggttttggtccagcatatactggtcacctaccggtctaagaggcgaagatacttcacgccaactaggcgggatttaaacggagaaaacctcccctggggcttctctcccataggggtggtaagagacccccctcgggggggtgggaaacccccggatatggcgccggaaaatatgcatggggaggcgatttggagagaagaggaaccacttagaacccgtcagcgagcatcaacacaaa

SEQ ID NO: 631777 - DNA, 2350 bp, Homo sapiens
  misc_feature (160)..(160): n is a, c, g, or t
  misc_feature (341)..(341): n is a, c, g, or t
  misc_feature (352)..(352): n is a, c, g, or t
  misc_feature (1010)..(1010): n is a, c, g, or t
tcatccctcctttgtgctctactcattttactttgcattatagttttgtgcccatttttctttccctgagtgctcaatatctcaagatactgaagacagggaccatgtcttggtcatcattccattcctctacacccgcaccaagcactgcgactcgctntagtatgactcaatgaatttattatttgattgtaagagaaaagaggttcaacataaagtccttttctaagccaggcatggtggcgcacacccgtagtcgaaataatcagaaggttgaggcagaaggattgcttgagcccaggaattcgagtccagcacggtcaacatagtaagacatttantgcagtggccnggaaccaaacttgcaatatctccaaggtaagcctgtcttttctgcagctgaaaggatcagaaggcagcatgccagctggtcttgtctaaagcgaagaagacaatattgcgacaagcagccatccaaaaagatgaaaagcgagaaagccatggtctttccgatgacagactcaaaagggctgagcagcacctattcaaatggtgagacaattctagagtgctgaatcctatccgcctcccagggacacgatcccgagggatacttgaaatttccagatttaaaggactgtaacccttagctcgaaatttactttgtgtttcggaactctctggagtgttaaggctcgtgtgttttctttgcgggtgtttttttaacgactcagtgggccggctccaagtttgtgaagatcctgttaattacctcctgcatttaccaccgaccaaggatgggaggcacgcggcacttgctgagcatatgtagagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgngctgtgcgcggcgcactcttcctccgcggggccgtgaaggcaccggcgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaagggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggagcgcactcgcgccgccgccgccgccgcgcccgggcgccccggagccgcccgccgcggggacgcggctcggcggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctca

SEQ ID NO: 631778 - DNA, 744 bp, Homo sapiens
gccgcgagcagagccgccagccctgccagctgcgccgggacgctggtggccatgactggctttcgtggatgtgtatgttcctgaggaaagatgatttgctgtgcgtgctcctgtggggaggacatgcagtgtctgcctgggagaagaggcagctgaggccgtggcccggagtagtaggagccacaagccaccctgggcaggacgaggccctgagggaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctgagtagctgggattacaggttgtgcaccaccgtacccagctaatttttgtattttagtagagacgggggtttcaccatgttggcctgggctggtctcgaactcctgacctcaggtgatccaacccgctgagcctc

SEQ ID NO: 631779 - DNA, 1235 bp, Homo sapiens
ggtagactcgctgcgtcgtgcgcacggagtcagcgtcggccgggatccggcgctagtatctgggcctgcctaggaatgccgagatggccgacgacgcgccagcttcagcctcgaggagaactgtgctctgatgacccgcggtgttcgagccccaatgctcccgatggtactttgtgctgcagcggagtttggtggagctgcgggaaatgttgaagcgccaggagagacttttgcagcaacgagtaagctggggtcccgcgtgagtcatccgcccaggctccttcaggcttcgagctaccctgggcggctccccttccccttccacggaacttctgattccctattccccgtggaacgggtgacgttgtgacctcagatcgaaacaatatcgcattcagatccataccgggcgacgttggaccggcaggggcttgctgacggaagaagcctgtgccatctatcctggacgcaggagaacattcactttctggccaaacactttggcgccctgcacccagagcgttaaccgcgacgcatcgttttggacctcgtataatggccaacacgtgcacagaggcttgccccaatgtggccagaaactgtggaaagcacagcttcaggaaagaaaaacaggtgcagcctgtgatagaccccgttgttaaaggatacttacggaaactcggtagcgccgtcaagtggcgaaccaaacggcacatttgccagaccagtttggaatcgtgggggttacacggaactacacgcggcccgagaaaatctctcgaaccccggactaacgttaggagtaccgatttcatccagcttaaggtatccactgcgcaattgattcgctccagggaacgaaataaacgcacgtcgcaaagactccaatcgtcacgagaaagcccctccaacacaaagcaccccacggggaacacctaggagcgcacggaaccgaaaacacacgatgagacaaccggacagactccaccagacaagaacaaccgccgcagggactggaaggagtaacagccagcatgtcaaacacacaggcggaccacagccatactccaaggagcaaaactaagccaggacaagggaggaacacagcccaccccaaacctgaacagccaaagtaagcccgtccaccccagccggccacaccgagatcacaaaaatacaccacggacaccaagacatctccagacagcaacagaacaaccaacgacgaatggaca

SEQ ID NO: 631780 - DNA, 149 bp, Homo sapiens
acccgaagacggggggggctattagtggccaaacaagggttttggaattgccccgtcctctaaattaacgcgtgggcccccccgggtaaattgaggccgtttttccccccggccgtttaagaacaaaccaattaaggactttcctggcg

SEQ ID NO: 631781 - DNA, 2255 bp, Homo sapiens
  misc_feature (160)..(160): n is a, c, g, or t
  misc_feature (915)..(915): n is a, c, g, or t
tcatccctcctttgtgctctactcattttactttgcattatagttttgtgcccatttttctttccctgagtgctcaatatctcaagatactgaagacagggaccatgtcttggtcatcattccattcctctacacccgcaccaagcactgcgactcgctntagtatgactcaatgaatttattatttgattgtaagagaaaagaggttcaacataaagtccttttctaagccaggcatggtggcgcacacccgtagtcgaaataatcagaaggttgaggcagaaggattgcttgagcccaggaattcgagtccagcacggtcaacatagtaagacattttgtctaaagcgaagaagacaatattgcgacaagcagccatccaaaaagatgaaaagcgagaaagccatggtctttccgatgacagactcaaaagggctgagcagcacctattcaaatggtgagacaattctagagtgctgaatcctatccgcctcccagggacacgatcccgagggatacttgaaatttccagatttaaaggactgtaacccttagctcgaaatttactttgtgtttcggaactctctggagtgttaaggctcgtgtgttttctttgcgggtgtttttttaacgactcagtgggccggctccaagtttgtgaagatcctgttaattacctcctgcatttaccaccgaccaaggatgggaggcacgcggcacttgctgagcatatgtagagccgggagggcgtgaggaaggactcggtctaactccggggaaccctcggagttccggcgcagacacccgagggggtgtcctgggaactccttcgcccgcgacacccgttcttctccgtctcccgaccaccagcgacgcagcagggcggctgccggcccggcccggcccgccttgcgngctgtgcgcggcgcactcttcctccgcggggccgtgaaggcaccggcgcccccgcgcgcccagctgcccggccccgccgcctaagccgccgcgttgctggcgggtagccgcgggcctccggtgcgcgggccccggcgcgtccccgagcgcgcgcctggccgcggccccgcgcgagttgcactaactttccggggcgggggaagggtgggcgccgcgggcccggctcccaggccttacctgtgctcaagttgtcgttgattttcaaaggcacccgcaggatgtagaccaggaatagcacgatgaagaaccacacggtccacagatacgtccaagaccaaactatgcaggacttgagctgctccagaaagcccgtggccgcttcagccatgtttcagcgctcctctctgctgccgcggctcttggtgtctgccgggatgattcaccggcccggagcgcactcgcgccgccgccgccgccgcgcccgggcgccccggagccgcccgccgcggggacgcggctcggcggaaatcgcgcgggccgcgggcgcgccggcttttccttctccagccttattgctaactctctaaaggtccctacaagtggctttcgtggagcgatcacgtggcccctgccccctcgcgttctgggtccatttatatttattatgctaatatttagaaagagaaggccaagtggcgcgccgaaggaaacgcctcaggcagttacaacccgcataagttgagcgtttaccacacgccaggcgctgctccacgatccgtacaatctcatttaacccctgcaacaattccccactacgatcctctttctataggtagggaaactgaggctcacagcagctgcgtagtttaccttaaggtggaaccaaaattcaattgcagtggtgtattctggggtccgaggtcttaaaccctactctgctcccttatcaggattcaggctcagggaatgaataaacccgggacagctaggagaagggaggaggtgcgctcctgtcgccggctagtaggcctgaagataaatcactctattcagcaagatttgggtggcagatgctatttacctttgttctgtctctttgaagcagcgcagggattttccagagaaatcttgacagatgaatgtttatcctccaggttttttggtgatcagaggtcaaactattctcagcctgtttttaatataaacaattctctgggataattttgactgtgaaacggccacctctaacagaaagtccattttaaacattgttttgttgtttttgttttgttttgactgtgctgaataaaatgtttcttttattctaaaatgttttctca

SEQ ID NO: 631782 - DNA, 144 bp, Homo sapiens
aacctgtggtccccgctcctgggagtcaccatattgatgctgaacttagtgcggacacccgatctggatacgcgcactacatgcccagaactcctgggctcaatgcgatcctcccacctcagcatcccgagtagctgggactac

SEQ ID NO: 631783 - DNA, 364 bp, Homo sapiens
  misc_feature (20)..(20): n is a, c, g, or t
gacactctaggggctccaantccctggggctgtgttggaaagctcaaagaggtcacagacccccgctcaagggaaaaattcttatttatatctttattattattatttttggagacagagtctggccctgtcacccacactggagtgcggtggcgcaatcttggctcaccgcaacctccgcctccaaggttcaagcaatcctcctgcctcagcctcctgagtagctggcattaaaggcacccaccaccacgcctggctaatttttgtaactttagtagagatggggttgcaccatgttggccaagcaggtctcgaactcctgacctcaaacgatccacccacctcggcccctagaggggtaccg

SEQ ID NO: 631784 - DNA, 195 bp, Homo sapiens
tgactaggatctcgtccaaagtgaacgtcgtgcgataccagcgaaagaggtacacacacattcttagccaacaagaatgtactctttgtaaaagtactagataagtcttccatttggtcactagggaagtagtataaaatagtgttgcgatgccaaacaaagaaaaaccaggctttccatgtagtaacactgact

SEQ ID NO: 631785 - DNA, 324 bp, Homo sapiens
  misc_feature (246)..(246): n is a, c, g, or t
  misc_feature (248)..(248): n is a, c, g, or t
gacgcacagcacctcggtgtcttcatcgccgacatcggataccaccaggcgttcgttctggacgaagtgcgcgtgccagtgggtcggaagccgttgctgcagcgcggcctggtccgccggtgcgatgtcggagaacagaacggacagacggttttgtgcggtcatgggccctcctcgattacccggtgcagggacaggatgcagaacgcggcgatgaagtgcccggtcttggtgccttgcgcgagntntcttgcgcgaataccgtcggcagccggccggcgacgcatcgcgcatggtctcgaatccgtcgagcaactgaaccgt

SEQ ID NO: 631786 - DNA, 299 bp, Homo sapiens
gtgaacatatttttgaaaagaaacaaaattgacaatcctttagccaaactagaaaacagagaaaaagcaaatacaatcagaaatgaaaaaggagacattacaaccaatactgtagaaaatcaaaggatcattagtggctattatgaatgagtatatgccaattgattggattatttagaaaaatgagataaattcctagacacatacaacctaccaaaattgaagaaggaggaaattcaaaacctgaacatacccataacaaataccaaggtctaaagcataatagaaagaatcctagc

SEQ ID NO: 631787 - DNA, 165 bp, Homo sapiens
gctcggtacctcagttccaaatcaaaaaaaaatggaactgaggctggcacggtggctcacaccttgtatcccagcactttgggaggacaaagcaggtggatcacctgaggtcaggagttcaagaccagcctggccaacatggtgaaaccccgtctctactaaaaa

SEQ ID NO: 631788 - DNA, 270 bp, Homo sapiens
cttgatcatagtgtcttcagatgctgcttcctcctgaaggaaatccttctgtaagccttgactctccctcctgtcggctggcatatgacagtggagcagtcaacacacaacactaccgtttgtgcatggctaacgaccgtggtgatgtaatacgcatcctgaggcatttcccctccatgacgtacgaacttggggctctgcacccagcgtcgcttcttgtgtctcctcttctcctcttctggagacgggatgacaggaaatcctttgcga

SEQ ID NO: 631789 - DNA, 490 bp, Homo sapiens
gtgttggatcctcagatgacgtggaagttatcagaaccccagtgtacttggagtacctctctgcaccatgatagctggctgatgttctgctcagtcacaattttacttgaaagcaagaattgtcctagctccttgtcgattattccaaaacgtttaacgttcaaagcagggtctcattaaaaaagaaactactggttgatataattgagatattacaatttcagaataaacatttgattaaaaataaggaaatcctcagttcatactgtatttaaaagagaattggtgacttgaatgtgtgtaatcttttggaacctgtctaaaaaccaaatacccctgcaaacagatacagcccaccctattctatttcaatatttggctgttttattttatagaaattattttgctgcattcacaaatagaatttgatttaagaagaactttttgtcctgtggtgtgtaattggataatcatagggttacttttttgg

SEQ ID NO: 631790 - DNA, 227 bp, Homo sapiens
  misc_feature (1)..(1): n is a, c, g, or t
ntgatctagaggatcccagcgctcagcatacgtgtaatttcttaagaaatgaggaaaagtgcaagtgatcccagtactggtgggggaaaacaaaaataaaaacaaacaagtggcaccgggccactggctgcctaaaccaatcacagcttcagtttggtttttggtcaagtgtgggagttacaagtagacacctctctgtgcctggtatggctcagcgcggggtaccg

SEQ ID NO: 631791 - DNA, 543 bp, Homo sapiens
cttgtgctgcgcggcttccttctgcttctgctcgtagcgcgtggcgttgtccgcccgctcctgcgccttctgcccagcctgctggtgcgcctggtcgagcttgtgctggaaatccgcctgcttctggtcgtatgcctgcttgctcgccgcgtgctgcggcccttccgcgccgcgttgcgcctgcttcagtgcattctgctcctgcttgtcgcggaatgcagccgcgtttgccgcctcgttcgccgcgcgctgcggcgcttcctacgcattctgtgcctgcttcagcgcctgctgctggtcgcgctgctgcgcgcgcaccgcacgctgctcgtcgttgagcgcgagctgctcctggcgaatgcccgcccgctcgtcgcgcatctgttcacgcgccttgccgaggcaggaattgacgaagaacttgctgtagcaatcgtgctcggccaccgcataacgataatcgttttcggcggagcgttgattgagcactttttgacgggcgtcgaaatccggtgcggcagaggctgcaacgggggcggccgc

SEQ ID NO: 631792 - DNA, 105 bp, Homo sapiens
gccaatactccaccagcaatgacagctgctaggacttctgtccgtttaaacagactgtctgagtgtttctcagtatacacatttgtatcctgttggctggcgaca

SEQ ID NO: 631793 - DNA, 1262 bp, Homo sapiens
  misc_feature (1262)..(1262): n is a, c, g, or t
ggctatgtttacatgacacagtgtgccaaacggctgacttactcgcggttgcgttagtttctatgctcatcaggactatctcaccctcccactcctgtttttaaaactcagaattctttcctaagagccctctcgagcaaagcgtgccgaagttagcttgtcttctctgtgctcggtcctttcttatgtcctcataaaagctcagatgatggtatctgtgagtatgttttgcaaattcaaaatatagtcttggtaattctattcttctccagttgatttgttaccgaagaactgctgtacagagctatgtcctttgtccagtttctactacgactggagaagccactccttgagaaagttgtttaaccttacacactaataggagaagatacttttctaaccatgagacatggacccgggacctgaactgacttacctcatgaaaagaatcctacaaccgaagacgcggcataccaggctgtgcatcccatctctatcggggcggaggcggagaacaatccgttgcgtgaccattgaaggaggaagctgttgctacgatcgccctaggactttcgtaggcacagagatgggccaaccgatcctgcgtgtcccagctccatcccgcgtgggaggacagtagcttacggaggctatgccctcgagcgagcacagcgtcgatcaaccatgtggcgccaaaatgaaaagccgggttccccggcattggcccctgaggggccacctccttcccaagccctttcgctttccttggggcaatgggaggtccctgtggagcattcccacggaagaaacttacgctttcaagcttcccattccattgtaagtgttgcaacgttgggaacaattcccgcaaaaaggaacctgttaacgcccaagcacaaggtgccttgttcctggggacgggacacccagccaatgggttaccccttggggcatttgcccgaaccatggaattgcaagaagcgaggattccaacttgcccccttgggcaaccccaagacaagcaaatggaaaggactccaaaggaatccaatttgggctacccttccccttgggaagacagcagaagtaccactccacgtggtcgggaatctcgagacaaggttcccaatcctctggggcctctcggcttggtcacacaccctttttccaaggcacatgatttgttggaaatcgacagcacaaagccaggagagttattgaaccaaatttccgagcaccccttccaacatgtgtcaacacgn

SEQ ID NO: 631794 - DNA, 163 bp, Homo sapiens
  misc_feature (65)..(65): n is a, c, g, or t
  misc_feature (92)..(92): n is a, c, g, or t
  misc_feature (119)..(119): n is a, c, g, or t
  misc_feature (141)..(141): n is a, c, g, or t
atcaaaggattaattcaattccaaacatcaaaggagaaatagcaaaaatcactatttcctctcanctcagcactagcacacagcatctgtgngcaggaaccaggagccggacctacctnactgagacccaggtcagtgggnctgtgtctgccaccctggcgtg

SEQ ID NO: 631795 - DNA, 450 bp, Homo sapiens
gaccatcgaaacgccacgctcgagatgactccacataggctcccggaggcgggcagcaccggtccggaattccccgtgcccatacatatatgaggtgaggggatgctccctcctttttacatagtcttaatctatatacacacttttttctcagacgacgcttacttggctagactcggccgctccaaggtggagacttcgcggggtctattcgccagattgatctaggttggagaggcatgtgaccagtctcaacatttagggagtatgggtcggatgaaacttatctgtaacaaacttacttgagaagaccagctgcaacgtctgacgactcatttggataggcttcatctcccacctctagaaatcattggacagcaacgaggatgggtcagtgtgagcacggtttccaggggtccactgataaagctgttgatgttccggctggga

SEQ ID NO: 631796 - DNA, 324 bp, Homo sapiens
tctttaccttacttgtcgatgcagattgctcgagactacctgattgcttcttctgctgttcagaccggtctgttaacgtgaatgtcgatttgtttgctggcaatcggtggtgtcggatacactacaatgttccattatttgcttcaatattcagacgatcttcaagggttatgttcagtcagatttctggttagtggaagaatctgtgaagcttctagagttcttctcctgctttgatctcataaaactggggctttaggacagactgctggtcctccttgagtcgtacctgccgtttcacttttttctcctgctggaggagtc

SEQ ID NO: 631797 - DNA, 322 bp, Homo sapiens
atgagcgatgcagctgatgctggctggatctgctgagcgcgagtgagggagcctgagcctgcccgccgccgccgcctccgcctcccctccgtgaacaagtgagccctgggcctggggccctggcactgcctgcccctagccctgtccctcggctgtctgtgcctgctgatggtgtatgctgctgctgctgatgctgagctgaggtgtggatgggatgatgctgatgctgatgctgcctgtggcattgatgtgctggcctgtgacctgatgctgtgtgctgcccgctgctgttgttgtgctgttgatgtgggaatgcctgctt

SEQ ID NO: 631798 - DNA, 1533 bp, Homo sapiens
tgtactctgcctggtcgtctcctggcggcgtgcgtgtcgatctccatctggcgctgcgttgcgtcactctccgtggggtgggttgcgattgtgtatgcagcgccgtggtatgctgtgtcgcactcgcggacgttagttgttgttggtgagccgtgccgccgccggtgggacctcgcgtgcgttcgcagagcacattgtgtgccgggtgagctagcacccgcgctctttggtggcacaccccgcctctctcgtttgggggtcaccctgtcccggtgggtctctcgtccctgcgtcgcctgtgtagcttgtcttttgctgcccgcgtgggtgcgtcttgggtgttttggcgccgtgtgtatcttggtggttttttacccgccggtttgtgccggagcgacccgtctgggtcagcgcttgcttgtggtggggtcgccaagtgtcccccggtcgaccaggcgcccccctgtgtccgaccctgatgggccaccagcccctctcggggggggagtccccctggtatattctgtgggggtttcctttgggcccacacactccggtggcacggttgcccaattctctgtgagggagtggcctcttttccggcgcccgttgtttcgccgggaggcaacccgcttgccacaggaggtgtcctgggggagcccccgtggtcccgcctccaggggctctcggcgattcccggcctctgggtccccccggggcggagatcacgcggttatctccacgctcttgtttggcgggggcgaccccccccctaggggttcccctctcgtttgctttcttgtgacaccttgggctctatttgggctccccgcgggccacgcccctgtgcgcacaggtggggcccttcctgcttgtgcaccccccagaggtttccaccctctttgtgtgcccccgcacacacactgtgcgtgtttatagaatggtgcgtgtcacacacactggggtttcacactgtggcgccctgtgcacacacactggggggcttatattgctttatatcccctattctcgtgagggaggcacgcccccttctctccacccacatctccctctcacacacaatcttgtcacaaggagcacgcacgcctgaatgggctttgagagccacgggtgttaaaggggcgctctcccaccaatccgcgtgaggcctcgtgtccccacaccttctggtccacacttctggggtggttccacagcctgcacaacttatttggagaaggagaattaacttcctccctcgaggggtatacacagcgcgcaggaaaaggtaagggagtgggccacaccctcccctttcacagctgtttgggagagacacacactatggcacggctgagagtggccccagagagcacactcctgtgaaaatggggacatcccccgccttgcacaaatgggcctttccacagagctgttcctgcacactatccccctccctgccgccaccttttttgcccctttttggcccacacaccatttttttaagaggttttgtttttctatttgtccaca

SEQ ID NO: 631799 - DNA, 306 bp, Homo sapiens
  misc_feature (8)..(8): n is a, c, g, or t
  misc_feature (12)..(12): n is a, c, g, or t
  misc_feature (15)..(15): n is a, c, g, or t
  misc_feature (23)..(23): n is a, c, g, or t
  misc_feature (49)..(49): n is a, c, g, or t
  misc_feature (79)..(80): n is a, c, g, or t
  misc_feature (107)..(107): n is a, c, g, or t
  misc_feature (116)..(116): n is a, c, g, or t
  misc_feature (138)..(138): n is a, c, g, or t
  misc_feature (141)..(141): n is a, c, g, or t
  misc_feature (158)..(158): n is a, c, g, or t
  misc_feature (163)..(164): n is a, c, g, or t
  misc_feature (173)..(173): n is a, c, g, or t
  misc_feature (187)..(187): n is a, c, g, or t
  misc_feature (193)..(194): n is a, c, g, or t
  misc_feature (212)..(212): n is a, c, g, or t
  misc_feature (216)..(216): n is a, c, g, or t
  misc_feature (226)..(226): n is a, c, g, or t
  misc_feature (232)..(232): n is a, c, g, or t
  misc_feature (239)..(239): n is a, c, g, or t
  misc_feature (242)..(242): n is a, c, g, or t
  misc_feature (255)..(255): n is a, c, g, or t
  misc_feature (257)..(257): n is a, c, g, or t
  misc_feature (265)..(265): n is a, c, g, or t
  misc_feature (267)..(267): n is a, c, g, or t
  misc_feature (275)..(275): n is a, c, g, or t
tagccatngctngcngtcctgangtggcagcgacgtccgcgtccgcccnggtcgtggcggcgggcgccagcgcgtgagnngaattcatagcagtgtgcagtgcaagnttcgctatnggaatctcggcatttcctactnccnggataaagcaagcaaangactnncagaacgcngcagagtgataacngtaganngcaatatatgtactccgnaacngcaaacttgnaaaagnaatagcngangaactcggttcangnacttttcngncgcggggnttcattatccagacagtaccaccggggttgg

SEQ ID NO: 631800 - DNA, 148 bp, Homo sapiens
acaaagagaggccaggtgctgtgagcatccccaaacccttgctccgtacccaaggtttttctccccagcctgccatcccgtatgccgttcttaattctaccattgtgcccccgctccgacattctcctcctttgcctcccctgttccc

SEQ ID NO: 631801 - DNA, 256 bp, Homo sapiens
acactttttgattttaacaaatgcaaatcgttctctaaaacttgacacaaaaaaaagaaaccagttctgtgaaacaggtacctcattactggaaaataacttataccagcccctctgtctagggaaataaaagtctagcagttcaaagttaaagttataagagacgtatcagattatgtaaacttaattttgtgcaaggaagttcccggaactccctttcactcgcttaagcctcttctgctgtgtggccctactg

SEQ ID NO: 631802 - DNA, 429 bp, Homo sapiens
gggggcatgggatgctaccagcctgtgcggagcggagcacaccgctaacgggagtgccaggttaaacactataagatgagaagaatagctctctgaatgagctgtgacgggtccgacgcgattatacctacatcaggagatgaagaggaccaacctgaaaggtatcattgatgggagattacgagcgatttggaccaccacaggaatgtttccccaggaaatcattatgtgcctacacaaacatgtaaggattgaaaggcttgtaatccaaagttactctgtacaaaccttgaatatcgaaaaaagcacgtataaagagccagttgattctgagcaatggattgagaaagattaggtacacacagaggggcagttgtgagaagtgacgcacatgggctccgctacttactggagattagatatatgatg

SEQ ID NO: 631803 - DNA, 643 bp, Homo sapiens
  misc_feature (465)..(465): n is a, c, g, or t
  misc_feature (508)..(508): n is a, c, g, or t
  misc_feature (545)..(545): n is a, c, g, or t
gaaatgaggtgacgagcctgtttatggatgtgaacagtgaggatcagatgttttatcagaacacattcttttattctaccaactctccatgagcgtgagtataggagtgccatgagctttttagtcagcagttttgtaaactctgtatataaaatcattaaccacacattgtgggtgatgggaatgacgatattcatgctagacagagtaataattgtgcaaccaataatagtgtaggcctgtacgctagctaagcagccttcacgcgcaggtgtggtgcgccgtggtgactatctcgactggtaggagttgatttgttgtcacttgtcccttcggggcgtgggggagcggaaaatctctcaacgcgttgtcatctctataccgttgttaaagagggggtgggggaaatgttgagtgttcgatgtgatgactgtaggttactcttccctctcccaagtccatgtnccaagtggctatgtaaagcaagatgatacagaaagctgctctnaaatctcactgagtgatttcaccttcgcctactatgnaatgtctcatcagacctgacatgtctgagataaccaaggtgagtcaggatgtgatccatcaacgacattgtaagacagttcgtctccaccgcaacctc

SEQ ID NO: 631804 - DNA, 478 bp, Homo sapiens
  misc_feature (56)..(56): n is a, c, g, or t
  misc_feature (119)..(119): n is a, c, g, or t
  misc_feature (334)..(334): n is a, c, g, or t
  misc_feature (350)..(350): n is a, c, g, or t
  misc_feature (417)..(417): n is a, c, g, or t
aggatttaccaccaaccatctatggcaaatgttctgttgtacatcaaaaatgcctngattattttagtgaaaccatttctgtgttgaagatcatttaccaatttgtctctatggaaaanagaagagttgggaagccctttgttaaccacaatcctgtctgttttaccccatgaaggattgcagactcttaaggaactctcaagggaatcatcaccctaatatagggtcgccacctaacatggttctgaccagagcatctcagctgccaagactcaaccagagggcccggttaacaggcagccttcagctgggtgggtataggtggacctgagancgtgggacagatctcnggtgatggtgatggggagaccggggcctagggaccagcagggacccagctgctgacagacattcagncgtggtactgagattcaactcatccctacacagacacacacacacacatccacccaagagg

SEQ ID NO: 631805 - DNA, 106 bp, Homo sapiens
aggacggcgctcctgatatgtgagctggtcaggagggaagttgtgcagcagctgcctggatattgttcgacgtactgggtagtgccagtaggtggcaggcccaggt

SEQ ID NO: 631806 - DNA, 396 bp, Homo sapiens
  misc_feature (18)..(18): n is a, c, g, or t
  misc_feature (20)..(20): n is a, c, g, or t
  misc_feature (81)..(81): n is a, c, g, or t
  misc_feature (118)..(118): n is a, c, g, or t
  misc_feature (274)..(274): n is a, c, g, or t
  misc_feature (296)..(296): n is a, c, g, or t
  misc_feature (319)..(319): n is a, c, g, or t
  misc_feature (344)..(344): n is a, c, g, or t
  misc_feature (372)..(372): n is a, c, g, or t
  misc_feature (390)..(390): n is a, c, g, or t
ttctggcacgagcataantngcaatggcaattccgtaaatgccttacctgaactgaaaaattcgtaaggctatatacaacntacagcaaaaggccccaacagttgtaggccccgtacngggcatactacaacccttcagctgacgccataaaactcttcaccaaagagcccctaaaacccgccacatctaccatcaccctctacatcaccgacccgaccattagctctcaccatcgatcttctactatgaacccccctccccatacccaacccnctggtcaacctcaacctagggnctactattaattctagccacctntaagcctagccgtttactcaatccnatgatcagggtgagcatcaaactcaaantacggccatgatcggggnactacg

SEQ ID NO: 631807 - DNA, 751 bp, Homo sapiens
taagtgttatgagggggaatgctggaaattgtcaggggtcatggaaactctgtcatataagtaaggctagggtgagtgtgtaggaagtttttccataggagtgtggtatgagtgggtcgtacctgtgaatcgggggtatgctggtccgacatccataaaaaccatgggatgtgttaaaacgtaggtgtctggtgttgaccaacaatacttgtttgttggtaagaagtccaagggtgaaaagatgcgtcatcctgtgggtccctcagtgacatcatttgtacgctggtgacgggtgtctattactaataactgtgtgggtatccggctattgaaagaactatgtggcagaatgtggtgccttgacgggaaggtattcagcttgttcgaacgccttgaagactagtatctgagatctcccctttctgtgcaatgtgtcaaatggtgtgtgttccaggtagtggatctctcgctcagttgttgggaaggatacactcatatttattgtgccaacgggttctatgaattggcatgcgccgtcactcaccaggagtgttgtccctgcggttgtcatgttgaaaacaaggaggtgtggaagacagggtcaagacggaaaggcctcattaatatagcacacttggtccgatagtacaactatatgggccaaagaggtgaactacctatcgaaaacttgtactgggcaaactggtcccaattgcgccgatacagggcacaccgtcagaagtaagagacc

SEQ ID NO: 631808 - DNA, 262 bp, Homo sapiens
ggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggacggacaccgagctgctgtcaatgttgtatactttgatgacaagtacattgtttctgcatctggggata

SEQ ID NO: 631809 - DNA, 213 bp, Homo sapiens
  misc_feature (84)..(84): n is a, c, g, or t
  misc_feature (171)..(171): n is a, c, g, or t
gcggtctcgacgggcgggcctggcctgtcccgggtgctgagcttcgccgcgtgctggccacgctgggtgcggggctgacagagncgcgtggagaagttgatggctgggcgcgagggctcccgtggctgcgtcgactctggagcgtttgtcgggcacgtcgtgtcgcgctgngcctcgtgcccaggaagccccgggaaggctgtgcaggggcgt

SEQ ID NO: 631810 - DNA, 1526 bp, Homo sapiens
  misc_feature (1384)..(1384): n is a, c, g, or t
  misc_feature (1502)..(1503): n is a, c, g, or t
tccatggtttaaaaaaagtgacatttgcttttatcacttattgggcaagggtggggcctgtgcagtgaagggtggctaaggtggtgcctcagggggagtgggttgggctgtggtggagaattgatgcacagaaagaggctgtgaaaggaaaaggggggtgggattgtagaaggccagggcccagaggggtctccctcaggtctccgctttcgtggaaacgggacacgcctttgaggacaggagctcagtggcaagccaatagtataggccaccaatctcagatttaaaaaattccgtgaaaaactcataggcgtgaaccatcacgtggtggggtgtctccagttttctttacatcagtggcggctcagaggaacccccaggggcccctctctgggtcactctgggtgaaaggccagacaaagatccgtggtattccagtgaagcctttagagaactctctgtgtcgtgtggacagaagacgcgggtaggtataataaccccatctccttttccccaggacatataactttccgtggaaacaaaacaggagaaccccaggggaccctcaaagttgccacgcggatacaagctcctcgtgaaaagaggccgtgagaagaaatatttgggggccatgttgtcggagacctcttggacgcaaacacgcgccccccggaaaccgtcaccttagtgcgcgcttcgtgcaaccccaggcgcagcttaagaaaaatgcctcttctgtagccgacagcaggatactagccgggtatactggggaagccttcttcctcttcaaaacccccccctcggggtggcccaaaacatatccgcgggacaaacgagacagggtattcaaaaaaacccctcatagtcccactagatgcaaccccctctaaaagaaggggtgggcccctctacaagaggcccctccacctaaaaatgagaccctccggtgctcccttaacagcccacattcggtaggagcttcttctccttatacacatcctccataaaaacagggtcgctgcaacaaaaaacaaggagcgctccgatcaaacacccaacaaacatatatacaccaataattcatcccccaatgacttgggggggccgacagtgtcataacacaccgcagaagaaagaacgaccactatacacacggcgccacccccaagccgcaacttcgttgtcaacaacaaaggccgctctcgaaaacggggagaagacgccccttatttagatacccgcaaaaggattttatgtcaggcgagaaatatgtagagcgcctttataacaccacagtgagtcggctaatcctccccctagtatgaggtgtggcgtgctcccaagcgattacgccagtatgctcgcaagaagccgcgttacnaaaggctcgatgcactacggaatacatacatctgcctactagtactataaagcagcacgctagtgctgacgatagtatgcttgctcacacggaaggctagtccatccatggacgtgcnngagacctactctgccggacgacc

SEQ ID NO: 631811 - DNA, 245 bp, Homo sapiens
aggatgtagaaagaaatcgtgaaccctcctatgtagctagatgggaatggaataatggcacactacattcgtggaaaataatttgggagcacctcaaaaagttaaacatgaagcccccatataagccagcaattccactcctaggtatttatccaagagaaagaaaaacggtgctcccacataaaaacgtgtatataaatcttcacagcagcattattttgtaacagccaaaaagggttgaaaca

SEQ ID NO: 631812 - DNA, 333 bp, Homo sapiens
  misc_feature (5)..(5): n is a, c, g, or t
  misc_feature (34)..(34): n is a, c, g, or t
  misc_feature (41)..(41): n is a, c, g, or t
  misc_feature (109)..(109): n is a, c, g, or t
  misc_feature (134)..(134): n is a, c, g, or t
  misc_feature (156)..(156): n is a, c, g, or t
  misc_feature (215)..(215): n is a, c, g, or t
  misc_feature (260)..(260): n is a, c, g, or t
  misc_feature (265)..(265): n is a, c, g, or t
  misc_feature (288)..(288): n is a, c, g, or t
  misc_feature (321)..(321): n is a, c, g, or t
tccantggttcatcatttcctttctggagaaagnaactacnccccagtacttcatcttgaacttggcagggtcctcggtgtactgtgaaggtgcccaccatgtctgggncacacgtcccagttattcaaaaganggactcggcccttggctgtggngctcatctggcccggtctcgtcccacggagaactccgggacgatgttgtcctggcaganagagggcctcggggtccttcttggccatgggcgtaccaggtcccngagangcgaggccttgtcgaagttctcnttgactcggaagctggctgcagctgcggagcangctgccggcgcg

SEQ ID NO: 631813 - DNA, 1483 bp, Homo sapiens
  misc_feature (1219)..(1219): n is a, c, g, or t
cccaagtcaatagaagccggcgtaaagagtgttttagatcaccccccccccccccaataaaggttaaactcccctgggtttggtaaaaactcccggttgacccaaaattaacttccaaaggtgggtttaaccttttttaacccccaattaagcttaataccccaccgggggatttgaattacccccaattatggctttagagcccttaagacctcccaccggttgaaattccaaccaaactggttcgcgcaaaaaccattacggaggcccaaacggcttaaaacttccaagggaccccgggcgggggcttcattattccttcttagaagaggagcctggttcgtggtaatcgcaattaagcccccggaattaatccttcgccaaccttttggcttcaggcctaattatatccggccaatttttcaggccaaaccctgtatgtaagggctaaccaagtataggcgcgcaaggtaccccccgcgttaaggacgcattagggtcacagcggtgtgtatggccccacatgtagaggtgtggccaggaaaagttgggcgctaacactttttctctatactcccaggaaaaaactatacgcgaataaggccccttttatgtaataccttaaacggggctcgcaacgcggtggggacttttagcgcaccggttaaaacctgtgcagacagtatgagagtggctctagagttgggaacccacgggggcccctggtaaaggcgccgcggtaataacccacacgcggccccgggtttaaaccccttctcttcaacagaggtatatatcctttcacaaaggggaaccctttttcaacgtataaaaaccccccttaaggcccaatctttaatatttatggagaggaagcaacccagggtttgctttaacacggggctaaacgcgtggcttacgcgggcgaacagggttgcccccttggtggacggaaacccaaagcaaataaagaaaacacagcaggaggggcggggcccggcgcccctataaaaaaatattcccccctcgagagggggcggccccaacagttttaagcacgagtatacacccccaggggtttctcttgttgtgtaccaaacggggtgtcccgccctaattagtgagggaagcacgcgccatattaaataagcgcagtatgaggcacatgaggtaccgccggtggtgtgtttatacaaaacacacgctcgttgcggacctncgggggcacacacaccgctgctgcacccgctgtgggagacactcttggtggcagcaggagacccaactaccattcgtggggggggagacgccaatacttgtggcacacactcatccctaaccaaagattttagcgcctccaagcgcgaacacaatctaaacgttgtcacggcgtggacatagcggggcgttacaccaacgcgcgaaatagcactgcggcgtagagaaaagttgcggctacccgagcaatcactctacaacactt

SEQ ID NO: 631814 - DNA, 435 bp, Homo sapiens
  misc_feature (62)..(62): n is a, c, g, or t
  misc_feature (67)..(67): n is a, c, g, or t
  misc_feature (76)..(76): n is a, c, g, or t
  misc_feature (84)..(84): n is a, c, g, or t
  misc_feature (90)..(91): n is a, c, g, or t
  misc_feature (95)..(95): n is a, c, g, or t
  misc_feature (296)..(296): n is a, c, g, or t
  misc_feature (342)..(342): n is a, c, g, or t
  misc_feature (352)..(352): n is a, c, g, or t
  misc_feature (385)..(385): n is a, c, g, or t
  misc_feature (395)..(395): n is a, c, g, or t
  misc_feature (412)..(412): n is a, c, g, or t
  misc_feature (433)..(433): n is a, c, g, or t
taattaaaaaaaaagaaactgattttcctctgtaatacaacctgccctagtacacattagancaagnaaaatccgncaagatanaagaanntgtnctacccagctcaagcctggtaccgcccgacctattctgtgaatggacagagaaatggggagagatacctagctacaagcttttatgaagttatgctaggacccagagctactgggattcttgtcaggtgtgtgtgggcccctatttccagggttcctcctgaagggaacctggaagaagctggacctccacagcctcaggnccccgagcattccctcccttacccttaaggcagggcttccgggggnaggggggagncccttgttgctgttcccccaacagcgtttccantcgggatttnccaaacagggcaccttntttttgttttccccattgggntt

SEQ ID NO: 631815 - DNA, 725 bp, Homo sapiens
ggtacctgtagcttgagtgtggccggtataagttcttgtttttcgatgtttgcagcccgacgggggtaaccctctaatgtagggattttaaagatacgcctctcagagtcctgcagaagccaaattggagtacaaagccttgcccgcagacgcagtggtgcgcattcttggacgcggctcctgcaatcggccaccagcggcgaacatactctgagcgctcctccagtccaacaaataccattgttatacccaccccgagagttaccccaaaagcgccctctaatttttcaaagtcgtccacctcgtccacccgcattctcagggttttattagttgttcgcagaactccagaaacatttatgccatattatcagaacaattttcaactgccattccgaagatcaaaaaaatgcatatggaccacacccctagcataaacccacgtctcaaaatgtgcgggtgatataattgtacaccaacaacaattgtagccatagcgcggtacaacataccgctaacaagtaggttcgtgcaaggctttgtggagcgcaggtgggttgagccgaagccggaatacaccccgtactggtttgagaaaacaaccccgcgatgcggtttaaacacacgtgattaaaattttcttggagtctaaaactacgaaacgagcacaatccctctgggcagacaagggaaaacattttttcaaaaaaagggcccccataaca

SEQ ID NO: 631816 - DNA, 177 bp, Homo sapiens
cccgcgcgccgcggccccggtcagcttgcttgtgaatccagcatggtagctggggctgagtgaagacctctgcacacctgggcacaggatagctatttcacttcttctccagtgtctaccttcctcctcacctcccagccatctatataaacacaatcctttgttctcccaaatctg

SEQ ID NO: 631817 - DNA, 809 bp, Homo sapiens
  misc_feature (36)..(36): n is a, c, g, or t
  misc_feature (48)..(48): n is a, c, g, or t
  misc_feature (83)..(83): n is a, c, g, or t
  misc_feature (246)..(246): n is a, c, g, or t
  misc_feature (279)..(279): n is a, c, g, or t
  misc_feature (298)..(299): n is a, c, g, or t
  misc_feature (306)..(307): n is a, c, g, or t
  misc_feature (313)..(313): n is a, c, g, or t
  misc_feature (322)..(322): n is a, c, g, or t
  misc_feature (327)..(327): n is a, c, g, or t
  misc_feature (351)..(351): n is a, c, g, or t
  misc_feature (360)..(361): n is a, c, g, or t
  misc_feature (387)..(387): n is a, c, g, or t
  misc_feature (394)..(394): n is a, c, g, or t
  misc_feature (435)..(435): n is a, c, g, or t
  misc_feature (442)..(442): n is a, c, g, or t
  misc_feature (462)..(462): n is a, c, g, or t
  misc_feature (474)..(474): n is a, c, g, or t
agcgggtgcggccgccgccgaccgctgcgggagggngggggaggagtngggagtttagcgcagtcgccggagtgcgaggacancgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgncccgttcaccgagagggggaacgagctctcgcncactcgccggaggagacgnncctgganncccaancccgccggngaaancatgagctccgtccagcagacagncgccgccgnncgcggagggtcaccaacgtggggtcnctgttgntacacccgcaggagaacgagtccctcttcactttcctcggnaagacantgtgtgactatgtcttcagncagtggtgcagntatatgccgcagatcggaactgtatgtggctcaaagacgtgcaagtggtgttgcttgagctggctaaaggaccaatccacagagatctaattttttcaagacatattggacaattcaaggctgggacacctatcgtgggaaccacagagctatacaacaaacttggtcattataatagtcctagaggactattcacattacctttggcgtggagataacttgtaaacgttgctcctaaattttggccaatgaagcaacacgcagagacaattcgaagaagcggtacagacccttggggccggcgcacaaggaacattgaaaaagaccgagaaccg

SEQ ID NO: 631818 - DNA, 225 bp, Homo sapiens
  misc_feature (133)..(133): n is a, c, g, or t
tcagcagtactgctcagctctgagtagctagatacagcatctgcacatgcctgcctatttgtatttagtaaagatagggttcatcatgtgggcaggctggtctcgaactcctgaactcaggtgatccggccanctcagctccccaagtgctgggattacaggtgtgagccacggcgcccagcctatttttcagtctccctttcttcagtagtcaaaagcactttg

SEQ ID NO: 631819 - DNA, 1044 bp, Homo sapiens
gcatgctccggcccctgcaaacgagcgtggggagagcagcttgaaaacgcgcctggcctgagctgtcaccatcgacactctccaggctccggacacgatgcaggccatcaagtgtgtggtggtggggagatggggccgtgggcaagacctgcctactcatcagttacaccacacaatgcctttccctggagagtactatccccatcgtgttggacaactattccatgcggcaagttgtagcaatcgtgtgggtacaaggtaagtccgaggtgcaacctgggcgtcttgatggcgtgtacagttgctcgtggccgtggagggactactactcgtcaccggctcgctctcctaatctcgcagacggaacgttttcctcatctgcttttccctcgtctgaccccagtctcttatgagtaactgtcctgatgtccaagatggcttgcccacgaagtggcggaacctactgccccagcagcaaccatcatcctggtgggcacctatatgctggaccctgttttggacgatcaacggatcactcattcggagaaagcgtgaaggtacgaatgagaggctggctcccatgaactacccggaggtcctggcatctgtgccatggcgattgacatcgggtgaaatacctggagtgcatcaaattctcacccagaggatgctgaaataccgtggttcgactgagtcatccgggccgtgttgtgaccctcatggccaagcggccaggaagaagggcgtcctgggcctcgcttctggggtttgggccgaggctccaaccttgagtggttttggtctcagggttcgatccttaggttgtagggccccggtggcaccgttggcccccgttgggtccatccgaggcgggagctgggcggggactcgctggaggcccagcgcgagacccggcttgttggtgtgtcaccccttcttgtttagggaggggcgcggattacacgcgtggagtgcgtgtgatccgcagtgaccgcatctgggtgtggtcactaggctccccgtagaggccgtcgacgtgtctcg

SEQ ID NO: 631820 - DNA, 1002 bp, Homo sapiens
tctcgcccccattgagacagcagtcttcggtgtgtggaatgtggatattctacccgcgtggaggtttgcttgctcacaacggggtgtgttttcccatgtgcagggtgaggtttttttttgccaccctggacacatgttggccccctcaaagaattctgtggggatttgtaccccagaatcctgttcccccaatcagcatgttctcccacctcctctgcctctccctccccctggagaccctggaagtggctgtgtgtcacatacagtgacccttggtcaccagaccacagaggatggagcctgggaagcagcgaggaatctcacaggggcgtgagaaatgaaaaagtgagaaaaacaggcagaaaagaacagaacaagcagcagcgtaagccgcccaagctactaggcgggaggataaccaaacaccgcaacacaacagggcgcccaaagaacaaagaagagacaaaaagaaacaaaggagactaaaagagaaacaaaggagaacaagaacaaggaagaagaaacagaatacagcgcagacagaagaaaatagaacagaggaaggaaagcggcaaaacgaacacaagcaaaacaaagaacataccccacaacgaaaaaagaaagaaagaaagaaacacaacacaccgcagaagccccaaagacaaacggaagcgggagaagccaaaagcaaggaagaatagcaccaaaaggggacagcggagcggcagcacaacaagccccaagccacccacagagagcaagggcacacgaacaccaacaaacgagacaagcaagagaaagaaaacacccagaggccagggtgccacacaatccgccgcaaggacgataactacaccaacaaccaaccacgaaccacggggagacgacgacaaagacacaaacacagagaggcacgcacaccgccaagggcccgaccgatccagaagcagaatcgagagaaggaaaaagagacaagacccctcgacaagacaacaggaacgc

SEQ ID NO: 631821 - DNA, 701 bp, Homo sapiens
gtggaagttaacacagcgattcatgtgtgtgtacctgatgcctggcagacagaatcattcatacgtgttcaactgatcaaggggttgcatcttgctcttgcggggatggaggtatcattctggggaggaagcatgtagttgctagtgacgttgttcggatatgtccaagtgtcgttcactaatgtacccctgactgtgtgcttttggtaatgtgatgtctgaatgtctcgtccccctacccacaagcatgacctcgttgcagtgggtagaccgtggacagccaggcgatacctgaaggagcatgtgctgcgggaactcgcggaggcggctgggtggaggtgagccaatggtggctaggctggacctgggatcttgcaaatgagtcgcggagtgacaaggtcacgaagagcatgaattgatgctggcatgaaggattccacgaggatcgtggagacctgcctggtagatgctaacaggatatggctggagtccgaagggaacatcagctgtgtctctgttgaagtggtgacttgtgcttttggatggactggttgtggaaccagctctgaggagcgcacttccacctgatgtactgctcaccatgtgggtcatgatgtactctctgatcacatgaggcagagtgctagacatgtgttgtccatcttggagagcatggctagataagatcgagtgccaacctt

SEQ ID NO: 631822 - DNA, 100 bp, Homo sapiens
  misc_feature (61)..(61): n is a, c, g, or t
aattcaaagcttctaacgaatgtacggggacatggcttgtggttaatctggtgttattttntgttcccacaaagttaaataaatcataaaacttgaaaga

SEQ ID NO: 631823 - DNA, 124 bp, Homo sapiens
gctatgcaaccccttctgacaggaaggcttagattgagtgccacctccattgtgatggggagctcagaattgtgtccagtggagaatttgggtagggagaggtgctagggagtgctgtagcaga

SEQ ID NO: 631824 - DNA, 787 bp, Homo sapiens
tcatgacagggcttgacgtgtgttgatagcttagtggtcttcgggtcttacgctataaatcttgctactgctcactctttgggtccacgctgcgttgatgagctgtaacactcaccgcgaagatctgcagcttcactcctgagcccagcaagaccatgagcccactgggaggaacgaacaactccagacgtgctgccttaagagctgtaacactcaccacgaaggtctgcagcttcacgtcctgagccagcgagaccacgaacccaccagaaggaagaaactccgaacacatcagaacatcagaagggacagactccagatgcgccaccttaagagctgtaacactcaccacgaaggtctgcagcttcactcctgagccagcaagaccacgaacccaccagaaggaagaaactccaaacacatctgaacatcagaagggacagactccagatgcgccaccttaagagctgtaacactcaccacgagggtttgcggcttcatccttgaagtcagtgagaccaagaacccaccaattccggacacatttggcgaccacgaagggactttcgcatatcgccaagcggtgagacaaatagccgagcggtgagacctttcccaatcgccaagcaaatcgaggcatcaagctacagatggtcttacaaaatggaaccccaaaagaagttcaataacaatttctacggaggaacctgggatcaaccaactggacttcccgggctaaagagtccctctgaaggaccgactggggccctttttgcctcagaggatg

SEQ ID NO: 631825 - DNA, 342 bp, Homo sapiens
cagtgccttgtacccagtcgtggcctgtacccgacttcacgaggatcttgcgcgtctgcagcgtggtcatgtccaggacgccacgtagttagagctctcggccaccgaatggtcgcgggaatacagcaggttgaccttagtgctctgcaccgccacggggctcttgctggaaatctacggccgccagcgctaaggcagcatccagcatagacgggtttgtctgggaacacccagctgaccagcccactgcccagggcctcgtcagccatcatcttgcgagcggtgaaagccagctcgttgaccaggctctggttcccgataaccttaggcaggcgctgcagt

SEQ ID NO: 631826 - DNA, 155 bp, Homo sapiens
cgttgaattgcgagcgttcatggcacagaggatagcattgaagatcctgcaagctgctctcatctctgaaagcaagcgttctgtccgctggccattctagcgcatcgtcctgcgccagagccaggtcctggcgccgcgggcattcaacgcctccg

SEQ ID NO: 631827 - DNA, 234 bp, Homo sapiens
tcccgggctgtacgaattttgcacgagggaaatgtttgtggaaaaaagtgcgagatatgatagtccacacatttaagacacatagagaatagggtgttaaatatggtgaaattttcaacctttatctagagcatttgcaaacttgtgaacacaattaacgttaaaattattttattgttaatcagggataacttttgatataattagattaactcctgcttttggttctctttt

SEQ ID NO: 631828 - DNA, 578 bp, Homo sapiens
  misc_feature (23)..(23): n is a, c, g, or t
cacattatgaggcggcgctcgantgatgaaggccagggcgattctggtgccgatggcgcggttggatgctggcgtcccgaacaaacccatgtcgattataacaacgcgcttttctcggaggtcaagcaagcgctggaaggctacctggctgggcgagaaggtttgccggtcaaatcactctctgagctgattgcttttatcaaccgcacccagaaacctggtgtgcctgaccagaaactgctggaaatgatcaatggggtgcagaccaaccaggaagatcgcgatgcgctgtggaaagccattcttcctatatttcagaacaccattgatgaccccatgaaggagcacaagctcgacgccatggtgtcgaacttccagtcccacaattattttttcagcgctgcggccgggtacccaggcatatccgttccgtcaggcatggatgaagacggcatgcccacggcactttacgtgtatggctccgccaacagtgaagctaccttgctgtcagtcgcctatggttatgaacaagcctcacaggccattcacaaaccggcttttctcccaggtgctccctt

SEQ ID NO: 631829 - DNA, 1053 bp, Homo sapiens
gaccgagccaaattagctaagtgaggctgggggtgatcggacgaggcaggtccgcgttcaggcgcgcggccggagctgccggaagttcggttcgcgccggcgctcgccagggaagcccggggccgccgggactcggccgtcctccggaccgagaggccgccgcacgggctgcgctccagatgctgctgctgccgccgggcaccccaccctcggtctcctctccggaggccatggacccactgaccccaaggctccccctttccacaaggcggaggccctccatccactcctacctcggcggcggggccctgacccccgcggatgggccgcccaccttcctcaatcgaccgccgaagtggtagtcccctaaacattaaaacgggcagcagcctgcgacggagagagccctgggaccagacacaaaggcagaagggagacaccgccaagggataacgctcctgtgaccttacgagaaacgcggcctaacacgcattagccccagcgaggtttggacgcccgcgttgtacttatagagcaagtagccccttcatagagcgtgccttgatagaccaccaactcgggcagtatatacacaccacacgcgagacctctacagggcggccatcatacactgttcgacgaaggcgcctggaacggcaacacacgggtctcttacaagagccggcctccgaagcccacccgggaacggcgcgaacaactcggcgcgcccaagcgtccagccgcgggagacccccacgacgcacccgaggacccgcgaacgcagaacacaaaccagtgcaccaggtatacggaccccacggcacgagcacttacaaaggaaacgaccggcgcggacacagcctggcgccaccgaactgagtagacgacaacccaataaacggccccgaagatccggacccgcgagactacaacaggcacccgccaccacacggccctacaagcagcttacagaccccacaagacgagcgtcacgacgacttacccacgcaaacccagcccccagggcgaaccaagacgacggagcgaacacgg

SEQ ID NO: 631830 - DNA, 141 bp, Homo sapiens
cgaccacagagaccttgatgggcattccacagtgtggagctacatactgaggcactactgtcctctattggagaaccactgacttctcagtatggaccacagtacccaagcctgtgctggtgaggggtaccgagctcgcat

SEQ ID NO: 631831 - DNA, 702 bp, Homo sapiens
  misc_feature (633)..(633): n is a, c, g, or t
  misc_feature (702)..(702): n is a, c, g, or t
ccgggctgcaggaattcggaccaagcctaagcgaactgtgcactgacagccgagccacatgcttcagacactatgatgctggtgaaggtctaagcacacggaacacctcacactggctgcctgaacgccagggctgattctaactactgtaacttgcatactggtgccatctacgactctgtcattgacctgaactacctgcataacatatgccaatgtgatgctactcctggtacattcgatgacacctgcctggctcacaacgctaagctaggcatcaaagtgaatgccatcaccatagtccaagactgagactcatacacaatccaggtgagcgatgctaacgctaagtacgtcaactaggccactgtcatcctcaccaccatcgataaagctgctgctcatgtgatttgagcccaacggctgatcatctctgccccctctgctgatgcccccatgttcgtcatgacttcgaaccatgacacgtatgacaacagcctcatgatcatcagcaatgccttctgctgcaccaactgctaagcacccctgaccgaggacatccatgacaactctggtataatggaatgactcatgatcacagtccatgccatgactgacatccagaagactgcngatggaccgtccttacactgtgtcgtcatgctcactgggctatgcagcatcatgcgtgactatctggcn

SEQ ID NO: 631832 - DNA, 1101 bp, Homo sapiens
gagcacagagcctcgcctttgccgatccgcgcgcgccgtcgcacaccgcgccgcgcgagctcagccatggactgatgagtatcgccggcgctctgtctggtcgtacacatctggctccgtgcactgtgtcaacggtccgtgctttctgcggtgcgagcgatgccccgccgggccgctcttcccctgccatcgatggaggcgcccgcaggtcacctagtggcgatgaatggatgggcatggtgtcacgaaggtattccgtatgatggagcgacggatggtcccatgagtcataggagagtgcatcctcactcctggaagctaccccaatcgagcacaggcgatcgtacaaccaatcgtgggaacgacaatgagatacaatatgctgtgaaatctcaacacaccttctaacagatgacgtctagctgtgttgcgctcccgatggaggcaccccgtgcgtgcgtgaccgatggactcccctgaacacgccaagtgactatcgcgagaagatgatccagatcatgtctgagagcattcaagatcccagccatgtacggtaagactatccaggactgtgctatccctgtacgcgctctggcacgtcaccaatggcatcgtgatggactaccggtgacagggggtcaccagacttgtggccaatctacgaggggtatgccctccgcaatgccatcctgcgtctggaccttggtggcgggactgactgactacctcatgaagatctcacagagcgcggcatacagttcaccacacggccgagcgggaaatcgtgcgttaattaacggaaaagctgtgctacgtcggcctgacatcgaacagagatggcaagatgctacacatctccttgagaagagtacactgctgacgacagggacatacaatgtgcaaataagagcattacggtaccgtagtgacctttcacgcatacattagggacatgagtcattggataccaaagtacctcaatccaccataattagactgcaatcccaaacctttaccaccacgtgtatcgaccacacaccgaacacacgacaagaaatcccgccaacaaaaaacttcatcgaacacccgagaacccagagc

SEQ ID NO: 631833 - DNA, 196 bp, Homo sapiens
tggtaccctgctcgccctctctgccattatttatacatgcatagtttggaaaaaataaaaactttttttaaaaaaagaaaaaaatgattaccgggtgggagtgagcatgttttaccctttgtcaacgagcccagctggcatggcttttctggagtgcgaggggccagtgtcctctccccagagaggggcggagcag

SEQ ID NO: 631834 - DNA, 745 bp, Homo sapiens
cgggtcttcggagaaggcgcgcggatgtcctgtgttggccatggccgactacctgattagctgtggggcacgtcctacgtgccggacgacggagtcacagcacagtagctcttcaactgcggagacggcctcaccatacaagtgcgtggcctatggggctcacctgggcgaagagaggggcggcaccctggtgaacaaggccagatgggggcttcctgagagccgcctggggcgtgggcgtgggggacaggtctcgggaattgtacacccacgctccggggtctcactttgagacatctggagcggtgctatggggtacggagaagcatctctagtacgtgcttggaatctcaggccggagattccatgtctccagacacatggaattgtcagggtgccaggagcactgatgacagctcggtgggcatgaaagaggtcccctgtaacccatttccaccttgtgctgtgcctgtgagcacacatgactctgtcagtagaccactctctagctcacatgcgttacgtggttgattggtacatggggatggagtctcatgtctgccctaagctgagagctttagctcccgaattcactccctttccctcgcagtgactttctcattctcccgtgggtacatcgacttcacatgcagaccaggtggtgagtatgatcaggaagttgggtcctgaacatcaaggtgagctaaagtgcgtactatcacctggtctctgggctaatcaccaa

SEQ ID NO: 631835 - DNA, 110 bp, Homo sapiens
ctgcttgtctggctggagtgatccactttatactgcttgtctggctggctgctccactttaatactccaaggctgcaccagatgtgtgcaggcatacctcttccagccag

SEQ ID NO: 631836 - DNA, 448 bp, Homo sapiens
  misc_feature (39)..(39): n is a, c, g, or t
  misc_feature (82)..(82): n is a, c, g, or t
  misc_feature (182)..(182): n is a, c, g, or t
  misc_feature (307)..(307): n is a, c, g, or t
ggcccaaaaaatggtggtttttaaaaaaagttggaattnaaaatggccccaaaaacttaaaaaaaatttaaaaaaatccggnaagatgcaacaacaaaaaactctgaagtatccctcctttcctttccccttcctttcctcctctcctcctcttttccttttccttttcctttcctttccanagggtcctcactgtgttgcaatcatggctcactgcagccttgacccacctgagctcaagctatcctcccatctcaacctcctgagtagctgagactacaggtgcgtgccaccatgcctggttaanttttgtatttttagcagagatggaatttcaccctgttgcccaggctggtcttgaactcttgggctcaagcgatctgcctgctttggtctctcaaagtgctgagattcaggcatgagattactgtaatcgctctggcctgag

SEQ ID NO: 631837 - DNA, 352 bp, Homo sapiens
aactggccactgacaaaatgaccccatttgttgacttcattgaacacattacttaatgagcaggtgaagccatcaaagattgggtgtccacgtgccaacgtgcgcaagatgggagcggccgaatctggcttggcggaatatctctttgacaagcgcaccctgggagacagtgataatgaaaggtaagcctcgggctaatttccccatagccgtggggtgacttccctggtcaccaaggcagtgcatgcatgttggggtttcctttaccttttctatgagttgtaccaaaacatccacttaagttctttgatttgggccattccttcaaataaaccaatttggtacccgaaaa

SEQ ID NO: 631838 - DNA, 200 bp, Homo sapiens
gtagctgtaaaggttatgtgtacacacgctggcacagcaagcagataaaatgccctcatcatttcacaaactattttctactggaaaagaagatgagatttttttcccgtgttgcctccgtgttgcagactgtcaactgttaatagagttcagacgtacccatatagtacatttatgatagagtgcataacacagtttct

SEQ ID NO: 631839 - DNA, 485 bp, Homo sapiens
ttatgactatgacgttgccctgatcaagctcaaataagctgaaatatggccagactatcaggcccatttgtctcccctgggagccgagggaacaactcgagcttgcaggcttcctccaactacctacttgccagcaacaaaaggaagagctgctccctgcacaggatatccaaagctctgtttgtgtctgaggaggagcaaaacagctgactcggacggaggtctcacatcaaatgaatggggatacgaaaggcagctgtgagacgagatgctcaatatgaacccaggctatgcacaacagtcaagggacatctcagaggtggtcacccctacggttcctgtaggtacttggacggagtgagtcccatcatgctggagcccaaatactttgcgacaggtgatcctaggacggcccccttgactcgttcaccaagagaacgtcgttcatatcaaagttgggtgtactccggtggggaatagcgata

SEQ ID NO: 631840 - DNA, 912 bp, Homo sapiens
gcgtcaagcaatcgagtatggtggagcttgaaccaaagcctcttcaaaaagcagagtggactgcatttaatactttgatttcgcactcttaatgttcactcagatataatcagaagtctcgattacaggaatttgtcttgttaggcttgcaatgtcgtttcattgtctctgtgttttattcttatggggcttaacaggtttatcactaatgcctagagatatagaataattaatcggggaagaggttcgcccagagatgttggcctagtaaattggttgtgtcggggccccattgggaggtagttagtagggtgaagaatcaatccgataaataaatataacaaatgtgttgagctctgatgcgacacatatgttgtggagtaaaagagaattggcgcattctgtatattatctttgagaacaggtgaaaagaacatgttctttgtgggtgacgcaaattatcatggcgagagagcttgtattgaggcgggtctagataaagattttggagtgcattaacttgttaacctaagagacttttactagggtacttgttattaacaggaatggtttatggctggcacatcatggcaggagggggagggagatcttgcaattatgaggtagcccctgctggtccattatagggaatgcgcgatatacaagaatgcgaattgggtgcggctgcggggaattaaccgtcatggtgactggtggtgaagggctccgggatgtttgagcgaagggtgggctaactgtacttgggtcccagatagaacaagaagttactgtgaaacacaagtgttggggggggctgaggatgataaaaagttttgagacaacatgggggggggggcccgggttaaaaggtcaattgggacaaagttttccagaaaacggcgagacaggctg

SEQ ID NO: 631841 - DNA, 508 bp, Homo sapiens
gacccagagtctagatttaacgcacccctagactttctgcctgtatacctatatcattcagagacagagttacgctcttgtcgcccaagctagcatgcaatggtgcgatcttggctcaccgcaaactccacctcccgggttcaagcgattctcctgcctcagactcccgagtagctgggattataggcacgcgccaacacacccagactatactcataatatattactatttttagtacagatggggttttgccatgtcggccagcctggtctcaaactcctgatctcaggtgatccacctgccttggcttcccagggtgctgggattacaggcgtgagccactgtgcccggtcttaatgcatgtagacttgataactcatgatgtagagctactatccatgtccttatttgtcatccatgtatcttctctgatgacgcttggctgcacattaaaagctcatttgaaaaattgcactgtatactttttattgaattgtaagagctgta

SEQ ID NO: 631842 - DNA, 108 bp, Homo sapiens
cgtttgataatcgcatttgcaatatcaacgtccaccttgggtccggagacatcgatgtcggccttgggcaggctcacatccagatgtggaccttagcctttgaagcca

SEQ ID NO: 631843 - DNA, 1202 bp, Homo sapiens
ggtagcacgaccccgcgacggcgtgacgtggctggacacagcaggtggtgctggccatgccctacgacagcccagtgcccggcatacaagaacaaccaccgtcaacatccatgcggctgtggtccgccaaggactcccaacgagttcacagctgcaggacttcaactgtgggagactacatcgaggcggtcctggacccggaacttggcgtgagaacagtctccagggtcctgtaatccctaatgagtaagccttctttgacggggaacggaagctgcgtggtgaagcgaggagtactttcggtagtggcgaggccgccatcagcatccaggggatagttattcctgactggtatcaactgtcgtccgaaggtcctggcgtgcctggggagcccctgatgagaacccatagtatgcggatgaccgattccccagaacaagggtgggcccatcccatgactgaaagcggacgatcaaacgcctcggtcccgtctctctattccccatggagcctacgattgcgcgaatcccgttgtgtttgggcaccgtgcgacgacaacggttgcgaacacttggggaatgaggatgggcctttgacgcgaaacactcgaaagggaatatgacattgagcttgatggcacttgccaacgctaaagcgagcaaaacggatagtattgactggaggctcatctgcaaagagggggccaaatagtgcagcgatgtgcccgccgttgtgagaccaaccttggttgagtcacacaacactggacctcgctgcacggaacaaaggaaaggtggggctgatccaccagagggagtagacaaagcaccatttggcgagatcgtacagtaacacgatgcctactgtagtgtacccaagtgacacaatacaccagggacgcgggggacaccattacccgagtgcgccaaaaaccacacggactgaggaagacacaggcacaaccagagagagatgtcaccccctcatcgagccgacaaacagaatgatgcacatcgactgaggccgctagcatggcaagagacgaaaggtgtgcacacaggccgagagacataaccgacagacgcacaaacgcggggcaagaaacctggtggcacaagaccccaggacggagtcaaacacacagagcgtgcggaccaccgcacaaacccccgatgaagcatgtgttgtacgctcatgggggt

SEQ ID NO: 631844 - DNA, 989 bp, Homo sapiens
  misc_feature (1)..(1): n is a, c, g, or t
ncccccaggaacgtcgttagtccattcgcaacgagtttgttttttagggacgcggccacatatgtctgtcattcagtatgaactatggcgcaaagatctgggtgtcgtgtagaattcggggaagacaccccgggtaccaccgggggttggtgtccttgagacggaggcaccccccagtgggggtacaatccaggggaggcagccggtggtcgctcaggttgtgtgtccgaccgaaacagcataggtggcccgtcccttcttagccgacactttctctgtggtggtcacgctgtgcccaccaggggaagaccacgcctgttggttgtgtgtacgccctcatggcaggatgttctctccgcattatagtatatagtatgggccgacagaccccacccttagtgccctcttcttgaagcaacaccgtgtcccctctaaaatttatgtcactctcctgcaaatatatctccgtctaacaattacaccgagaaatgttttcttctcctaaggctcaccacactagtcctcactcgacttatttccccccagatgtcaccccgcggtagtcccccccccccgcagatagattcgaattcgtatgtttaacgcccacaacttctgactcgctatcattctttacaataacatgtgccaccataggactcttcatgtatcagatgcacatcaaccgccccattcccactggattgtagatgttattcgtgtatcacctgttagccctatgtttttatatatcaccacatacacacaaatttttttttagatgcaaaaactttcttttacatataaactatcaatttcctgcagtgactctgagtatacataacaagagtgagcatgatcaccaacacccccacgggaattggcccattctcataagtaatacataaagcataatttatcctttcggagacaacatttcctttggtaacaacaacacccaaaaacaaaacatttttacaccacataca

SEQ ID NO: 631845 - DNA, 356 bp, Homo sapiens
actctcactactattatattatccgtgctagcttatgcacctttcctgcccatctatcaacacagatggcattagctagcgttcttcaagtccggaataattgactaagtgtgtgacacatccaggccttgtaggaatgagtcactggggcaggtgggcagcccgggtgcaatctcaccaggagccccaaagcctgttctgtaagaaacactgtcacatccaataccggaaggatttggactgacagccttatggagatacatctgttcttatcgaaactcgaatttcttttttaattaaaaagaaaccgctgctttcttattaacatggggtgcaaaaaaggcaggccaaggagg

SEQ ID NO: 631846 - DNA, 1104 bp, Homo sapiens
ggggactcaccgctccagtcgcccgcgaggccagcgcaccggtcccccatcggcagccgagcccgcccgctcgccgttcgtgccctcgctgaggctgggcatgcaggattggctggatcgaggcctcgggtcacaatgccgccattggagggaagttccatacaacctctgccacatcccgtggggccttgtgcattccctccctgacccacaagaggcgtcccaacacgcttgtcgttctttcgcttgcatcgctggcggacttccaggactcgagaacgaagataggccagaggacgatgttctaaggcctgagtgtgtacaaggacctgcctgctctgtctggatcagtgagagattaggtggctctgaagcataggttgtcagagtctcttgaggatgagtgagaacgctcacaccggcgacggcacgtgatctgttcggtcaacgggacgcattcgtgccctccttgaaagacagacgtgtagaaccgaaccacaagaatatcaatctagtgtagtttggactcgtttactcgaagacaagcgagctgaatcattgtgctggagttggcttgactgcaggggacctctcgcagatgatcaagtactttaagaagcagaagcggctcatcccggagaggacacgtatggaagtactttgtgcagctgtgcagcgccgtggagcacatgcattcacgccgggttgatgcaccgagacatcaagcctgccaacgtgttcatcacagccacgggcgtcgtgaagctcggtgaaccttgggtctggggcggtttcttcaagtcttgagaccaccgcagcccactccctagtgggggaacgccctactacattgtcacccgcagaggatccatgagaacggtacaacttcaaagttctgacattcttggtcctttgaggctggcttgctgtacgaagatgggcaggccctccagaaggtccttctatggacataagaatggaatctccttctcccttgttgccaaaaaatcgagcctgtagttacccccgttccccgggagacattatccgaaaaagttcgagaactggtccagcattgtcatttgcctgacccacagaagactg

SEQ ID NO: 631847 - DNA, 304 bp, Homo sapiens
gatacaaaccattaatgcagtggtgcaggcacctcatatcccaacacgactccatgacgctgaggcaattgaattgcttaaagctgggaggcggggcgttgcgtgcgccgcgatcgcaccagtgtactccagcctgggcggcagagcaagactccgtctcacacaaaaacaaaaacaaaacaaacaaaaacaaatctcagtagctataagatgaacagtattttcctgcaccgggagccttgtggtggtggcttcctggagggcatcgtcgataatctacatgcagtcattcactattctacca

SEQ ID NO: 631848 - DNA, 138 bp, Homo sapiens
agcaggatccctcctagttactaagactccagttacaacagctttttatggaaactgaaaaagagagcagaggaagtataagagctacccacttaagaaataactttaactagttaaaaaactttcgtagaaatctta

SEQ ID NO: 631849 - DNA, 482 bp, Homo sapiens
agacacagccaacatttcaccgcttaccaagaaattgcattccaatgtgaggtttcgcaggtcggaactggtacacggaaaaattacctgcagaaaacaggataaacagtgcacgctgcagtcacagcactcactacggttggcatgagtgggtgagggttgacatcaactacacccttcctgcagaaaaaggtctattccgagaaataagtggaagctgtaaagcaagaaaaattttcgatgtcagggacgcagccgattaaattaacaagacaggaatgggccgggcacggtggcttatatctataatccccagcactgtgggaggccaaggcaggcagatcacttgaggtcaggagttgagaccagccccgcaaacatggtgaaaccccgtctgtgccaaaagtacaacaactggcaggtcatagtggtgagcatttgtaatcccagctactagtgacacggaggtgggagaatttctg

SEQ ID NO: 631850 - DNA, 263 bp, Homo sapiens
cggttatgttatctatagattacagacattgtatagaaaagcactgtgaaaatccctgtcccgttttgttctgatctaattaccggtgcatgcagcccccagtcacgtaccctctgcttcctcaatccatcacgaccctctcacgcggaccccgttagagttgtaagcccttaagagggacaggaattgctttctcagagagctaggtttttggagacgtgagtctgccgatgctccctgttgaataaatcccctccttctac

SEQ ID NO: 631851 - DNA, 1222 bp, Homo sapiens
ttggaacactatacctattattcggcgcatgagctggagatcctaggcacagctactaagacctaccttattcgagccgagctaggccagccaggcaaccttctaggtaacgaccacatctacaacgtataatacgtcacagcccatgcatttgtaataatacttctatacatagtaatacccatcataatcggaggcttaaggaaactgactagtatccacctaataatacggtagcccaacgcatatggcagttaacccgcataaacaaacataagactactgactacttaactaccctactctcctaactcctagctcgcatctgctatagtggaggccggagcaggaacaggtaagaacagtactaccctaccacttagaagggaactactcccacacataggagcctccagtacgaaacctaaccatactactccttaacacctaggacagagtgtctccatcaatcttagagggacacaaaaaaaatcaaacaacaacaaattactcacatatcaacaaacccacccatgaacaactaaacaccaaaataaacaaaaagagaccacccatccactcggtactgcagtcccgaatacataactacaaaagcaagaaccattaccatatctaccattaatgaatgcatccacaaaatcaccataagcacatgacaagagacatcacgtcataccctaacataaatagaagccggaaaaaactatcaaaaaagacaaacgtttcattagatacccgaaatcggtagggaagagaagaaaatcgagagttaaacatacaaacaaagacaaaattgctggaagatagaagaggattaacacctgaaagaatataataatatcaatacaattcattacacgaaggaagataagcgaataaattcgtcgtaccagaattggaaaactactacaaactcacaggcaaaacaaacgcatccacactgtggactacatagggataagaaaagtagaatacaaataaagaggagatacaaaagatataaaatgtagagtacgagagtaaaataaatagacggaaggaattgagataaacagcgagacattataaaaaggataagaaataagtagattgcaaagaagcaggaaattactgaataaagaagacagatattaaaagatggagattaacaagaacatagtaacatgtgagcggaaagcgcaaatacaagaaaaaaatgaag

SEQ ID NO: 631852 - DNA, 890 bp, Homo sapiens
ggcccggttgcagcgtgacgccggatgagtgcttttaggcttgctggcccgcgggctgtccaggcacgcgaggccctcagatttaccttctatgatggtcctcctttgtgcaatggactgcctcactatggacatatactgtgcgggacaaggacacacctcagcattcactacctcatgctgccccgtgtccgagaagactggctgtgcccaagaaaacagagagtgcagtatctcagatgcagtctgtgattgactgtggaagagtgatcagagaccgaaaaattattcccataaatggaagggcatctgaactggcaaattacattcaccagaggatcttcccttcctggttcctgtttgtgccttatgtcaatcttaccattgtgtgcaatctggcacgctgaacaaggtgacgtatgtgtcctgaaaaatccaacaggtgaccactagggtttgccccttttaaagctgacagagtgttgtcactagcattttggggtgtgaacaatacagagctggtgtcttccattgattgaaaccaggaattacaaaaccaaattgatttaactgaggtcttaggtggaaaaaacacttgtgtgtgactgcaaggattcgggctccctctctgatcacagttctaagtctcttcttgtgcaggatattcaacctaagcttcctgaatgcaaggcccaaggattgtgtgtactggggccggtgggcctctcctgttgaaaacccttggggagtggtccccaccaggtctcgtgttaggcgccagtttgggctcggcacgagatacggtgtctaagggcccacgcgggaatcgaaaccccggaaattgtatacacggtgtttttctcgcacaccgccaccttcatataaggtgg

SEQ ID NO: 631853 - DNA, 461 bp, Homo sapiens
  misc_feature (24)..(24): n is a, c, g, or t
  misc_feature (36)..(36): n is a, c, g, or t
  misc_feature (353)..(353): n is a, c, g, or t
  misc_feature (362)..(362): n is a, c, g, or t
  misc_feature (395)..(395): n is a, c, g, or t
  misc_feature (407)..(407): n is a, c, g, or t
aaaaaaaaagacccctaaaaagcntgaaagtttaantgtctccaattcttaaattatcatcgtctagatgtacatttatttgtcagcaaccttgtctgatttgaaatagatgatatgataaaacatgccattaacatgagtagtttatttttgttgggctccagagtgtaagaatattttattttttgtttgacatagtgaagttgacttgcgtgaataacaatccagcatgctttcattcttctgaataacacagaataactgtggctacagctctggattagttgtctattccagttagaggatgtgtgacattatggtttgggaatagcatatttctaaagcataatatnataccaggnaatagtgaggctctgttttccactttatctttnccatccacccanccatccatttaacagataattaatggagtggcctatcttagggtggtaatgttt

SEQ ID NO: 631854 - DNA, 162 bp, Homo sapiens
gtctccccttctcggaaggcatcactggcatgcgccacagtgtaggcctgcgggtcccgggacgactgtacgggtcctgccgctctgcccgaactcctcctccaccagcgagctgacaccaaactcttggtccatctcctccaggagaacgcgtcaaaatcg

SEQ ID NO: 631855 - DNA, 148 bp, Homo sapiens
tagaggatccccataggaagtctgaggctctgaaattttgaaatcgaccgatgttggacagagttcagatgttctatgactttggtttcctctagactttgagttccacataagctggggaggcctcacaatcatggtagaagacaag

SEQ ID NO: 631856 - DNA, 254 bp, Homo sapiens
  misc_feature (86)..(86): n is a, c, g, or t
  misc_feature (179)..(179): n is a, c, g, or t
aggacaagccctccaaaaaccccatactaagacacatcacaattaaactcctggaaactaaagacagaaggaggaaaagtactaantgacagagagaaataatgccttgcctagagaggaacaccagtttgaatgaaggcagatttcttaaccaaaaccacaaaaggccagaaagaagngacctgccattgttcaactgtaaaggggaaagagctgttgactgtgagtcctctacccagcaaaactatccttca

SEQ ID NO: 631857 - DNA, 194 bp, Homo sapiens
accgcggtgcgctcatgcatgagagctcctttttttaaataaaatatcaagcttagagaagtctagagaacatcattgcaatgccctatgcacccgtaattcagctttgttaattcctatcactttgccatgttcgcttcagatctttttgcttgatttaataaataaatcattgccgaacacaccacggcggc

SEQ ID NO: 631858 - DNA, 277 bp, Homo sapiens
  misc_feature (165)..(165): n is a, c, g, or t
  misc_feature (194)..(194): n is a, c, g, or t
ctagggttgatgaataccctttactgagtcaactattgctttaaagaatttttttgtaggtttatgtactcattttagttagcatctacctctctgggaaaatgaaaggagggttgacttagggatgagtatagatgttgaaagacaactatcaaaccatgtggnttgaatttttaaaattgtaaaacattggngtccaaacctcccaccccacttgtatgtaaaggacagtgagttttgtataaatagtaaactataagaagcatgaattttcatc

SEQ ID NO: 631859 - DNA, 155 bp, Homo sapiens
  misc_feature (71)..(71): n is a, c, g, or t
  misc_feature (78)..(78): n is a, c, g, or t
  misc_feature (105)..(105): n is a, c, g, or t
  misc_feature (115)..(115): n is a, c, g, or t
actactgcaaggctacaggctcccggacgtccctgctcctggcttttggcctgcctctgcctggccctggncttcaangaggggcagtgccttcccaaccattcnccttatccanggctttttgaccgctatgctccgcgcccatcgtctgcacc

SEQ ID NO: 631860 - DNA, 673 bp, Homo sapiens
  misc_feature (21)..(21): n is a, c, g, or t
  misc_feature (90)..(90): n is a, c, g, or t
  misc_feature (102)..(102): n is a, c, g, or t
  misc_feature (104)..(104): n is a, c, g, or t
  misc_feature (115)..(115): n is a, c, g, or t
  misc_feature (128)..(128): n is a, c, g, or t
  misc_feature (153)..(153): n is a, c, g, or t
  misc_feature (160)..(160): n is a, c, g, or t
  misc_feature (164)..(164): n is a, c, g, or t
  misc_feature (189)..(189): n is a, c, g, or t
  misc_feature (197)..(197): n is a, c, g, or t
  misc_feature (200)..(200): n is a, c, g, or t
  misc_feature (202)..(202): n is a, c, g, or t
  misc_feature (212)..(212): n is a, c, g, or t
  misc_feature (218)..(218): n is a, c, g, or t
  misc_feature (220)..(220): n is a, c, g, or t
  misc_feature (225)..(225): n is a, c, g, or t
  misc_feature (231)..(231): n is a, c, g, or t
  misc_feature (236)..(236): n is a, c, g, or t
  misc_feature (249)..(249): n is a, c, g, or t
  misc_feature (263)..(263): n is a, c, g, or t
  misc_feature (315)..(315): n is a, c, g, or t
  misc_feature (344)..(344): n is a, c, g, or t
  misc_feature (377)..(377): n is a, c, g, or t
  misc_feature (533)..(533): n is a, c, g, or t
  misc_feature (560)..(560): n is a, c, g, or t
  misc_feature (651)..(651): n is a, c, g, or t
ggacccgcgccgaagaccagngggcccaggaagcctcttcccgaagcctccccctctccagcccctccactcctgggagggcatctgctncggccagcggancnccctgccccanaaccccggcaaangcatatccaacccacccgtgtcttnttccctntgancctccgggtccggcggggtcctcangggaacangtnangcccccccanctcctnantccanccctangtctnggcggctccttanggggcggcatcgcnggctctttccctggggcctaggtccccccgctggccgtcccactggaatgtngcagctgatgtgggcaaggaaggcgctcntcccctggccgcattgtcctctccttctgcccntcggcggcccgctacacaaccgctctcctggtcctcccgctggatcatctggtagtgctgccggttctccaggtaggcggccagctcggtgtcctgagccttctcagcccgctgccggggagtgtcgccctgctggtctgtcttcatgagcgaggncccggcctccacgatgtagtggcaganggtgcgctggcccagggccgctgcttggtgcaaacaggtctccccgttttcctccaccgcatcaaggatctctggggggggcgtggtccancaggtagcggaccacatccttt

SEQ ID NO: 631861 - DNA, 1005 bp, Homo sapiens
cttctgggtttccaccaattggcaagaagggatcagcctgtcctagagatcactcctctgccaaagatcccaacaagacaacatggctcccaagaagcctgagcctaagaaggaggcagccaagccaatgaatgtcaagatgctggactttgagacgttcttgcccatcctggctccagctccagctccagcccctgcaccagcccctgccccagctcagcacatttcccgcaacaaggagcagggcacctatgaggacttccctgaggctcccaaggaacctgcctttgaccccaagagtgtaaaggtggagggcctgcgtgtctttgacaaggagagcaatggcactgtcatagacttcactgccgaccagattgaagagttcaaagaggcctttatgggtgctgagcttcggcacgtccttgccaccctgggagagaagtcattgtttgaccggaccccgactggagagatgaagatcacctacatgactgaggctgaagtggagcagctgttagctgggcaagaggatggccagtgcggggatgtactgcgggccctgggccagaaccctaccgccaatggctgcatcaattatgaagcctttgtcaagcacatcatgaatgccgaggtgctgcgtgtgctgggcaagcccaagcctgaagagtcagggtgaagcagagtcttccaggtgcctgcccttggctttagccataccagggtgagttaaagagaggcccggctgggtgagctgagatggagtcctcgacttatcaccacaccactgccccaaggacttacaggccctccctgttaataaacagctctaacacggccaggctgggctctgtgaagcagagtcttccaggaccgcaagaccaacccttcctcctcctcagcctactcaacctgaagacaaggaagatgaaggccttgaagattatccacttccacttactagtaaatatattttcttttccttatgattttcttaatttttttcgg

SEQ ID NO: 631862 - DNA, 747 bp, Homo sapiens
agccaaattttaaaatcttttgtagagacagtgtctcactattttgcccaggctgggaatttatttcaccaatgttttatagttttcactgtagatatctttcacttctttggttaagtttattcctagtcattttattttgtttgtagctattgtaaatgcgattcctttttaaattttttttcagattgttcactgttggcatatagaaatgctactgatttttgtatgtttgattttgtatcctgcaactttactgaatttatcaattctaataatttttgatggagtcattaggtttttccaaatatatgactatatcactcgcaaacaaaaaaaaaaaaaaaaaaaaaaaaaaaaaacaaaaaaacaaaaaaaaaaaaagaggggggcggggcgcgctccacaaagatatataccccccgcggggggggcacccagatttggcgcgcgctcccccccgagttttttgtgtggcacaaaggtgggccccccctaaagaggggaggcccgttattataaacagcctgagcgacaggtgggcgcgcgtgtttatacaaacagtctcgaggtatggggggaaaacatttgcccagttgcgggaacatctcttgtgggagcagagacacccttcaaccttcgcggggggggggcacacaatatggtggcaccaaacgccctccacgaacaatttttcgacggctcataagggacagatcataaacgtttaaaggtggttcaacagtg

SEQ ID NO: 631863 - DNA, 253 bp, Homo sapiens
tacttttccacggaatagtgtagttgcactagaagtggagagatcttgaatgcaagacatttctaagttagaattattaggatttgaacaatttttctgttggttttttttttttgtggtattgcgaaaaagggtataagaataaaaaataggaatattccatgtttgtgacctttgtgtgtatttccctaaggccctaagggcctataacaggccaggtttcctctctctaccaaacagtactccattacta

SEQ ID NO: 631864 - DNA, 406 bp, Homo sapiens
attgaaaatgccagttgttgtttttttggggtaatatccccaaataaaatataggtaggggtccatgaatttaaccggtttttttttgttccccatttggctttacttaaataatctttcatatttttaaagggtttggcccaggggctggggaacccttgaagtccccagaataattaggactcaaattcagcccaacccaggattagctttttgtcccatgagtaacccagggtccgggccccagcaaaaagaatgtttatgagggtcagagtaagatgaccaattgcaccataatattttttaatatggtatccggtaaatttattcagcggccctggtttactcccagttggtttatttgcccccataaaaaagggtccaataaaaattcaggtaatcccca

SEQ ID NO: 631865 - DNA, 330 bp, Homo sapiens
gagtctcgctctgtcgcccaggctggactgcagtggtatgatctcagctcactgcaacctccgcctcccgggttcaagtgattctcctgcctcggcctcctgagtagctgggattatagatgcccgccaccatgcccggctaatttttgtatttttagtagagatgggatttcaccatgttggccgggctggtcttgaactcctgacctcaggtgatccccccacctcagcctcccaaggtgctgggattacaggcatgagccactgtgcctgggcttaagttttttatagatgggaaaaccgagggtccaaacgtgagcaaagggctct

SEQ ID NO: 631866 - DNA, 247 bp, Homo sapiens
cgctatccggaccaggtcacagccaccaccaagagcggagctaacctgagcccacagccagcctgtgcctgtggccggtggccgtgaccagcggcgaagacaggtgctcacccgtgtgaatcggctgaagctctgaagaatctcccagccccagtcctggtatttgcgtgtcccctgtgacgcggtacaaggtagaacaggctctccacggtctctggccgcagcaggttgtgcctgtctgctggct

SEQ ID NO: 631867 - DNA, 207 bp, Homo sapiens
caatctgtgctgacaacgagtaggaggacatggacatagtcgtctatatggtttcatactgtcagacagcagctgggagggtgagccctgtacctcgccgctgcccccctaccaccaccaccatggctctacctgtggggcttgtacctgaggtgatagtgtataccgcctgctttgtgcttggaggtactcctagcagcttgtggg

SEQ ID NO: 631868 - DNA, 495 bp, Homo sapiens
ccagcctcaccaataaaaaaataaaaaaaatatgcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgttctccaaaaaataataataatataattaaaaggaatgttttattccttttagttccctgtttgagatctcacttgatcggtaagaagaaagttaaggattctcttttgattttttttgatatagatttttaaattctattactttatagtagggtgggggtcaatattcttggcttaataatagaagagcattgattattctcttggctttataatagaataccatttaaataggagttccctgagtgtgttacaatcatttgatctggctaaactatttcaatgttaatgaatttttaaaatttgggaggggtaccgagc

SEQ ID NO: 631869 - DNA, 400 bp, Homo sapiens
gcggaatcaccatggcggctgggaccctgttttcgtatcctgaaaactggaggagcttcaaggctgcgatcgctgctcagcacagcggggctcacctccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaa

SEQ ID NO: 631870 - DNA, 751 bp, Homo sapiens
agcgggagtggaagtgtctggctccccgtagaggcccttctgtacgccccgccgccatgaactcgtgctcacgcgaacagggccgtcgttaggctggctctgtagcctcggcttaccccgggacaggcccacgctcgccaggtagtggggcagaccgtctgaggactgcctccctaggtcagcgtcggcgtcgcgctgggacctggaagcgggagccgtcgtgagctgaaaggaggagctccagatggacggtggcggcggtggcagcgcaggcagcgggcagtagctccagcatcgccagcaggctgggatcgaggcgtcaacatggcgagccgcgtcgtagcagatgtccaacttctgctggaagaaaactgactatccagcgaacaacgacttagcgtgttatggcgtacaaatgatttgatgacggaacttgcagaaggattcgcatcaagtgtggatgatgatagtgagaaggaaagtagtgacaatgatgtgggaagttatgggaagatcaagcctggcgaggtacacgaattgagctgtgcgaatgtctatggtccttttaggtgagtaacagtgacaaagaataccaatgtaggagacaattggtagataccctctgggataaggatgcttttctgataaggaccaatgcgagaatttcaagtattgggtcttaagaaggtaatgggagaacttccgccgagcctcccagtgggctctgcatttaggtggttaattgtttgta

SEQ ID NO: 631871 - DNA, 445 bp, Homo sapiens
  misc_feature (30)..(30): n is a, c, g, or t
  misc_feature (38)..(38): n is a, c, g, or t
  misc_feature (198)..(198): n is a, c, g, or t
aatcacggagggcctcctccccactttaangggttaanccctttttggccccccctggtaggttaaaataaagtatccttggtagaagaggatcatcccaactttcacctcacctagttttaagcatcccattgaaagatgttcaccctgaatcaatcaagtacccacaatgattgcccaaatacagattttcctaantccatcattccttttacatttgttggttggcattaccctaaaaggtagagctttcccttctctccaatttattcattgatttatatcatgtggacttgtggcttattttatttgagaagttgtaatttgttcgtttgccagtggcgaccccttcaagctggcttctgtgtcctttggtatgtccccatcattcttggagcatgttcttactttctaatacaaaaagacattccatggtcaaaaaaaa

SEQ ID NO: 631872 - DNA, 119 bp, Homo sapiens
  misc_feature (11)..(11): n is a, c, g, or t
  misc_feature (26)..(26): n is a, c, g, or t
cccaccctggnctcccaaagtgccgngattataggcatgggccactgcacccagcattgaaaaaatttcttttgtagaaatgaagtttcactgccttgcccaggctagtcttgaactcc

SEQ ID NO: 631873 - DNA, 188 bp, Homo sapiens
ggggggggggggcctttttttttttcccttttttttggggggggggcccccggggggggtttttttttttgggggggggggtttttagggttccccttttttcccccccccggtttttgggggggggagggggggagggattttttttttattttttttaatttttttttaattttttttcccccgga

SEQ ID NO: 631874 - DNA, 356 bp, Homo sapiens
caccagatgctcccaccatgtcttaggagggaggatctggtgcacttataaggatctgggtctgtcagtgtcagagaaggtaggatctggccctggtatgaggatctggatctgtcagtatctgaggaggtagggtctggccctggaggatctgggtctgttcatgtctgaggaggtaggatctcgtaccagtatgaggagctggttctgtcaatatctgaggacgtaggaatctggtacaggtttgaggatttgggtctgtctgtatccaggaggtatgacctcgtacaggcatgagtatttggtattgcagtgtctgaggaggtaggatctggtgtaggtgggagcatctggtg

SEQ ID NO: 631875 - DNA, 338 bp, Homo sapiens
ggtcgtcagaggatcccgtctacatagtgttagcaagtataaagcacgttctggataccatgggtagacacagaagagacatagcctattacctttgttttccttagttttctttttttttcttttcggagacaggtactcactcggtcacccaggtgggagtgctgcgccttgaccacagctcagagtagcctaaacctcttgtggttcaggcattctacccccatttcagcctccaaaattagcggggacacacgagctggggccaccatcccgggctattttttttttttatattttttgtgggcaagaaggggggtctccttggtgtcccgggg

SEQ ID NO: 631876 - DNA, 1005 bp, Homo sapiens
gaagcttggtgtgcacgctatgtgacggcttatggccattaggccccttcacgtggatccatagaacgcgtttgtcccagtcacccaggcttgttaccggaccggcattgcctagatttaatacgcctcgctatcgggacactttgtactagtaggctaggctggcgtaacacttgggcccctcaaggattacttctagagcggccgcgtctaaaggcgctatcaggaccgcgacaagccagcccagatccgacttcagcaacattattcggcgccaataggcgtgttgcctgatggctaataagaacaccgccttggaccacaagaggaagatcggttaaactgattcacgattgtgaaaagggtgatgtaaccagtcagcaaactgagtgcagaataccaattctgaagaacaggtgcagagtataacatccggacagcaaagaatgctggttggagctggactaaggctcagcgatataagcaagcaggaagatggacccacatcagtagtcatcattgctgggctcccttctaagattctgtaccaagctatcttcagaaagggatcaacccaaccatcattctgagtcattcgcagaaggccctggaaacggcattgaaatcttgattgacatgtctcgacctgtggcactgggtgcagacgaaccttggtaaatagtgcaccacttaacagtgcactcaacggggttccagtatcaaggtctgttgccccatgagtgaacttcagtgattaaagttgttgccccgcacaagcagcagggaccttaggtcatacaatcgcacacggggcgagacctaagccgggtaagaaatagtagacagaccagtataatagaagcagacatacatcacgccaacatagccaaacaaaccacacacaggaagaaaaacagacatagagataaacatagaaaaagaaatctgagctaaaagaatatacacaacatgacgtagtatttagtagtagacacgaatagacta

SEQ ID NO: 631877 - DNA, 558 bp, Homo sapiens
tcccctgccaggtatctctaccttctctcatggtgactcgggatcaactggccctggctcctaagtaagggcttccagaagggggccagtaattagatctgatctcattcttcccactcagatgtcctcaaagacacggctccagaaattcctaccctctccggtgtcatcggttcttctctctactaaattcaatcccatcagaatcaggcagtgccactagcaactctccaactttacacacacaggcagtgcagacacatacacaaatgaagcccacaagccctccagtgacggcaccatttctcaacaccccttcagggtacaactataagagtggtctccataccttatctcgcgaggtggcgggtctccttccattctctcaggctcataccaatccgtccagggcaactggcctttctcaaagtaccattcacctctaggggtcactcatcagtccttatctaacccaaattcttggttggacagagttgatctctcttcccttgaagctttcttcagtgggttaaacggcacagcattctggtttgcctc

SEQ ID NO: 631878 - DNA, 940 bp, Homo sapiens
tcgctcctcaccgtgggcgttgtgggcggtggatatgactgtgcgtgtagccgctggttacacggtgtttcttacaccggtgtgtgcaatcttgtggtggccactgctaatattgcgggccctgttttggcctcccggtaacgtgtttgcgatggctatttcctcgcttttctgtgggtgagtaagccggtctcgcctcttaggagggatgtaacatcgacccgcctgtgtttgtgcgcctcgaccagggccctgttgcctgcatatcaacgagaacattgtgctgcgagcaaactaatgcgcgcgaactgccccagcaggggcgccacccacgtcgggggtcctcgcaatatctttttggcagcctctgacaaacagacaccgtcggcgtcccctgggtgcttccgcagttctccggtgtcccctggaaggttgtcttccgacgatttcttcaagtgcgagttcatcccacgggaggatgtgttcccgcgcactgtactacggtgatgcgggcctaaggtctcctccccccggccggccacccggttttgggggagacccccccggatgtgacggtcccacctcttgtgtgagatctgtggctccatcataaggtacgcccaaagggctcgccgccttctcgcagaagcccacgaatcgcggcggtgcagcgctcgaaatggactaaacaccgggggccggcacggaatcctgtcgggagccaaggaacgccccacggcctggtttttggaacaaaaaatgtgtactccgggatggggcccacacgcaacgacggggcccagaacccccccatatcaccggcgacaagacgatgaagaggcaacacgaatggtccggccacacaccaacacggagagcgcactcaaccagcctcccaggagacagggggacttcaaaaaaaaacaccccaacaattaac

SEQ ID NO: 631879 - DNA, 289 bp, Homo sapiens
gggggggaaaaaaaaaaagggccccccctttttccccgggggcccctttaggggcccccccccccccatttgggggggggggttcccggggggggggtttccccttttttttttcaccaagggggggcccccccccttaagggggggggggttaattttcccccccgggggggcccccccgcgggtttttttttttttttttggggggggtttttttttaaaaaaaaaaacctttttggggggcccttttggggggttttacccccccccccccccttttttccgggga

SEQ ID NO: 631880 - DNA, 948 bp, Homo sapiens
tatcagaagcgctgatggtcatatccaatctcaatatctgggtcaatccacaccctcttagaactgaggggggcctctggtgtctcgcgtgattgggagaatatggtgtactagtaaatcggtgtgatgtaccttcttcaacagtatgagcacagttatagacattcagagtagaaccacttgtggatgggaataacccaacaagtgccgatttcaggggcgggtgcatgtagttattattttacagatagaaactacccctaccgactcatctttccttctctaagacacaaagtgattggttatttgggtaccgtgagtaacgtaacagaagttcaaaaggcagttgctgtggaatacgagtgggtatattgggggttctgttggctttcgaaattttcttcttgggatgtgtaaatgtagtcaatgatgaggtaagtgcgcaaatgctgtagctgtttgctcacgtgactgccaggcccatcggagtgtaagccggggttgccctctatttggtttatttttgccacgttatgagcacgaaatggtagaatcctccacggtgcttcctgcgtttccgtgacaagccgctcggcgcatggcctggcgtgaaaatctggggcttagaacgcggtcttgcggtaacagccttcctctgatcgcactcgcccctcggcggagcaggtatcaatcgttatactggtaacaacaaaggcgtaactatatgaataattgatgcgccaacacggactaatgacgatgtggcgattttactagactgcacgtcaaacaaaaacggggcgcaaagatcacgaggggccaagtacacaacaatgttgaaaaggccacaaaggaggataaaacagaccatacaaagcggacagcacagaacgaaacaaggggaagacacaagacagaaaaagagacaatgccatgctaacaacgaag

SEQ ID NO: 631881 - DNA, 115 bp, Homo sapiens
gtggacgcactcgggaattgtaggaggacgaggctcaactcttgccaagccaaattgagacaagtcttacacaagccagagtgtgggcaaggctaactctgctttcaagcttaag

SEQ ID NO: 631882 - DNA, 415 bp, Homo sapiens
tgttttgaagaaaaaaagaactattttgaagaccgttttggagagggtcctcttgtaaaggggattcccgaagaccagaacccccttaaaaaaaaaggccgctgggtttttttattaataacttggggggaactgcctcctaagtggaagaactagtttgttttagttttccccgataaaacccccctgctttttaaggaaggaagaatggaatttaaagggggctttttttagccccctatagataggggtttggataaaagcatatggggtactcctctttgccccctatgccgtttttttttaaaaagccaagaggttccgatggtccattttgggaataagaacctttcttgggcctggcccttttttccggattttgcttgatgcttccaaaaaagttttgttttgggga

SEQ ID NO: 631883 - DNA, 379 bp, Homo sapiens
aaatatgtaagatagcctaagccataagaggttcccaagaggagaaaatatctatcctgcttcaattggaagagtaaaaaacactgaagatcaagaggtggggaaaagactttctaggaagtggagaattatgtgtactccaagcacttgcattcacgaatttgcatgcccaatgaataagtccaaaaatacacaatgtgtttatccaaataaagagaaagatgcttcagctgcgacagtagaaaaagaattcatggcggcagtgaggctttcccgcgaacaccaaaatggtccgatctgaggggcaaggtactcccggacggcagaacctgcacaaacagatgcatggcactggatcttatacgcctcatgcatcact

SEQ ID NO: 631884 - DNA, 385 bp, Homo sapiens
  misc_feature (170)..(170): n is a, c, g, or t
  misc_feature (183)..(183): n is a, c, g, or t
tgcatgagagtgcccggtattgaggtgcacacgagatatttgatacaggtacacaatgtataataatcacatgagggtaaatggggtatccatcacctcaagcatttatcatttctttgtgttacaaacagatccaattatactattttagttacttttataaatgtacnagtaagttattgnttgaactgtagtcaccctgttgtgctatcaaaaactagatcttggctgggctctctggctcatgcctgtaatcccagctctttgggaggctgagatgggaagattgcttgaggccaggagttcgagcccagcctggttaacatagcgaggccccatctcagtcaatcaatcaataaaaatatatgtatattcttagatagca

SEQ ID NO: 631885 - DNA, 143 bp, Homo sapiens
ggtatagaaactgtattcaagagtcaggtcagagtcttcttttcttttctttttgcgatggagtcttgctctgttgccagactggagtgcagtggtgcgatctgggctcactgcaatctccacctcccggcttcaagctgcta

SEQ ID NO: 631886 - DNA, 332 bp, Homo sapiens
  misc_feature (321)..(321): n is a, c, g, or t
acagtagactgtagtgtgaggctcgcgggggcagtcgccatccgcccccgccctgaacgagctggtgtcctttgaggacctcctgtttgaaaagaaatttcagtcttagaaggcagcaggctcggtgtccaagagcacgcagtttgagtacgcctcgtgcctcgtgcggaaaagagacaatgatgacatccgtaaaggcatcgtgctgctcgaggagctgctgcccaaagggagcaaggagggacagcgggattacgtcttctacctcggccgtggggactaccggctcaaggaatacgagaaggccttaaagtacgtccncgggttgaaaa

SEQ ID NO: 631887 - DNA, 340 bp, Homo sapiens
cttactctgctaagttcacagtctgctgtgttttgctttggtactgccttcgttcttcgggtttccacaagtacagtcttgttttgtgtttttggtttacttgccgtgttgcatatctgtagaaagttgcttattcactggccttggttccattgaagtctgcgtctcgagtagtccgttatcctcctacagaaccatctagcattttcaataactctacgtcctccagaccttctagaaggaacgaaagaggtctcgtttcctagcctgagcttgctcttgagtgcgttcacctcgcggcccatggcctcgttgctctccgtggcctcatcctaccaaa

SEQ ID NO: 631888 - DNA, 1867 bp, Homo sapiens
agacagcaggaagaggggatgtgtgaggcagcccattcacctggggaacatgactgggttgtcgatggacggtggcggcagccccacaggtgggactgtggcacccgttctactatgactatgagaccgttcgcaatgggggcctgatcatacgctggactggccttcatcgaggggctcctcatccatcctcagacagaagataccgcaagatgcggggcaataagaagcgcaggcaaactcaactgaacgatgagccgtaacagcagcactcaggcaggaagacacccaatgaacctggggccagctgggaacgacaagcatggcccatgactacctggaagcacaccccaacaacccagggccaaagcacctttgtaccacgacactgacagagccagggcatgacaggaagctccagactcaatgtgaccaccaaggtggcattagcacaacgaactgcctcgtgcaacctcacgcccactacatacagccggcgacacagacagcagactcactcacggaccacaacacacaccacgcaccccccaacccacgtcccgccaccacggacctagacaacgactagcaccaccagaaagcagccgacccaaattaacacacatgaacacagtccccagagacaggcaccgaacgacgcatcaaacaagaaccggggaacgaaagcaaacacagccaagaatgacaaccaaacacacaccaaaacacacggcaaaacaacaacaagacacacacacaacgaacccaaacaagaccatatcaacggagcacaatgcagacgcaacataaacgatagaaaaaaaacaacaacccaacacaccacacaccagcccaaaccggcgacaccgacaaacacccgaacacaaaccaacaaaaacgacaacaagaccacccagacacagcacagcccaccaaccacacgacaaacagcacacaaacgcccggcgcggcacgaggacaagaaccaacgcagaggcggccgcgcggggcgcaagggacgagcagcggagagccactcacgcaggacacacgagaagcagaagtgaagggagaagagcgaggtgaataggcaggagccctgcgcagacgcgagagacggcgaggagcgacaatcgcagaacgcgatcagacgaggagcgccagcgcgaggcgagacgagaggggacagagacgacggaagggacagaggacagcgtgatgaatccccggcgctcgagacgaagtaggacgagacatgcgccgaacccacgggcgactagaacgcacagacacccggccctcacgccacgaagcgaggcggcagagacacggcgccaacatcatacccgaccgtactcgggagccgcaacgcacagaccgcgaacgccgcaccagcgaagcgcacgccgagccagcataacggcgaacaccagcagcaacgcgaccgagaccgcacggcatcagacggaggagggagacgacagagcgcaagcaacgaggagaagaagacgaagagcgctagagcgacaacgacacaacgagctgcagagtcgcagcaacagacgcccgggtagtcagcatagagggcgacgcctagaagccgcaagagtcgcgagcggagggaagccgaagcggaaagcgctaactgcggaacgcagagtaggatcggagtagggacgcccgaggtcaaaacgaagaagcgagcaacagcacctcgtcagcgccacgaacagccagggctcctgacgagagccgaaagacgagcggcaggaaagcacagcgggacgagcgagcgacgagacgcgtggagagcagacaagactcgcagaggaggcaccacgccagcagccagaccgagcagaagcgg

SEQ ID NO: 631889 - DNA, 628 bp, Homo sapiens
ttccagatatgaaggaggaaatggctcggtcaccgtcgtggatacccagacctgctcaatgttaagatggccccctggacattgagattgcccacctaccggaagctgctggaaggcgaggagacaggatttctctgcctcttcccaacttttcgctgccctgaacctgagggaactaatctggattcactccctctggttgataccccactccaaaaggacacttctgatttaagacggttgaaactagagatggacaaggttatccacggaactttctcagcatcacgatggaccctggataaaaattgcacacactcagggcagccatatatgtacccgccagagattaaaaagagaatccatatcttaaagaaaccagctttcaagtgcccttctgccagtttttcaggagcgccagatagatttggaataggaataagctctagttcttaaccaaccggacactcctaccagatttagaaaaaagtttaccacataatttagtttaccagaaaatcttgtgctagaatacttttttaaaggtattttgaatacccttaaaactgctttttttttcccagcaagtatcccacccacttggttctgcttccataaatctttggga

SEQ ID NO: 631890 - DNA, 126 bp, Homo sapiens
aattctgcaccacagcccaagcagaggtcttggctggatcagaacaagctgctgagttgccatcaccaacttcagccgggactggcagagctggccgggccctgggcgccctggttggacagctat

SEQ ID NO: 631891 - DNA, 1338 bp, Homo sapiens
acataagataatatcataccacgagagaaactccaatgaatataaggcaatgtggcaaagcttacaaccagtcctcacaccttaccagcacataagataattcatcactggagagaaaccctacaaatgtgaagaatgtggccaaagccttataaccagataccacacaccattaccagaccataagatacattcaatactggcagagaagcccgtacacaactgatgaagaatgtggcaaagcctataggcagtcctcacaacatatactaaagaataagcataaagtctcatacttggagagcaacaccatacaagatgtgacagcatgtggaaaacagacttgaaaccaagatgctcaacaacttacgtagaccataagagcatgcaatacctggcagacacacacgcccgaagccaaggaggttgcaacaaaaaaaggtgagcaaccgcatgacataaaagacgaaacaccatcaacaaacataaacgtggcacacactcaccgaagcacatgcaactacctggacagcagaaccacccagaacccaaacatcgatgaccacgccatggtcggggacaaagccacgagaaaaacacaggagactcaaacaccataaccaaaacacaaatacaaggaaagaacaatacgtgggaaaggacaaacccgacacaaaagagactgcagccaacgggagccaaacagccagaaaaacagccaggaccgcacgcaacacacagcaacccatcaagacagacccaaccaacaccgggaacgaacaacaaaaccgtaccacaaaaggcagacagcacaaaggcggcccacgacccaaacatgaacgaaaagccagccccagtacaacagacaaccagcccacaacacacaaccgagaagaaaacacacccacccaccacgggcaaccacacgcgccccacaccccagacaacaacacaacacccacacaggacaccgaacacaggataacacacacacggaaacagcaacaccacaaccaaggtgacgaaaccgccggcacacggcagataccactacaactcacacccactgtacgtacagtacagagaagcacaagatggaaagaaaacacacgacaacagaaagacagacgctagaatcagagtaaacaccaagtacaaaaaaaagaagagcaaagatagaagcggagaaagaacacaaagcagaaagaaagcagagaaagacgccacagaaagtaacaagaaccatggacagacagacaggaagaaaacaagcgaaggaaagaagagcacaccaagagtgatagaccgtgctaacatcacaccattaagagggaagag

SEQ ID NO: 631892 - DNA, 911 bp, Homo sapiens
tccacctccaccaccacctgcctacaactatgggagttacggcggttacaacccggcccctataccccaccgcagccccgcaccgtaagacctaccctcagcccagctataaccagtatcagacagtatgcccaggcagtggaaccagtactatcatgaaccagaggtacagtggtccgccatactacgtggaactacgactacgtggagctactccgtggaacacatcagaggtggtacacgtacacagtagccagtgtgacccagagggctcacacggacgaggacaccatagccgggcctatccgtcacaacacgagcgaccatgacctacagagaacccaatccatacgtggccaccccagacagacatacaccgaagggatgactgacggaatggaggatacaacacacaagaggaactgacccaaccacatacaaagacaaacagctggacccctccgccgcgcgtccatgaagggagacgccttccccatttagccccccagtcacacgtaagagaggacaccaagggaacactttcatacacagcacgtggggactgagcacaggaccaagaggctagcaccacaagtgggacagcgataatagacaccataccacactagagcacagggacaccaacacagacgacgagacaacgcacagaagacaggtatacccaaacgcaatccaacaatgggaagaccacactgcagcaaaacacgcactgcaacgcaaacaccctagaacacacgggaccactagccaggtgacaacgtcacaacaaccaaaagaaggaccacacaaaaagcaaaatcacagcaacacagcgagaagacgacctcaccaaagccagaaccgcaaaaaacgacacaacaacagccaacagatcaaacacaaccacacga

SEQ ID NO: 631893 - DNA, 499 bp, Homo sapiens
  misc_feature (1)..(1): n is a, c, g, or t
  misc_feature (107)..(107): n is a, c, g, or t
  misc_feature (196)..(196): n is a, c, g, or t
  misc_feature (234)..(234): n is a, c, g, or t
  misc_feature (249)..(250): n is a, c, g, or t
  misc_feature (284)..(284): n is a, c, g, or t
  misc_feature (286)..(286): n is a, c, g, or t
  misc_feature (288)..(288): n is a, c, g, or t
  misc_feature (292)..(293): n is a, c, g, or t
  misc_feature (302)..(303): n is a, c, g, or t
  misc_feature (322)..(322): n is a, c, g, or t
  misc_feature (334)..(334): n is a, c, g, or t
  misc_feature (339)..(339): n is a, c, g, or t
  misc_feature (369)..(369): n is a, c, g, or t
  misc_feature (401)..(401): n is a, c, g, or t
  misc_feature (403)..(403): n is a, c, g, or t
  misc_feature (414)..(414): n is a, c, g, or t
  misc_feature (445)..(445): n is a, c, g, or t
  misc_feature (449)..(449): n is a, c, g, or t
  misc_feature (462)..(462): n is a, c, g, or t
  misc_feature (464)..(464): n is a, c, g, or t
  misc_feature (474)..(474): n is a, c, g, or t
  misc_feature (491)..(491): n is a, c, g, or t
ntggttttataaatcctcctcttgaaattattgttcttggcccagcatggtagcttatgcctgcaatcccagcacttcgggaggccaaggcagaaggatcgcttgancccaggagttcgacaccagcctgggcaacatagtaagaccccatctctgtttttttttaaaaaaaagaaattctgttcaaaagtatttnagaccaaaaggaggtcataaaaactgttcatataattnctctatgagaaaaanntccctgtatgggaaggggcactgaagatctggcncngngaannggggggggnnagggcagtgataagatccngccctatttttntagcntgcattttcgaccttgtggatatgtctgtnctgggtgttaatagccccctccttgttttttngngggaattaagnaattaaagtgaatctgtgtgctaatgaagtntgcngttacagaatctntnaagccaagcntgtaaagtctgtaaggnaagatctt

SEQ ID NO: 631894 - DNA, 300 bp, Homo sapiens
cgttcattttccaaatgaaagatggtttacatatgaatcatattggcagatatttaagcctattatctcaaaggtgatggatattatcaacctagttgctgtggtattacagtgtcgtgactactcaaactctggcgatagactgggttgtctcaatctaacagtcaaaggtcatgcttaatgtgtacaagtcgtaaaaacttttaacttaccattactgatgcttggaggaggtggctacacaatccgtaatgttgctcgatgttggacatatgagactgcagttgcccttgattgtga

SEQ ID NO: 631895 - DNA, 347 bp, Homo sapiens
aaggatcccgacacatagaatgcatactagcatataacgattcttctgctcatgttctgaagccacagcagaaccttgattataagtgaccgacattgaggcagaagagttaaactctggctagatttcggtggtgccccggcaataatagtttttgaggtttggaatttactgttattttatgattaccatgtccccgggtggaaaaagggaagccagccatccaaataaccacttgcttgcccagagacctttccctcaaacagattgctttcaggaagctgcgagagaagtaggggcatcccttgtggtggtacctctatgtttaaagaaagaagaaaaaaacc

SEQ ID NO: 631896 - DNA, 622 bp, Homo sapiens
tggaaaaatgtctcgctcttgtcgcccaggctggagtgcaacgatctcagcttactgcaacctccacctcccaggttcaagcgattctctggcctcagcctccaaaagctgggattacgggcacattgccatcagttccgtggcataattttggtattttatagtagacaacggggttttcgccagtgtttggccaggcgtggtctcgactcctcctgtaacctcagcgtgatcgtgcccaccttcggcctcccaaaggtgctgcgaattatagacaggagccaccgctccccgaaccctcttctcactttctcgaaatcttcttctcctttttcccacctttcctagggtgttcaaagaacaggtggagtggctcctctgaggtttcaaacaccaagcctgacccgggataagctattttaccagcaaaggcattccaagtgggcttgctagcggggaatgcacttgtaaggacaaccagcgcttccctcgctacgggaacgctgtttgtccctaattgccaaagaaaccgccgcttgacgccatcccccagggagaacacctgctcctggtccaggccccattccccctcgtcctggtcctcgggttccgcctttgcccc

SEQ ID NO: 631897 - DNA, 324 bp, Homo sapiens
atccagggtcgcctatctgtattcccgcgacattcggtggcctgagagcctcaactacgtggcgtctggaacatgagcattctgcagaccctagacctcgtgaagtcatgtccaggccacgactgagaacaacggaactgaaaaccgtcacctactccaagctctgagagccctcgcgtcccaggccccagccaggtggccggccttgttccgccgtcatccacagaaagggaggatgggcgatgacagtggtctctatgccttctgacccattttcccaggttcataactttatgacgatcagtttctctagccctaccccgt

SEQ ID NO: 631898 - DNA, 139 bp, Homo sapiens
ggggtacatggacccaaaggacgtctggctctcatacttggcgtagcagcgctccatgtggcgcaaggcaacacgtgggttgatggagaggaaggaggagcgatacaagcggcatcggcagaagcagaagcacaaggat

SEQ ID NO: 631899 - DNA, 121 bp, Homo sapiens
  misc_feature (3)..(3): n is a, c, g, or t
cantcttttctaacagaaagcagctgaaaaatccaaagctgcacatagattagcaagctaaaagcttgcatagtgttaatgctgacagactgtgccaactagaaaagggagtgcctgcaag

SEQ ID NO: 631900 - DNA, 248 bp, Homo sapiens
  misc_feature (2)..(2): n is a, c, g, or t
  misc_feature (11)..(11): n is a, c, g, or t
  misc_feature (112)..(112): n is a, c, g, or t
  misc_feature (207)..(207): n is a, c, g, or t
anttcggcacnaggggggcgttgggaacggttgtaggacgtggctctttattcgtgagtttcccatttaccatccgctgaacctagagcttcagacgccctatgctcagccntcgaaccaaccggcggccttgagcgctgacaagcaaaggtggtctcgcggaggtgatccaggcgttctccgccccggagaatgcagtgcgcatgnacgaggctcgggataacgcctgccaacgacatgggtaagat

SEQ ID NO: 631901 - DNA, 263 bp, Homo sapiens
cctggtccatgtttagtacaggcgctgtcgccccggcgctgtgtcaaagacctgctgctgtcgatcgccggcggccgcagccaggaaaaacgcgcactggcactggtgcgttgaggaaaaaacggcccgccgcagcgggcctgagcaccgttaccggaacggcggttcgttgaaggtgcgcagcttgcgcgagtgcagacgatcgccctcggcgcgcagcagatcgatggcgcagatgccaatctgcaggtgctcggagatcg

SEQ ID NO: 631902 - DNA, 1168 bp, Homo sapiens
  misc_feature (567)..(567): n is a, c, g, or t
  misc_feature (633)..(633): n is a, c, g, or t
  misc_feature (998)..(998): n is a, c, g, or t
gcccttgccttcaatgtgtcctgatcagagagatcgacaaggcggacggcatgttctggagctcagtggaaccgggagaccaccagctgttcttcctccatgttccactttaacgatgtgatgaacgctcactcgtgacatcacatcacaagaccgtctacatcggcattgagtcccatgtgtgactggtcgacggctgtacatctctcgacgagatgcagtagttgacctagagttgaccaacatcccctgcctgatgctgagatagaggtctttcggatacctgggatcagtcctatttgattacccttgccaggataggattatcgctagtgcatatgccgtcagggggagttcttgtcgttgacggcacttattcaatcccaccatacgctaggtctccttatgtcgcctcgtgaaccgcggcccacacctatgagttgatgtgcgaccgccgtcgggcagttgaccattaccagggagcgatccaccacccacggatgcgacagtactactagggagagctcacacaccaatcgcgttagaatccagaatgcgccgttgggnatcacactcgggcgcactcttagccgagatggtcaatctagattgctagctccggtgggaaagcantgcaagcgccagtcacgatctgtcaaacttcaaggatagcacaaccaacaggccagacgattgcgatccaatcataggttcccaaagtacggatcggtagcggttctcatgtgtagcggaaggtttcctcaacgtgagggagattcgctcaagtaaagtcattagaagcttcgctttgcgcggatatagcgaatagggcaccgcttctaaagggaatggttaaccctttgtctgggaaaggtttcattcgccgccttttagaagccccaacttttgtcgccggtaacagcggtcgatttctgtaacgggtgtgcggttcaacacacaaggttatcacactattgataatggcccacaaccgaggnggtggtgttcctcgaacagggaaaacatttccaaccgcgtcgaatttaacttgggggctgtcgaaagacttgttttccccctttcaacgtgaattccgttaggcgtttccaattccccgggcgctaaaaccttaaaattagtttttccaaccgtttgtaaccatttcccg

SEQ ID NO: 631903 - DNA, 255 bp, Homo sapiens
  misc_feature (82)..(82): n is a, c, g, or t
  misc_feature (202)..(202): n is a, c, g, or t
  misc_feature (208)..(208): n is a, c, g, or t
cagggccctgggctcggttcagcgatctgctgtcgccatctggaaacgctttgttaggttgaataacggtccccccattttnattgtgcaccaggtcctgggatcgtggagcgggtcctgcctggcctggctgtctttccgggcgcagactctgtaagtgcagcccgatcgatagtccaggccgaccgggatgagtcctctnactctntggaggggcagccttcggaggtggcaggagttcctgaccgggcgtct

SEQ ID NO: 631904 - DNA, 651 bp, Homo sapiens
  misc_feature (18)..(18): n is a, c, g, or t
tgatgtatatgtaccacnttttctttttccaatcatccattcaggggcacttaggttgattccacgactttacaatagcaaatggtgctatgataaatgtacaagtgcaagtgtcttttttatgaaattatttattttcctttgggtagatactcaccagtggaattttagtttttgagaaatcttcatactgtttcccataaaggctacaagaatctacatccccaccaaaagtgcacaagcacgcaacagataattttaatgtgttttactcttccactagacactatgcatcttgagggcaagtttcatgccttattaatcttagtattatttccagtatctaggacagagaatgatataaagtcaagagtaataaatgattgctgaaataaattgaaattttaaattgcttggttccctaagcagccactttcctttactatgtcaaaaacagtgagtccttttcctttgccaatggcatatttcatatgcccaagagatgtgaaagcatacagcacaaagctgaaatgaaagactcattacagtattgcattagagctacgaagtcatattttgcaaccattctgtgccaccaatataattagaagatattgaactttcattagtttgggaagtcagctggccctt

SEQ ID NO: 631905 - DNA, 227 bp, Homo sapiens
ggtatctaaggatccccgtcccaggcacagtggtgaggaaaaatacgtctggacggcaggtgtcatcatcttaagtatggtaagcggctaggtatggattaaaccgtaatcatatctttttcctatctatctggaggcacggggggaataaaaaaccggtatattttacttggtggcagatagtctggccgcatctgggcaagtggcggcgcgagggggcgctcgac

SEQ ID NO: 631906 - DNA, 787 bp, Homo sapiens
  misc_feature (118)..(118): n is a, c, g, or t
  misc_feature (120)..(120): n is a, c, g, or t
  misc_feature (137)..(137): n is a, c, g, or t
  misc_feature (171)..(171): n is a, c, g, or t
  misc_feature (769)..(770): n is a, c, g, or t
ggccagacgtacgggcatgcaggccctcccctccagcccctcagcatccagccacatctgtggacacagccagcgcggcggagcagggctctgctaaggacagacggcatcaaggcangncctgggccgggccaggnctccctccccacagcagccctcttggcaggcagncagacgcccgtgagggtggacctgccatgagggcctgcacgccggaggccgcccactcagcactgcgggccctccagacagcctgaccaggcatccccgtaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgcccatcgtgcggggatcnntagagtcaccgtgggaa

SEQ ID NO: 631907 - DNA, 498 bp, Homo sapiens
  misc_feature (443)..(443): n is a, c, g, or t
cactgactcatccacgaacacaggctacatagaacttcgggtcctgagttccgacgacacggccgtctattattgtgcgagagatgtcaggggtgacacgtctatgatagttgtggactttcccccgcttgatcactggggccagggaaccctggtccaggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgagagcancacacgtatcgctgacagtattgtgcctgtgtctaagcccaggcctacgaaatcg

SEQ ID NO: 631908 - DNA, 247 bp, Homo sapiens
tcccccgcagtctggggcttggatgtgttagccctgctccacctgttccaacacttcccgtgtattcatgcctcggtagggtattcggcccttgatgatgagctcagtgagcaggatcccatcggaccacacgtctgacttgatggtgaatctgccacagagggcagcttctggggctgtccactttatggggaacttggaaccttggcagggtttgtactcgtcgtccttgatgagacgcgccaag

SEQ ID NO: 631909 - DNA, 455 bp, Homo sapiens
tgagagggagagacgcggcgtatagtagctcctggtccttgtactactgggtcccgggaacccgggtcaccgtctcctcagcatccccgaccagccccaaggtcttcccgctgagcgcagcaccccccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtatatgattgttcactcccagttccgatcaactctacctaccccatggtcctttcgattccgtactcataacccggggccgagctgattct

SEQ ID NO: 631910 - DNA, 1200 bp, Homo sapiens
ggcgatctttaggacctggcctgaccggtgcaaacccgcaatgcatgctttagcccgtcgaggacgtgtgtcccacaggccaggattgcgctgttacccaggctgtgagttcgcagtgagggtcgagtcatacttcacctagcagtccttgatcttcctgcgtgtgtcaagccgattggtcccatcctcaagcctcccaataagtaaagcctaggttagcacagggcgacattggccaagcgtggtcgatcccatatcagtatcatcgttgctgtatgagaattgttatgcatgaataagcgaagttgtccatgataacatctccgatagatagccacacgtagaggactagatcataaggggttaggtggctgtggataactagtttcctcgtgtgccagctgtaaacgctggcaccatggtacttctttcttgtatgagcgcctgctggtagttgaactagtcacgatatactgacgatcgaagtcgggcgcattgcacacctgttgcacagactacagtaaacgcacattctggtccgcttggaagacacctacagtgtggaaatcactagcgggggagcatgggtcatgccattacgtgcatcgtgctatacttatgtgagcgcataatggatagtcgtgaccagtgtgacaacatcgcaagatccatgtgcgtgcattgatcggggaacacattaaagacacattatgtgatcctgggctgtgggcattgacttccgtcaatgctgattacagtttgcctcaatgttcgaggtccaaaccccagttgctttgccactaaagggcgcgtatgacaaaaagttgctctaattgggccacagggggccgaaggaggtactctggcgcagttgcaatacgcgttgtagaggttgagttgttctaggaaatttgtggaatatggtgtaatgtagaggaagcacattttgaagttcctcgttcgatatggcgtggaattttgttaacaaaagcttggagggatggttgggaagatgggcatagaaaatgtctgattggtggttaccagtcgttgggggaaaaatgagggggttttgaaaatgtgaaattttctgccaaaggaattattggctgtggggctttttaggtaaactttgctattgggagttaatggttaattgatagagattaacaagattatccagtctcaaggaaattattc

SEQ ID NO: 631911 - DNA, 303 bp, Homo sapiens
gtgttttattgtgcgagactcataagttggggatgtctaggaccgtgcgctattgacttctggggccaggggacaaggtcaccgtctcctcagcatccccgaccagccccaaggtcttcccgctgagcgcagcaccccccagatgggaacgtggtcatcgcctgcctggtccagggcttcttcccccaggagccactcagtgtgacctggagcgaaagcggacagggcgtgaccgccagaaacttcccacccagccagatgcctacacggggacccatgtacgagaaggggatacctcaagga

SEQ ID NO: 631912 - DNA, 742 bp, Homo sapiens
  misc_feature (565)..(565): n is a, c, g, or t
ggtgaggaacagcaaagaaggaaatatggggaaatggggtgaatatcaggtggatcagagagatacagtcatgggggtcaggtgtggtatcaggaataatgtgggaggccagattgaagtccgggccaggaaccatggtaattgtgggacttaaagagtgagtacagctgaaggagccggggagcagaaagtatatgtgtcaggtatgaggaagaaaatagattttggaagttatgagaaatgtagagagtgagttgagcatagtttgtgatttttagggcctctaacggtattaaagcagcggcagccgctgcatgcagacatgagggctaggctaaaacagtaaggtcaagttgtttggacagaaaggctacacggtgtggtcctggctcttgtgtaagaattctgaccgcactaaccatgcctaggaaggaaaggagttgttcttttgtaagggattgccctgacgctgtaaactgccctgacgctgtaaactgccctgacgctgtaaactgccctgacgctgtaaactgccctgacgctgtaaactgccctgacgctgtantctagctcggtaccctaaactgccctgacgctgtaaactgccctgacgctgtaaactgccctgacgctgtaaactgccctgacgctgtaaactgccctgacgctgtaaactgccctgacgctgtaaactgccctgacgctgtaaactgccctgacgctgtaaactgaggtgaacagc

SEQ ID NO: 631913 - DNA, 127 bp, Homo sapiens
cgctgccaatggagtacacagcatcatccttggtcagaatctactaccttccacagcggccaggctccactgaaacaacactcttacgctgacacaccacagctcaggctccttgaagatctacagc

SEQ ID NO: 631914 - DNA, 412 bp, Homo sapiens
agggtgccttatttggcctcaattacttaaaggagttttgggtttttccccaaaccggtttttaaaaccgccaaattaaagcccttttaggtttaattttactgggtttaacttcaccgaattatttttttaatgcttgggggccttttggattaactgtagtcttaaatcatgtgatctgccatcggttgcttttggttaaaacctaattactggaacccttggtattggttgtatttggagttaactatttgggttggtaccccctgcttgtgggtttcatagttattgtaatgcagggaaggaatttgggaatttttttttcctcaacctggctaattaacactgaaaagtccgtcaaggttttaggtttattttccccgaaataaatttaaagcaattggattaccca

SEQ ID NO: 631915 - DNA, 490 bp, Homo sapiens
ctgggcattggcaggaaggtgaacatcaaggaggtatacaccttcgccagtgagccaaacgacgtcttcttcaaattagtggacaagtccaccgagctcaacgaggagcctttgatgcgcttcggaaggctgttgccatccttcgtcagcagtgaaaatgctttttacttgtccccagatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccaccccctgacgctgtaccctgacgctgtaaactgccctgacgctgtaaactgccctgacgctgtaaactgccctgacgctgtaaactgccctgacgctgtaaactgccctgacgctgtaaactgccctgacgctgtaaactgccctgacgctgtaaactgaggtgaacagc

SEQ ID NO: 631916 - DNA, 1449 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 631917 - DNA, 1441 bp, Homo sapiens
  misc_feature (81)..(81): n is a, c, g, or t
cgagagatcgagtcggcgagagggattcttctggctggtccccggcccacaacggtatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 631918 - DNA, 206 bp, Homo sapiens
tgactcctctcagtccactttccatttctattctattatcagatggctacttggaatcaggaatatcactatcagatataagtaatttatcaagttgatagtaaaatcattaaagacaaggagtatcaggggtagctgctcacattgtgaggcaggatgataggatttgagagctgacaaaaaaaaccactgaagagaatcacact

SEQ ID NO: 631919 - DNA, 1458 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 631920 - DNA, 294 bp, Homo sapiens
  misc_feature (75)..(75): n is a, c, g, or t
  misc_feature (93)..(93): n is a, c, g, or t
  misc_feature (229)..(229): n is a, c, g, or t
gcacgagaggtgtgcaggcggtgctgaggcacagggtctgctgcaggagcacgggcccgaacccgctccagcgcnccgccgcgccagcgtacnccgcgtacgctgtgtacccccgcgcactgaaggaggtccaccagccctcaccagcccccgcggaccgtgcaatggcccagcgtaagaatgccaagagcagcggcaacagcagcagcagcgctccggcagcggatanagcgagtgcgggcagcagcagccccggggcccggaagagagacaaagcatggaggacacaagaat

SEQ ID NO: 631921 - DNA, 279 bp, Homo sapiens
atcagctgtttgacttctgatgtattgtttcaggcttgatgagagatgtcctccaaagacagtagatcagtgtacactatggtctgataagtagccagcatatctgcaatgccacaggtagttggacaataacccggacatcattcatctaaaatgcacagctgtctctggtagcagcctatgccacacatgttgaagatagaaataagagtgcatagtagtcgagggttaaactcccatagttccaggtgcagctcctgatgtcgcagaggcctgagc

SEQ ID NO: 631922 - DNA, 1466 bp, Homo sapiens
gaacagcctgagaaccgaggacacaggcatttattatgtattagagactcgcgagggggatatagttctggttaccccaggtttgacccctggggccagggaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 631923 - DNA, 242 bp, Homo sapiens
gtgcgacaggcttgtcttttggtacaatcgcacaagcacacatacacaatgggcacacagacacagacacacacacacaatgtacaaaacatgcccagtcgcactcctgtgtacaaaataaagtgtgttgaagaccctgggacagttttgatgacagtgtgagaaaaaaacaaccattttgatggtgtaaatgccccattctattgtgtgcaagcatctgtatgtgtatgtgtatgtgtgtg

SEQ ID NO: 631924 - DNA, 1820 bp, Homo sapiens
  misc_feature (287)..(287): n is a, c, g, or t
  misc_feature (1036)..(1036): n is a, c, g, or t
gagtgataaatactaacccatatcgtctgaacgtctgataagaagctctgtcacctaagagagtcccttaataatctcgtccaacaattcatagccaatcaatccttcttacaatcacctgaccaagaatctgttaggccttctacaagcgatgtcggcctctatttcatatcttattggatacacctcatattatgctctaatatactctctaaagcctctctcgatgtgttcaatatccttcttacaaacacactgtaggtggcttatacgcataacttcacagnttacctaaagtccccaacacattgtgtattgccttacacgtcctgagtgtaactatcattctactcatacattgaagtaccatgcgtttggacaagtcgttacgagaattcttcctagagattataaactgtctcaaggtgacaaattctggatcggcccagcttgtgggacaacgtaaaggagaagaccacaattttaccaaagtgcatcgtgtactagatatagatacaaaggcgcccttggagcgtgcctggtctcaactctttctataaggggaaaatatgcgaacttaaatgctcaaccatgtttatttaacgatctggccaaatccatgtatgagaaagcctttaccattcgtgaacacaccatgtgtaactttcaaaccaagctctcaaacataagtaaggagaaacccccttcctgggagtgtataacttgccgaatagggcatagactcatatgttgggactgccctttggtgaggtccaacaataatttaggttttggaactctgggagttacaataccacaagttaacatcttcacgggacacagaaaggaaacaccaacttctccacgagaacctcggcacccctgttattaatcggcaccaccataatagttacccttgagggatggcgggcgcgtccaaaagcgatcccatagtaagaatagagtaaaagagctccaatgagacagagggtctttttggagacacacacgcgcccgttagagaatgtatagcganacccgagacaggaggggagcacggcattttggcgagagcgacacaaaggtgcacggtttccatatggagggacacgcgcaaagatctacatgtggggcgcaaacaccacctgattaagtgtcactaagggaactccacccatgggaagctttcgttcaaacgacaaaacatagtcgtgtcattacattaccacaccatataacggcaaaaaggcaccatggttcaatttataggggaggagacatattgtgtcgcccgtggataaggttcccccaccagcaacacacatctaaggtattatgggttggggccaagacgcaacagcacgggtacacattcatttaaggcggtcccccaggtgagggtttcaagtgggactttgtcggaaacacgagacagtggtcccccagggccaacttgtgtttatcgaaaccccactctagctttgtaccgcatccgtagagtgatgagagagcactttctaaaaatcaaatatagtacctatagttaataagaggttaaattggaaaaggtgtaatctcaaaagcccagtgggaaaacatgtgaggaaatatcaaccagattaatgtattattaatatgataacgagaatctagaagaaatagtgttatgtagactgcgcgtggtggaaaaatatataacaatagcaatagtagacgagcaaagatgaaagaagtagaggatggatagtatcgaagaaaatgaattatatgtgtggtgggttacaaaaaaaggcgaacgatgtaataaaatatgtgagtac

SEQ ID NO: 631925 - DNA, 202 bp, Homo sapiens
  misc_feature (23)..(23): n is a, c, g, or t
  misc_feature (82)..(82): n is a, c, g, or t
  misc_feature (109)..(109): n is a, c, g, or t
  misc_feature (133)..(133): n is a, c, g, or t
ccagactgttaagaaaaggtaantgggttgtttaatgaattgatattgtccactgatcgtatttctacttgttaaataattnaaaatcatcttaaaattcatactttgnctttaatttagacacaaggagatntaatcgctgtgtaacatcagagaaagctatatggattatcgttcagaagtaaatgtttctaacattgac

SEQ ID NO: 631926 - DNA, 511 bp, Homo sapiens
  misc_feature (334)..(334): n is a, c, g, or t
  misc_feature (416)..(416): n is a, c, g, or t
  misc_feature (460)..(460): n is a, c, g, or t
tctgttgcccaggctggagtacagtggcatgatctcggctcactacaacctctgtctcctgggttcaagcaattctcctgtctcagcctcccaagtagctgggactacagacaggcatgcaccaccatgcccggctaatttttgtatttttagtagagacgggatttcattatattggccaggctagtctcgaactcccgaccctgtgatcctcccgcctcggcctcccaaagtgttgggattacagcatgagccaccgtgcccagcaggctcattttttaactttgcaatattttaacttgacagaccatcgtttgatgtccattttaccacngtctacattagttgaggtcctcaatatatcttctttatgaacctaagtctctttgatgtcaaagtattaaatatcattggtnatgcctgccagctacttggaaggctgaggtgggaggatcacttnccccaggatttgaagccagactgggcaatgtagcaagtccccatgtcttaa

SEQ ID NO: 631927 - DNA, 190 bp, Homo sapiens
ttaggcgcgttctgcgtgtgtcaccaacctgattcgaccagttatttgacagacgaatcggaccccattcgaggtgctgaaggcagcagagaacaatgaaaaaagaagccggcgggggcggtgttgggggccctggggccaagagcgcagttcaggccgcggcccagaccaactccaacgcggcagacaa

SEQ ID NO: 631928 - DNA, 353 bp, Homo sapiens
ccgagaggctaccaagacatgcgagactccagggtcaccttcgcatcagatttcagagacgctgaagatttctcagggccagagtacctggtcttcatgctcaagaagtaacacatctctagccagggctattaataccacgaggttagtggccgcacaaggctggccgacgagagccgctggtgccataatacatcgtccaagtccttcattgcacgtgcagaaacttgtggtccagcatttatgcaactcatggacgctccagccagtttcataggcgtcactgtggtgcaaggtggatgcgggacttagctcgaccatattttacacgtgcactaggagcctttccggcg

SEQ ID NO: 631929 - DNA, 3653 bp, Homo sapiens
gcgggaagcaccatgcagtttgtatcctgggccacactgctaacgctcctggtgcgggacctggccgagatggggagcccagacgccgcggcggccgtacgcaaggacaggctgcacccgaggcaagtgaaattattagagaccctgggcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacctttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagaggtaagatgggagggctgttatttcccctaggtcatctcttacattctagttctggtgctctctatctgtttaagacaaacccttgtgcacctttctcccacctctccctttctcccttgtctcccttgagaaaacaactccagttctctgcctgcaccatgactgtcgtactggatgtaactagtctaccagtgacctcagggcactttgggcttggctagatcactcactgttgtagcttctgttgtgattttgaagttgcagtccatcaccttccctcctctttgagccctagctaagtcactgaaaggaaatcatggatttattaatcataaagctatactagctcacatctgaagtcaacatgaagtttcctacttccttgtctttgaaataagagaattagaccccagggagtgacctctctgacttacccatccaactgcaaaaaa

SEQ ID NO: 631930 - DNA, 496 bp, Homo sapiens
aaagtatttacttgtattgacatttactctttgatgtcatcaaggcctaagtctgctttgctttcagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttgacattccttggagaaggcaaa

SEQ ID NO: 631931 - DNA, 172 bp, Homo sapiens
atgtctgactttatctgacacttctgctggctcggagccagccttgtatctactaagaagatacagataaatcagccagtcatggtagtacacaccaagtaatcccagactactcagtgtgtatgagtgcacgagcacttgcgttgaagcccgcagagtgcagagagtttca

SEQ ID NO: 631932 - DNA, 3267 bp, Homo sapiens
gcgggaagcaccatgcagtttgtatcctgggccacactgctaacgctcctggtgcgggacctggccgagatggggagcccagacgccgcggcggccgtacgcaaggacaggctgcacccgaggcaagtgaaattattagagaccctgggcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacctttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccagccctggtgtcagcctggcgaagatcga

SEQ ID NO: 631933 - DNA, 107 bp, Homo sapiens
atatttaatcttgtgcatgataccccatgtaaaatccaacttgttcaaaatttcttgtacagatgtgtgtatacactacatttgtttattaccaggaaatttcaagg

SEQ ID NO: 631934 - DNA, 1534 bp, Homo sapiens
cggcacattaaccacgaatacattgctaaaataaagagtgagaaaggctaaggaagtctgtcgcagagagtgctggtcaagaattgagcacgtttgctattgtatagtaatgtatctctcaggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagaggtaagatgggagggctgttatttcccctaggtcatctcttacattctagttctggtgctctctatctgtttaagacaaacccttgtgcacctttctcccacctctccctttctcccttgtctcccttgagaaaacaactccagttctctgcctgcaccatgactgtcgtactggatgtaactagtctaccagtgacctcagggcactttgggcttggctagatcactcactgttgtagcttctgttgtgattttgaagttgcagtccatcaccttccctcctctttgagccctagctaagtcactgaaaggaaatcatggatttattaatcataaagctatactagctcacatctgaagtcaacatgaagtttcctacttccttgtctttgaaataagagaattagaccccagggagtgacctctctgacttacccatccaactgcaaaaaa

SEQ ID NO: 631935 - DNA, 102 bp, Homo sapiens
tgcagaccccacttacggagccatgtttgatactgctttctctgacgataaaacagtaattactgcttatttctctttatccttttataaccatgaaccggg

SEQ ID NO: 631936 - DNA, 554 bp, Homo sapiens
tggagctcggtaccggctgttttgcctgggctgtggtgcgcaaaggcccacaactgcagcaggatcagcaaggcgctggcggcgatgaaccaggcgctgatctgggcgctgcacgaacaccgccaggtcaccgcgcgacaacagcaaggcgcggtggaagttctcttcgaccatggggcccagcacaaagccgagcaggatgggcgcgaccgagaattccatgcgtcatgaggatggcgccgagtcacaccgaatgtgccagcacttcccagatctggaagaggctgttctgggtactgaacacgcccaccgcgatgaagaacagggccgacgggaacaggtagcggtacggcacctgcatgcagcttgacccagacgccgatcagcggcacgttgagcaccatcagcagcacgttgccgacccagaagctggcgatcaggccccagaagatgtccggatgctcggtgatcagttgcgggccgggctggatgccctggatcagcagcgcgcccaggatcagcgccatcaccgcgtcgccgggaatgcccaggct

SEQ ID NO: 631937 - DNA, 1610 bp, Homo sapiens
gcgggaagcaccatgcagtttgtatcctgggccacactgctaacgctcctggtgcgggacctggccgagatggggagcccagacgccgcggcggccgtacgcaaggacaggctgcacccgaggcaagtgaaattattagagaccctgggcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacctttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttgacattccttggagaaggcaaa

SEQ ID NO: 631938 - DNA, 839 bp, Homo sapiens
tggcacactgataatggctttgtgaaaatttatagatgttttgtagcgaactgtaatgcagaaatggcctaatttgatggttaattgttgctggcttcaaaaattaaggtataaagattaatatgtaaggaagcccattctttcaaggtaaatacttggggtgggaggggagaaagggaaccttttcttaaaatgagaaataattactgctaattttaaaatttcttgatcattgaatgtgagacccttctaacatgatttgagaagctgtacaagtataggcagagttatgtgttcctgtttacattgtttttgtttgttttggggaaaataattggtaggtgtctaattactgtgttacgttcagttgttatattgcagtaaaagcttttaaaacaactcattgcatgtttgcttgttgatgtatcccgtttgtgaaatctagcacttcttggggccaagtggagaaatgtctgcagttcagctctgccctgtctttgtccccattccgctcagcaggaaagcgtgtgttagtcaggcaagtacgtgagtgcaaagctgctgcctgtttaaaaaagcccagcaaaagtgctgatgtcagtgtcaaagattaagtgcaaagtgttgtcaaaagctgggtattctgagtaggttgtaaagtgtgtttcgtttagttagataagacgtgtagttagccattaaagtcattagtataatattgctttcaaaaagaaatggtagacaaaactataatccagcatcttttattgcattggaaagactggcaaagtcttttggatgggttgggagatgtggtaaacgacatgtgcgtttggaaa

SEQ ID NO: 631939 - DNA, 1771 bp, Homo sapiens
  misc_feature (120)..(121): n is a, c, g, or t
ccatcatgccttgacagtgttcaccatcttataggagtggtgatgggggtgagcaggcgaagcagagcggagaagagacaagaaaagaaagaagaggcacacgggagcgcgcgtttggtnnttacaagcgtatgggtactcttgactacgtgtatgctcgcttagctcagtgtgatgcgtaacgtgtctgtctcggaccgagtctgtgtagtcattgttagatgaactcttcgctgcatgctgagagagtagtatgatatctcggtgggctgtggcgtgtctgttgtttgtgtgtgaaggcagtggttggtagttctgttcttctgttgtgtggacgacgaagcgcaggcgttgtgttgctcgtgctgtgctggtgaggtctggcttcgctctcttgctatctctccttccggtgggggtgctctccccccccttgtgtggggggctcgcctgcccctgtgattgttctccgccccgcgggggtgtgagcagttttgttgtgtgtcgagccacgcgcccttgcctcgcgccgtgcgtgtgtgtgtgtagatgtatgttcgggtcactctgtccaccaactgctcgttcgccacgtctgtgggtctttctcttttatttctgtcgcggcggaggagaaaattgtggtgttgaatggtcctgttgtgtgcacccagcagtgggttcttcgtatttctccgggtgtttcttgtcgctgctgatatgactccgcgcgcgggttggtgttggtcacttttgggcaccaagagggccgggcgacagctcgtttttagtttggtatgctcgtgcgcgaggcgctcccttttgtgtggagggggggtgagtcccgctccctctctggccggtgtgtgatatgctcgcggcgctgttttcataaagaggcgcagaggggcgcttgtttgttgggggggtgttggggtgatatattcaaacaaaaaaggtggggcgggctctgctgggaaatacggggtctgtctgcgttgctgttttctagtagcgaaagctttgttcattttgtcgtctctagtaggtggtctctcccctatcaaccaacattgttgctcctgttggaccataaagatacagatgtctcctctcctttttcgcccgcccgtggtttgacagagatagtaaaactctttcgtgtggttgttttctctcacacgaagatattatataataaagagtctccgcgcgttgccaaaggaaaaattatactccgcctcccccccctctacttgtagtatatccgtgttattaactactacgcccacactactcctctctcggccccttctctctgagtgctgtctcttgtcttcgcacactacagttcccttcggcagttgtcagataaacgagccgccctttgctgaaaactatttgttcttttgtgagaatagaccccccttctgtggaaagaccaccactctcttgttctggcgtatttcttgtatttccaatatcccacagcaaaattggcgagggttctcatagtatagagcctgggtgtagtaagggtggttgggatggcctgtgtgccccctcgtgttgtgtcgatgaggtcgcgcgccccctccctcgcgcgcacactctcgccgcgtgtgggagggtgtgtttacatctcgccccagctcagtgacacattgtctccacacatgtgtgcacacccagtttctttaacaaagacttcttaaaagttttacacaaacaatccaagataatctccccctccacacaataacacacaaaa

SEQ ID NO: 631940 - DNA, 130 bp, Homo sapiens
ggctgaagtaatcttcttatcctaccaggcgtcggaataatctcccatatagtaaattactacgccggaaaagaagaaccagtaggatacataggtatgggctgagctatgatatcagtgggcttcctag

SEQ ID NO: 631941 - DNA, 682 bp, Homo sapiens
  misc_feature (225)..(225): n is a, c, g, or t
  misc_feature (233)..(233): n is a, c, g, or t
  misc_feature (283)..(283): n is a, c, g, or t
  misc_feature (433)..(433): n is a, c, g, or t
gaagtgtgacgtggacatccgcaaagacctgtacgccaacacagtgctgtctggcggaccaccatgtccctgcattgcgcaggatgcagaggagatcactgcctgcacccacacatgaagataaatcattgtctctggccagtctccggtgatcgcggctcctcctgtctcgtgtcacttcacagatgtgatcacaagccgagttgacgagtcggccctcatcgncaccgcanatgcttctaggcggactatgacttatttgcgttacacactctcttgacanaacctatcttgcgcagataacacgatgagattggcatggctgtatatgttgtttttgttgtgtgttgggtttttttttttttttggctcgactcacgatttaaaaactggaacggggaaagtgacagcagtcggttggagcgagcatccnccatagttcacactgtggccgaggactctgattgcacattggtggtgtttttaatagtcattccaaatatgagatgcgttgttacaggaagtcccttgccatcctgccaccccacttctctctaaggagaatggcccagtcctctcccaagtgcacacaggaggaggtgatagcattgcttctcgcgtttatgtaatgcatgagccttcgtgcccccccttcccccttttttgttcccccttgagatgt

SEQ ID NO: 631942 - DNA, 336 bp, Homo sapiens
aaatctagccatctattcctcgacatttacagctagacaggtctggagaaagcacagagccatgctaactagtctcatttaatttctggacactcacatcaagtaaatccttagtactacctgacaattgtactttatttccattatattcacccttagtgccctctagagcgccctcatactctctgctctttagcagacatctttgctatctctactctcagctgataaccttggttttggtttcactcagaaaatagaggcagtggaggaggattttcacaggtttcaccactgcattgaccacctacctgcattgtgcctataaactaggcc

SEQ ID NO: 631943 - DNA, 457 bp, Homo sapiens
ctcggtacctagactattacggtgatctaaacattttaaaattaaaattaatcccctccctccagcacacaaaaaaaaaaaacacacaacatttagaggatttgccaaaaatattctctattacaacttttttaaatttctttaattaagggcttgggccccaacggttgcacatagattcaggggatttggctcccttctgaaactaaatcattggtaagaggcttcagaaaaagaaatttagcttgaaatctagtctggggaaatggggggcagggaatgaaaaatgtgggtctcttgtttctcccacgggacttccttctgattattttacgggtgtacgtccggcacattacaggtctccacgggagggcagctgtgtcgggctttctccttctgtggcttcagcctctgccggcggcacacaggcttctcccgtttcttcgaagccgtcaga

SEQ ID NO: 631944 - DNA, 209 bp, Homo sapiens
aacaccggcccatgattacttaatactgcttgtctggctggtatgatacactttaatactgcttgtctggctggatgatccactttataatggttggctgggtggattaaccaatttaatactggttggctggctggatgagtccactttaatactgcttgtctggcatggatgatccacttgaatactcgcttgtcctggctggatga

SEQ ID NO: 631945 - DNA, 209 bp, Homo sapiens
agacagcttcgaacagatgcatgagattacagagagcaaacatcggcagaactaaagtcgagaatatcttcatgtttgcaacctttaatctgacttgcctttactatcctttccccatttcttctaatctcttttgccttacactatattaccttctaggtatcacctcatcctatagaatcccttctagtttaatgtcctgccccaaa

SEQ ID NO: 631946 - DNA, 680 bp, Homo sapiens
  misc_feature (526)..(526): n is a, c, g, or t
  misc_feature (632)..(632): n is a, c, g, or t
  misc_feature (636)..(636): n is a, c, g, or t
  misc_feature (642)..(642): n is a, c, g, or t
  misc_feature (663)..(663): n is a, c, g, or t
tatacccgttagttccgaggaacctgtatccgagataagcactgcggtttagggtgaattggcaccatcatgtgattgctggggtggtggacgatgtgattgcagggcggcggaaggatgtggtgattaacgtgcctcctgggtcgtcgaaaacggagcttgtggcgattaatgtgatggcgcgagggttggcgctgaatccgtatgcgcggtttttgcatattagttattcggatgatttggcgctgctgaattcggagacggcgcgggagattgtgcagtccgatgaatatcgtgcgttgtggccgttggagattgctgacgatgccaagtcaaagaagcgttggaatgtggtggtggatggcaagaaagccggtggggtgtacgcggtgagtctgggcggacaggtgacggggtttcgggccggacacatggccccgggatggcagggggcgatcattattgatgacccgctgaaggtagaagatgcctacagcaagaccggacgcagtaaggccaaccgtangctggtgtccacggtgaagagtcgtaaagccagtccggacacacccatcattgtgatcatgcacggttgtcgcaggacgatccgacggggttcatcagtctggggnttcnggcgcntggatgttgagatccgcttgntgatatgctacgtccct

SEQ ID NO: 631947 - DNA, 858 bp, Homo sapiens
cggcgccggtcgcggttcactggttccccgtcgggcgttggggcggattgtgcacttcagtttcggcgccaattcccggttggcttccggggcaacggcagcagtgtcaagcgtcttcccttcatagcgttccgctgcttggaggccctgataccgttccctagtggtcttggccggtagcctgtgttccagcctccggcgcgaggtcgtgttgtccttgtgccgcttccgggattagtaccgcgtgtgtgtgtttgtgcccccgcctattgtgatggtcctccgttgcccctcgctatcccgtggcgtccttttttcaaacccagccggggtttccggccgctcgctgtccgcacccaactcgttgggcgccccccactggggtcgtgtaccccgtgggagggtacccccgcgttccgcgcgggcttatttttctacctccctccatgactgtgtcgccccctgatgtcgcttttgacccggcgggcactgggtaactcccttggcggtcgcaccacatctgggtgtgaacctccccgtttgtgtgccccccctgccgttaaatattaccactccaccaaacggtcttgcacactcaatgagacgtgccccaccacttatgggttaaaccacaatgccatttcccggagccgtcgtaaacccaagccacgttgtcgcccgcggcaccacacccgcggggtattaacttcggtcacaattcttttaaattctgtggacgcccaaccaccaccgtttcacatgtctcctcctcctacaaaattaattcccccaaattttttaataggggcccttttttcccctttcccccccctttcccccttttagacccaaaaaaaa

SEQ ID NO: 631948 - DNA, 894 bp, Homo sapiens
  misc_feature (38)..(38): n is a, c, g, or t
  misc_feature (51)..(52): n is a, c, g, or t
  misc_feature (55)..(55): n is a, c, g, or t
  misc_feature (57)..(57): n is a, c, g, or t
  misc_feature (67)..(67): n is a, c, g, or t
  misc_feature (110)..(110): n is a, c, g, or t
  misc_feature (166)..(166): n is a, c, g, or t
  misc_feature (308)..(308): n is a, c, g, or t
  misc_feature (311)..(311): n is a, c, g, or t
ccacctgtgccctgtgggacattaaaacaggccagcanacagtgggttttnntgnanacagtggggntgtgatgtccctgtccctggcccccgatggccgcacgtttgtntcaggcgcctgtgatgcctctatcaagctgtgggacgtgcgggattccatgtgccnacagaccttcatcggccatgaatccgacataaatgcagtggctttcttccccaaaggtacgccttcaccaccggctctgacgacgccacgtgccgcctcttcgacctgcgggccgatcaggagctcctcatgtactcccatnacnacatcatctgtggcatcacctctgttgccttctcgcgcagcggacggctgctgctcgctggctacgacgacttcaactgcaacatctgggatgccattaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaac

SEQ ID NO: 631949 - DNA, 362 bp, Homo sapiens
  misc_feature (324)..(324): n is a, c, g, or t
ggcatgtaccctttctgtgggttacctatcattttgtagatcagtgtttcaaaacatgttaagtttagaaatagattcttttggcccaggcacggtggctcacacttgtaatccctggtactttgggaggctgaggtgggtgaatcaccttaggtcaggagttcaagaccagcctggccaacgtggcgaaaccccatctctaccaaaaatacaaaaaaattagctgggtgtggtggtgggcacctgtaatcccagctacttgagaggctgagacaggagaatcgcttgaacccaggaggcggatgttgcagtcagccaagattngccattgcactccagcctgggtgacagagcaagctctg

SEQ ID NO: 631950 - DNA, 1158 bp, Homo sapiens
  misc_feature (642)..(642): n is a, c, g, or t
ttctccgctcccagacatgtagtccctcggcttcctgcctcgagaacggcgcatcagcaggcatcgtgggaaggtgaacagcttccctaaggatgacccgtccaagccggtccacctcacacgtccttcctgggatacaaggactggcagtgactcacatcgtgcgcggaagtctgacaggccgggatccatagggtgaacaaggaagtgagagtggtgagacgcgtcggtggtgaccaattagatatgacgacactcactccataggctgagtgtagtaggggccgcaaggttttgtggcgtgctagcaggttgtgagagaacccaccttaccagaaggcccctcctgagagcacttatcagagaacattggtgcttgtggcctgtaagcaaaacatactagcttgatcgagagtagtcattgcacggacagtctatcttatataagtacatttggactatacaattgctatagaacgaacggcactgtaaaccaagtagctgacaatgatgagtggctaggatgacggactggcacagaagactgactggaaccaaagggagcttcgacgtcaagctatgatagaaatgtcacgttggagcaaaggatcacttcgcagtgatacaattcgccgcgcgatncacacccatggattagtctgcgcatgactttgcgctctgacgggcaccagaaggaaaggaccacagctggaatgggatgaatccaaaggttggaatggggatgggcaactagttggggtcggatgaaagcctggggaacttgagtgcgcccgggacgaagtagggttgtggattgcacgacaagggatagcatgtaggaaccaagtgtaaaggcgcagcgattgaagatatgagcggacgctcactcggggtgaccaggggcaaaagggacaacgggcgtcaccagaacgtgtggggagcaaccaaaagaaagctggccccgaaaggacccaccgagggctgcggccaagggggccggtatttggggcactgggcctccggctcggtggaggcctactctgggggccaggcgcctggggccgaaagggtgcattcaccggaagagagaccacccgggacgtccgcggactcggccggggcaccccaacacgggagcacccggccccagacagccgc

SEQ ID NO: 631951 - DNA, 958 bp, Homo sapiens
cattaatggctagtcgaggccggtgcttattcggcgaggtggatgcatgattggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgcggttaaaaaaaaaacaaacaaaacacaaacaaaaacaaaaaaaacacacaacactattatcatcaaacaaaaaaaaaaaacaaaaaaaaaaaggggtgggggcgcggcgccgcgccccgccagcaagaaagaaagttataaaacacccctagtggggggcgggcgcggcccgccccaaagagtagagtacgaacccagtcagcaacacgggtgtcccaaaaaggaagacccggcgcacgcaccaagggggtggtgggcttctcccccaaaaaaaacgacacgcccgggggcaacgcaggcggtgtgtgacaacacaccccaagaggtggctagcggggagcaacaggaggcagctacacaaaaagagggagcacgacaggacgcagaagtataaaatcgccgccccccggcgaggggat

SEQ ID NO: 631952 - DNA, 1318 bp, Homo sapiens
  misc_feature (38)..(38): n is a, c, g, or t
  misc_feature (51)..(52): n is a, c, g, or t
  misc_feature (55)..(55): n is a, c, g, or t
  misc_feature (57)..(57): n is a, c, g, or t
  misc_feature (67)..(67): n is a, c, g, or t
  misc_feature (110)..(110): n is a, c, g, or t
  misc_feature (166)..(166): n is a, c, g, or t
  misc_feature (308)..(308): n is a, c, g, or t
  misc_feature (311)..(311): n is a, c, g, or t
ccacctgtgccctgtgggacattaaaacaggccagcanacagtgggttttnntgnanacagtggggntgtgatgtccctgtccctggcccccgatggccgcacgtttgtntcaggcgcctgtgatgcctctatcaagctgtgggacgtgcgggattccatgtgccnacagaccttcatcggccatgaatccgacataaatgcagtggctttcttccccaaaggtacgccttcaccaccggctctgacgacgccacgtgccgcctcttcgacctgcgggccgatcaggagctcctcatgtactcccatnacnacatcatctgtggcatcacctctgttgccttctcgcgcagcggacggctgctgctcgctggctacgacgacttcaactgcaacatctgggatgccattaagggcgaccgtgcaggagtcctcgctggccacgacaaccgcgtgagctgcctcggggtcaccgacgatggcatggctgtggccacgggctcctgggactccttcctcaagatctggaactaatggccccacccccactgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgcggttaaaaaaaaaacaaacaaaacacaaacaaaaacaaaaaaaacacacaacactattatcatcaaacaaaaaaaaaaaacaaaaaaaaaaaggggtgggggcgcggcgccgcgccccgccagcaagaaagaaagttataaaacacccctagtggggggcgggcgcggcccgccccaaagagtagagtacgaacccagtcagcaacacgggtgtcccaaaaaggaagacccggcgcacgcaccaagggggtggtgggcttctcccccaaaaaaaacgacacgcccgggggcaacgcaggcggtgtgtgacaacacaccccaagaggtggctagcggggagcaacaggaggcagctacacaaaaagagggagcacgacaggacgcagaagtataaaatcgccgccccccggcgaggggat

SEQ ID NO: 631953 - DNA, 1345 bp, Homo sapiens
  misc_feature (38)..(38): n is a, c, g, or t
  misc_feature (51)..(52): n is a, c, g, or t
  misc_feature (55)..(55): n is a, c, g, or t
  misc_feature (57)..(57): n is a, c, g, or t
  misc_feature (67)..(67): n is a, c, g, or t
  misc_feature (110)..(110): n is a, c, g, or t
  misc_feature (166)..(166): n is a, c, g, or t
  misc_feature (308)..(308): n is a, c, g, or t
  misc_feature (311)..(311): n is a, c, g, or t
  misc_feature (550)..(550): n is a, c, g, or t
  misc_feature (556)..(556): n is a, c, g, or t
  misc_feature (559)..(559): n is a, c, g, or t
  misc_feature (569)..(569): n is a, c, g, or t
ccacctgtgccctgtgggacattaaaacaggccagcanacagtgggttttnntgnanacagtggggntgtgatgtccctgtccctggcccccgatggccgcacgtttgtntcaggcgcctgtgatgcctctatcaagctgtgggacgtgcgggattccatgtgccnacagaccttcatcggccatgaatccgacataaatgcagtggctttcttccccaaaggtacgccttcaccaccggctctgacgacgccacgtgccgcctcttcgacctgcgggccgatcaggagctcctcatgtactcccatnacnacatcatctgtggcatcacctctgttgccttctcgcgcagcggacggctgctgctcgctggctacgacgacttcaactgcaacatctgggatgccattaagggcgaccgtgcaggagtcctcgctggccacgacaaccgcgtgagctgcctcggggtcaccgacgatggcatggctgtggccacgggctcctgggactccttcctcaagatctggaactaatggccccacccccaaaancccccnccnccccccaaancctgctgggcccaggccaggaggggccctgcccatgcccacactacaggccagggctgcggggctggcgcaatcccagcccccttccccgggccacggggccttgggtccctgccctcccacccaggtttggttcctcccggggcccccactgtggagataagaaggggatggaatgggggaagaggaggagcaggaggccctcatccttctgctgccctggggttggggcctcacccctctggagggccggaggcaggaggtggaaaccccaggggctggcttttttaaaactggttttattttaatttttattatattttcagtttttccataaaggagccaattccaactctgcggttaaaaaaaaaacaaacaaaacacaaacaaaaacaaaaaaaacacacaacactattatcatcaaacaaaaaaaaaaaacaaaaaaaaaaaggggtgggggcgcggcgccgcgccccgccagcaagaaagaaagttataaaacacccctagtggggggcgggcgcggcccgccccaaagagtagagtacgaacccagtcagcaacacgggtgtcccaaaaaggaagacccggcgcacgcaccaagggggtggtgggcttctcccccaaaaaaaacgacacgcccgggggcaacgcaggcggtgtgtgacaacacaccccaagaggtggctagcggggagcaacaggaggcagctacacaaaaagagggagcacgacaggacgcagaagtataaaatcgccgccccccggcgaggggat

SEQ ID NO: 631954 - DNA, 767 bp, Homo sapiens
ggacggtgcaccggacggagggatcgagcaaatgggtctggtccatggagcactggagggtcctacgctcgggcggggggcagctctcggggctgctggtattacctgcgctagttcttcctcttggtctccctcatgcaagtacctcatcatcctggaggctcgtgctcttcatggtctagtggcaagcgtgcacgtgaggcacagagtcgcaaccgtgcaggccaccgagcgccgagccgagggcctatacagtcagctcctagggctcacggcctcccagtccaatcttgatccaaggacgctcaacattcatcagcgcgcgccaaggatgccatcatgcagatgtggctgagatgctcgccgggatctggactcgcatcaattgtcaggcttccgggcaagtgccagggtgaccggggtcatctatacgatactaatcagaggtcacatggctgccatcatcttgagtgagaagcaattgccgagatcaattcacaggcacgatgaacaagagctgcgatgcctgggtcttcatgctgaatcagaaggtgaagacgctggagtgtggagatagccaaggagaagaccattggcactacggataacggcacagcgtgctgctgaacgaaacgcgtggcggaggaacaggtggttgaatgcgtgaaaacccgggagctgcagcagcaagagcgccagctggccaaggagcactgcggcaggtgcaagccctctgctggccctggacaaggacaagtttgagatgg

SEQ ID NO: 631955 - DNA, 602 bp, Homo sapiens
tcgggtgccacccgtccatgatcagaggcaaaaattaagcagcatttaagacctcctatggcaggatttaatcaagatctcaatcagagttaagtggcaatatggagaactgatcctgggcctcttcatgctcctacgtattacgatgcctggagcttacggaaagcaatgcagggagcaggaactcaggaacgtgtattgattgagattttgtgcaccagaacaaatcaggaaatccgagaaattgtcagatgttatcagtcagaatttggacgagaccttgaaaaggacattaggtcagatacatcaggacattttgaacgtttacttgtgtccatgggccagggaaatcgtgatgagaaccagagtataaaccaccaaatggctcaggaagatgctcagcgtctctatcaagctggtgaggggagactagggaccgatgaatcttgctttaacatgatccttgccacaagaagctttcctcagctgagagctaccatggaggcttattctaggatggctaatcgagacttgttaaggcgtgtgagccgtgagtttccggatatgtagaaagtgggttgaagaccacttggcaggtgcct

SEQ ID NO: 631956 - DNA, 639 bp, Homo sapiens
ctctggtggatgatacgtcaagtcacagcatacagcatacatcttgctgaagtgctaggatacttatcttattagagttggagtaagtagcataactgctaatctaaagctagctcttaagttgaaagattatgtatggactgtcagttaacggagcactagagcttgatatgaatacagtgacttatgacatgggatacaggattatagcaggcccttggacttctaccatacagacggtctagcattgtcagacctctgccattgctaataccatgtggaaatctgagtccattagacgcgatatctgattttagacgatggcagataactcagaggttgtcaacggcattcatacatagtcgtcatagacatattgttgtacttagaccgctgctagtgacctaagagataccatgcaggtcttagcagagactggacctagcgtcgcgccacaggtgaatttgacagtgatatgttccatgctgaggttggctgcttcagacatgcaagtgatcatcacccgctagtggaacgattggacaaccgctgatagcacttaacaggctaccaatttcccttatccgttgagttaccattgccttgtagatgacatttaacgtcccctgcattccagcc

SEQ ID NO: 631957 - DNA, 753 bp, Homo sapiens
atcatcccagcactctgggaggttgaggcgggtggatcacctaaggtcaggagttcgagaccagcctgcccaacatggagaaaccccatctctactaaaaacacaaaattagccaggtgtggtggcgcatgccttaatcccagctactcgggaggctgaggcacggagaatcgcttgaacctgggaggcagaagttgtggtgagccgagatcacgccattgcactccagcctgggcaacagagtgaaactccatctcaaaaaacaacgacaacaacaacaacacaacaacaaacgcagcaattccattcctaggtgtacacccaaaaaaattgaaaacaggtattcaaacaaatatttgtacacaaatgttcactgaagcattattcacaatggccaaaagaaggaaacaaccaaatcatcaacagataccggataaacaaaatatgatatccatacaatggaatattatttagccataaaaaaggaataaagtactgatacatgctataatgtggttaaactctgaaaatatgatgatgtcccggtgtggtaagctcacaacctataatcccagcaagttgggaagaatcttcttatggttcaaaaaaaacaacgtaggcctggtgttgctggctcaggccggtatggtggtccatgcctgtattcatccacgatcggaggtgaggggtggacaccgcactcggattgaacggccgccattggaaacctgttctaagacacgcacacaaaaa

SEQ ID NO: 631958 - DNA, 365 bp, Homo sapiens
cgatgggcgcggatgtgatctcaggcatggtcctctcctgactgggagcgtggagtggatttcgggtgcgttccggctctgttgcggggctggatatgcgtggcgacgacagcgactagggtcaataggctgagtacgttgacggtccctcccgcctgcaccgcggcggaacggtccaacccgtccccgatgccgatgcgtaccagcagggaggcctccagcaggaaggcggggagccagaaccacgtcgtccatttcagccggacctgcaacacggcgggcaggatgatgggggcgtggccgaggatcatccccatggtgaatccgaggaagagcgagtggacgacggcgtcatacccacttcg

SEQ ID NO: 631959 - DNA, 201 bp, Homo sapiens
aactactaaagttccagtagttaggccattcatttaatgtgcattaggcccttttctgtttatttaaaagtcaattgctttctaatgctctatgggccgactatcaagatattagtaaaaaaggatcatgtttttaaacagcaggtcccgggccccttggaaataaaaatttgccggattccaataatttggtttggggga

SEQ ID NO: 631960 - DNA, 416 bp, Homo sapiens
  misc_feature (416)..(416): n is a, c, g, or t
attcctgaagttgacagcattttcgccgagaggtctcgctccgtggccttagctgtgctcgtgctactatctctctatggcctgcaggctatccaccgtactccaaagattcaggcttactcacgccatccaccatagaatggcctgacaaagaccctgaatggctatgtgtctgggcttcatacatccgacattgaagttgacttactgaagaatggcgagagaattgaaaaagtggagcattcctggtctttcagcaaggactgggctttctatctcttgtactacactgaattcacccccactgagatgagtctgcctgccgtgtgaaccatgtgactttgtcacagcccacgatcgttaagtgggatcgagacatgtaagcagcatcacggaggtttggatgccgctttggn

SEQ ID NO: 631961 - DNA, 874 bp, Homo sapiens
tcaaaaaagccagtttttttttaatttggtaaaggctctgccataaatctttctagggggtgccatgggtcaccggccaaatctcgccccgggtggcccgtgtacccggcaaacagagtctcgtggccattcagccagaccaggccagggaggttgcacgtgggggtggttcgtgcctttgctgtgcggggatacgtgatataacttctcgtgggcttcagtctcatctctacaagtgatctctttctcccctcataaatctcccagactctggagtgcgtggggccgtggtggcagcacccgcagcccgagtatagcgcggtgtatgagggcttgtaagccacgagggcgcgttgtggagtgtatgtgtctccccacaccattctatagcgcggtggtaacgacgggtgttttgtgccttctcggtgtggagaatctacccatataaaaacgtgtggccgcgtgggccgatctcctttggggccttcccgagaagagcccccgagagagggatctccccactcgtgcgaggaagaacgagtctcccccggtgttctcagaattagcccgtggtgtgtggccgcgcagtggtggctgtgggtcctatcagctgtgggcaagttataagcccagggtctcccatattaccgtttgggacgcaggctgtgttgttccccatgcctacgtgggagacccgattgaataaggggatgtgcctcgccatgttgagggcgccgaaaaaaaggcgcgatcccacagaggaaaccccccccactcttgttgaggttgggtgtctacaatccctgggagcagtggtttttttgcccccaccccccccggggttttcccccaagagcgtggaaggggggtcaac

SEQ ID NO: 631962 - DNA, 110 bp, Homo sapiens
  misc_feature (40)..(40): n is a, c, g, or t
  misc_feature (65)..(65): n is a, c, g, or t
  misc_feature (79)..(79): n is a, c, g, or t
acagctccgtgtactgaggccccgcagctctggccacagngacctcttgcaagtgccccctaagngacccggacacttncgagagggccatcaccgcctgtgtatataac

SEQ ID NO: 631963 - DNA, 1680 bp, Homo sapiens
  misc_feature (265)..(265): n is a, c, g, or t
  misc_feature (1210)..(1211): n is a, c, g, or t
  misc_feature (1292)..(1292): n is a, c, g, or t
ctcagacgtgtgtgtttttatttcgtctccctcctttctgttgtttcgtgcgcccacagcctcgcagcgacgtggttcttctcatattacgggagagacagggtgtgttgttgagacaaggtggttaatgagagtgagtgttctctctcgccgtgccgacatatttgttgtttctcttcccccgcgccccgttgtttttgtgccaccgaccaacgagatgtatcattctgagtctccttgtggtgtggttcggttgtgtcccccncctgttttttttatgttgagggggggggctcccctcccgccctcgtcttctggggctctccaaacacagtggtgagagacaaacacaacgagcgtgggtttgtttaacacgcggccggccccgccgggggggtgtgttctccctcttatatttccccgccggcgtccaaaataagaggtggtttgttgctcaaatagaaggaaatctcaacaccgcggggggttgtcgccctctgctaaatatattgtggggggggcccctcctcgtttatgattatgagtgggggcggggctccaccaacacacgacggcggggggttgtaacacaacgccgttcgtgttgtttgtaagtgactgctgtgtagaacaccgagcgcctggcggatgagttgtggagcttccccctcgtccccccccctggtataataagaagaggcgggggctggggcaatcataataagaccaccaccacgctccattagattagtcagcgcagagagattgtcgccctctccctattcttggggaggagccgttctgtatatcatcatggtataggtataaaataggcgtggcccaccaccactgctgattctgctttttacgccacacatctcgctacactacagcggcgggttgtctcgtagagattttcgcccacacatcgctcgcgctctttttataaaaaatgtgtgtgtgtcttgtgtgggggtgcgacaacactcgtggcgggagcacacgaagagaccccacacaccctctctcggaggcacacgcggacacaacatctgtctatgatagaaagcgtttctacaacacacatctcgccaaagcgcgcgcaatcatttatcatatatatatatctcacatttgtgtaggtgcccatcatataatctgtgtgggccacacgcgcgggagcacacacgctttattctctctcgtcggnngagatatacacacgcgcgcgcacatctcttctcatatttttagtggaggaggcacacatatatcacacacacacataaggngggtttatacgcagcaccccgcgcagatgttgtgggagagacacgagagacacatctcccgcagcggtggcggcacaccgcgcgcgtatatatataaagggtgtttcgttgtgtttctacacacgcagagttataaaggtcttctacacgcgtgagatattgtgagtttcacgcgaccgcgcgggtgtatatatccacgagggcgcgtgtttttgatatttattttctcatatattctctctgccctgtgtacggacaagagacacacaagagaaaatatatagagcctctatctttctccacaagagcgccctcttcccccgcttaaatagaaattttttcttactttgggtttaaaccccccccccccccaaaaaacggggtttta

SEQ ID NO: 631964 - DNA, 242 bp, Homo sapiens
tagaacagtttcctgtccagctcatggcggcccatgtaggcccaaaacttcctcaagtcaaactctccaggcccaacttctgcttcccagtggcatgaacaggcccagcattttgacttgagcaacagcctctgctaagccctgcttcttgcactcccagagggcttattccagagcccagactcttgcctcatggacagctgccccagagccaaatttctgacctgcctgcccagcagacc

SEQ ID NO: 631965 - DNA, 295 bp, Homo sapiens
  misc_feature (24)..(24): n is a, c, g, or t
  misc_feature (89)..(89): n is a, c, g, or t
  misc_feature (104)..(105): n is a, c, g, or t
  misc_feature (116)..(116): n is a, c, g, or t
  misc_feature (120)..(122): n is a, c, g, or t
  misc_feature (125)..(125): n is a, c, g, or t
  misc_feature (132)..(132): n is a, c, g, or t
  misc_feature (135)..(135): n is a, c, g, or t
  misc_feature (142)..(142): n is a, c, g, or t
  misc_feature (179)..(179): n is a, c, g, or t
  misc_feature (192)..(192): n is a, c, g, or t
ccccccttaggatgggcaccttantcgtctcagcaacaccaaattaaccccttcatccagtggcccctccaggcaagagtctcagcggncgagagtccagcctnncctcccccccnccannnagngggcagnccngcacagntgctgggagcccttgtgtgtctggtcacactttttangcgtcacgccaanaggccagcctcctggccccaatacccattttggaagcccctgtggccgtgtggatgtcggtaacagttgtataaaataaattctatttatcgctattgtaaaa

SEQ ID NO: 631966 - DNA, 1113 bp, Homo sapiens
gtgagctggcgccgagcgggtgcgggtgctgggcgcatcggccatcaccgcgcggccgcgccagcggacaccgtgcgtaccggcctgcggcgcccggccaccgtgggcggaccgcggaacccgaggctatgtcccatttaacaagagttttcatcgggtgtcatggggacaaacgtattccatccccaccaagccctggcatactccgtgcggagtggccccaaggcaaaaccaattgaacaccacaacataattgcatcaagcgcatacacataagacacatggaggagacccggtagtgagggacaagacggcaaccacaaatcaaacaacggacgaagtgaacacaagagaagacacacagaacacgacgaaaagcagaaaacaccaatggcaacaacctacgacaagcaaacccaacacaccaacagcaatgacacacaccaacaagagcaaacaacaaacaagaggtaagaacgcaggtgagtgtcaggacagaacagacacagcggccagcacaccggaacgggaaagcgaagcggcggaaaagacgggaagggaagagacagaaggaacgacacgaggggaggcaagaagcgagaggtggagggaggggaggcgacaagacagcggtccgaagtagactagaccacacggaggcggagaggaacgagagcgcgacgcagaacgcggatgagagacaagaagtcggcgaggctagaatcagagaggagcgaaggagaagagagggcaggaagacagctcaggaacagagaacgaggacactagaggagggagcgcatggagagagaagagagggagaggcaagagaaaagagagcacgaggagagtgggcgaggcaggaggggagaaacgaagaggacaacggaagggagagatagacgagagaagcgggtgcagagagccggaacacggacagcaggggcgagcggacggaagaacgagaagcgtaaagaacaagactaggacagaggaagagcagagctagtgtacatagggagccaagagaagaaaatcacaagagagggaggaagacacagagagacagagctacagtcagtggagagacaaggagaagaacgagggagaaag

SEQ ID NO: 631967 - DNA, 480 bp, Homo sapiens
agcggggtctgcgttgccatcccggccctgctggaccgcgtgggtcagtaggaagccgcggtggatggtggcgagagaggacccaggtgtcctgagacagtgagtgcaggccggcgagtggcacacgctggtgccaaggatgcaggcggccagggtgcggagacatgttcgccaccgaccctgtagatactccatatccttgatttcgtccacacatgtatcgggagttggagatgtgcacactaaaggagagcgcatcatggggaactggacacaatctggacaactgaagtgacacatacgacacacacttgacctcgaccacacatggacgacaccatgaacacacaacacaacaagatgcacattagaacgaggtcagcatcaaaaagtaaggggcccccagcggatcgaccacgcaagcatgggcaccgacgaacagaaaggcccagaaccccgacctgccagagaacagaccac

SEQ ID NO: 631968 - DNA, 1478 bp, Homo sapiens
  misc_feature (173)..(173): n is a, c, g, or t
ggcccagcggagggtggaacggcgtcggtgcgagcttgtgggccgcgctggtcctaggggccgtggcgctgatggccggcgtgatcgcgggtgtccgtagctcgcatcgatgggttgggcgtttgacggtgctggcccgtgcgggctgtcagtgcacttccgtatcgtcccantaagcagttggtgccccggggggacatcattataacggtgataatgcttcaactgtatcgacctcgtctaagggacggtggaccaattgacgtcaagtggacagagtgaaggtcttggggacgcgagccgcacagacgcatcgcaagtcaacttatcagccctgtcaccgcattgctgggatgagctcacacaagggcgaaaggtacactaatactcggtacgttgcagcagctagtattcaaggtgtccatgcagggatggctgggagctgcgtgacgcaagttgacgttaactggctcatttggacgctaaactacgtaaaaagacccgtcgagttctagcacaataggggggcacattatgtctgatttgtaccgcttgcctaggaaaaaatcttcggcaggcgcaaattttcgaagattgttggtagcctacatatatcaaggacggacaggtcgtgacttcaaaccatgtggccccctggggtgggcaatatcgacaaaagctgtgacgcctgggtccgaaaagtcatcgggtcggaagttcgtagggacccacatcggtacaattccgtcgtcgacgtggcaaggcgtgctaggatcccaggaccaagacgccttagtctagccaggaggttgggacaaccccttttctttcgaattccttacccggggtatgaaaacggcttggaaaacggggggccctaggttggttacccccttggacacaagggggccgaaagacaaaacatttaccacttggtgttttatgtaccttacagggaagcgcggaactacatatgaaaggtgttatacttaaacacttggagaggccttagaacacggtgttcgacccttttggttcaccctgggaaggaggggggctttgaacaaggaggggttgtgagcttcgaagaagcccctttgggtggaggcacagacaggaaaacaaggcaggggtgtcccaagagtggagcctccccttggggagtcccccaaagacaagggtctcctcacaggattccccaaccttttccctaggcttgaagacctctattccggggaacttcacgaggactcggcacagaaaccccgaggggggcacccaagcagggcggggggggcacaccatgggggggggcaaagaacggtgggcgaacgcgacagccgatgatcaccaccgggaagcagccagacgaagacgattcatcagaagacctgtatgaaacgaggcttgcccagcggattacaccacgggagacacccctcatagacctcacacgcggaaaaaagaaacaggtgaga

SEQ ID NO: 631969 - DNA, 1304 bp, Homo sapiens
  misc_feature (687)..(687): n is a, c, g, or t
gcctccatagctggtagaccttacataaggcctatgcagatgtgagtgtgcaagttgcctggtagctgtcgtcaatgatgctgatgcgattatcactgttctgccaatcccaacattttggttggacgatgagatattcctggatagagagtgagaaccatgcgacgatcggctgacgcgagccacgtgccgtgtccgtggctgcgatctctaactctggtggctcgaatggatgatgaatttacgcaaagtaatgcataatactgacgcctcactcccgactattacgtggagcacttgaaggattgatgcccaggtgtgtgccatcatcgatcgtgtgcagcgctacctggaggagaagggcactacctgacgaggtctagccgcagtctacactgactgcgtcattccgtgcatcgatccttagctacagagtattgacttatcatatgcgcccagtcatgtcgcacagtctgaccccgtcctgagggctcctcaaagtctgatgcaagaccaggcagaaagatgagggcgatgactcggctgtgttgatggagagactgtgcaagtacatctacgccaaggaccgcacagaccggatccgcacatgtgccatcctctgccacatctaccagcgcgagtgcagagcatggtggtagatgtggcaaggatggcagcatgtgccgnacatgctctgactcgcgctggtaccaggcccggactcatgctcatgaccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagccggcgccgtcaggtccccttccaacctgcatcatcaaccgtggaggctgctggagtgtgtctacctggtgtctgccatgctccgtggagactccccttacatggccgcccatgtgagagcgagtgcccgccgacgcaatgatcagcaagcagttccaccaccaggctgcgcgctggggcagagcgatcgaggcgcccgtggcatgggatccgccctgtagtctccaatggcgaggaagcatgtggatcgcctgacctccaagtgccatggaagaatgggtgactgggaagcacctgtcgacaggtttgtatcatcaatgagaacgatgaatgggaaagtgtgcgga

SEQ ID NO: 631970 - DNA, 1004 bp, Homo sapiens
aatctgcgatggcatcctaatgcttaccgaacgaaaactactagcgctatatacaactacgcaaaggccccaacgtatgtaggcccctacgggctactacaacccttcgctgacgccatatacactcgttcaccaaagagcccctaaaaccctgccacatctaccatcaccctctacatcacctgccccgtacctatagctactcaccatctgctcttctactatgaaccccacacataccccataccaaagcccactgtgacacaccactgaagctaaagcctacctatataatatcatagaccacctcgtagcgctagcccgcacactaatacaagtacgcaatcagaatacaagaggagtgaagcgaatcgaaaaactacaaaaacataccatagccaacaagcatgtaagatgaaggcgagcataacgatggcaaggaacagacacacaaacaacgaaatcatacactggtgtaaacgatcaacaccgtagaacagagacaaatatcgaaagagaatccactcactagtaactagaagtaaagacataagattacaataggaaatccgttcatcacgaaacacctaataaaatcaaaaacaaaaacagaacgagaacaaacacatacatagaatttaacaaagcgaaagaaacaaatattagaagatacgcctagagaaaaccaaaaataaatataatgaaatatacaagatatatgcagacacgaaactacagggagaaaaggaacaccatatatcagacaaatatctcaagcaaatacaaaacacaagaatgagtaacgcaaaagtggcgacagatcagaaacacaattaaaaagagatcgaacagatagagaaacataaaatataaacagagataaaatcaaacatagaaagacaacatatcgagtacaaatacatacgaacattataaatagtaagaatgagacacaacaaataatagaaataaagaaacactcagtcaacaacataacaaggaaa

SEQ ID NO: 631971 - DNA, 943 bp, Homo sapiens
cctagcgcccctggaagccaagaatatgaggaagtcttcttccttcgcgccttcttcttccttacgctccaggcagcctgacagagccgctcgaaggctctgctggccgcggctagccggtttacccattccactggacccagccaccacccactcctgctgtctggtaaactttcctcctgtttctggggccatgtctggcatgaagagtttttactgaatagttttcattgatcgcaggccagttctctcttctcacccctttattgaagtgacagtgaaaatctaagtgagaaagcactgttacaggggctgaaaaggctacaggagaccagagccattgacttttatttttaaaatgaagatctcttttacttgaaggaacttaagaattttggcattcaaataggggctggaagacttgaaagcagtagaaatttcaccacaggtgataggaaaggatgatcacgaaatgaatatctcctgacttgcacacctagtgagcagagccaggaaggacctccttcaccttagcatttggaacaggctgcaaagttcattcttcctcatagcagcccctgcattcagtttggtttagttgttttatgtggtttctagcctgattttttttttcagggtgcagcagaagtctcaggtagctgagaagttcatggaatcttcttatttgctacacctttcactactgcttgtgatatagtgcagggttgggatgtgcagacatttctcaagtgcactgtgtacctacacagcatgctgcaatttggctactgaagtcaagagaaactggtttgaacaactactgagtgtaacataggaagcgcatttcatttgataacaggaacacagcttttgtgctaataaaatgcttcgccacttcccacaccacaccatcccccccatcttccacacacctgctcacatc

SEQ ID NO: 631972 - DNA, 275 bp, Homo sapiens
  misc_feature (35)..(35): n is a, c, g, or t
  misc_feature (38)..(38): n is a, c, g, or t
  misc_feature (42)..(42): n is a, c, g, or t
  misc_feature (46)..(46): n is a, c, g, or t
  misc_feature (51)..(52): n is a, c, g, or t
  misc_feature (57)..(57): n is a, c, g, or t
  misc_feature (85)..(85): n is a, c, g, or t
  misc_feature (90)..(90): n is a, c, g, or t
acgtgggacctattactttaaagtgaattggaaanaanatantaantcacnngtganttattatgttgtttccaattcactttanagtantaaactatatataaaaaagctttcttgtaccatctgaaaccttctcatgtgtatatcagtactttgggaaactttgcataagaccatctgggtctactggttgaatggtaagagaagggagtaataaaaaaataagaaacaaaaatgatactgttataagcttataagccatggagtaaatggca

SEQ ID NO: 631973 - DNA, 1250 bp, Homo sapiens
gcctccatagctggtagaccttacataaggcctatgcagatgtgagtgtgcaagttgcctggtagctgtcgtcaatgatgctgatgcgattatcactgttctgccaatcccaacattttggttggacgatgagatattcctggatagagagtgagaaccatgcgacgatcggctgacgcgagccacgtgccgtgtccgtggctgcgatctctaactctggtggctcgaatggatgatgaatttacgcaaagtaatgcataatactgacgcctcactcccgactattacgtggagcacttgaaggattgatgcccaggtgtgtgccatcatcgatcgtgtgcagcgctacctggaggagaagggcactacctgacgaggtctagccgcagtctacactgactgcgtcattccgtgcatcgatccttagctacagagtattgacttatcatatgcgcccagtcatgtcgcacagtctgaccccgtcctgagggctcctcaaagtctgatgcaagaccaggcagaaagatgagggcgatgactcggctgtgttgatggagagactgtgcaagtacatctacgccaaggaccgcacagaccggatccgcacatgtgccatcctctgccacatctaccacatgctctgactcgcgctggtaccaggcccggactcatgctcatgaccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagccggcgccgtcaggtccccttccaacctgcatcatcaaccgtggaggctgctggagtgtgtctacctggtgtctgccatgctccgtggagactccccttacatggccgcccatgtgagagcgagtgcccgccgacgcaatgatcagcaagcagttccaccaccaggctgcgcgctggggcagagcgatcgaggcgcccgtggcatgggatccgccctgtagtctccaatggcgaggaagcatgtggatcgcctgacctccaagtgccatggaagaatgggtgactgggaagcacctgtcgacaggtttgtatcatcaatgagaacgatgaatgggaaagtgtgcgga

SEQ ID NO: 631974 - DNA, 1218 bp, Homo sapiens
cctagcgcccctggaagccaagaatatgaggaagtcttcttccttcgcgccttcttcttccttacgctccaggcagcctgacagagccgctcgaaggctctgctggccgcggctagccggtgaggagggtggggggaggggccgtcccgcgtgtgggggagtctgaaggcgaccaacgagagggagggccggagcggggaggtggctcggaggcatgtccagtaaactggggatgaaaatcctcccaggaacccgattattaatgggttgagggaagtggcaggtgcagcggttgcgcaaagacaatgatgcttagtagccaggacttcatggccacaaaattgtgtgtagagagggccacagcagcctgaaaaccattttcgtccccttttaggtttacccattccactggacccagccaccacccactcctgctgtctggtaaactttcctcctgtttctggggccatgtctggcatgaagagtttttactgaatagttttcattgatcgcaggccagttctctcttctcacccctttattgaagtgacagtgaaaatctaagtgagaaagcactgttacaggggctgaaaaggctacaggagaccagagccattgacttttatttttaaaatgaagatctcttttacttgaaggaacttaagaattttggcattcaaataggggctggaagacttgaaagcagtagaaatttcaccacaggtgataggaaaggatgatcacgaaatgaatatctcctgacttgcacacctagtgagcagagccaggaaggacctccttcaccttagcatttggaacaggctgcaaagttcattcttcctcatagcagcccctgcattcagtttggtttagttgttttatgtggtttctagcctgattttttttttcagggtgcagcagaagtctcaggtagctgagaagttcatggaatcttcttatttgctacacctttcactactgcttgtgatatagtgcagggttgggatgtgcagacatttctcaagtgcactgtgtacctacacagcatgctgcaatttggctactgaagtcaagagaaactggtttgaacaactactgagtgtaacataggaagcgcatttcatttgataacaggaacacagcttttgtgctaataaaatgcttcgccacttcccacaccacaccatcccccccatcttccacacacctgctcacatc

SEQ ID NO: 631975 - DNA, 414 bp, Homo sapiens
  misc_feature (45)..(45): n is a, c, g, or t
ttttcctatgtcctaccgtggaaatgtgatacagaaaatatccanggaataatcctctctaccaaaagccttcctgaggccgggcacggtgacttacacctgtggcccttgcactttgagagaatgaggcgggagaatggttggagctcaggagtttgagaccagactgggcaatgtacagagaccagtcactgtaaaaaaaaataaaaataaaaataaaaataaaaaagtagccaggagtggtggcgcaacctgtggtcctggctactcaggaggctgaagtggcagaatcgcttgagccagggaggtcgaggctgcagaggctggagtgaactttgatcatacctctgcactctagcgtaggtgatagagcaacaccctgtcttaaaaaataaataaataaaaaataagagg

SEQ ID NO: 631976 - DNA, 304 bp, Homo sapiens
ataatctttcttatgcatgtggaagggatgatgaatgacctcatcctatacctccttctccaacccaccagtatcgctgatatcctggtcaaacctgcatctacactggttcatgccccaaggcctcttgtagggacttccacatgggtaatgagggctgccctttttattttactattatgagtagtggatgctaattctggatatgctcaatgttctccctcacaaggtaggccacaaattcttggtgttgccctcacatctggggtcttcaggcaccagccaatcctgccgtggattgctg

SEQ ID NO: 631977 - DNA, 434 bp, Homo sapiens
  misc_feature (97)..(97): n is a, c, g, or t
gggggggtctggccccggcttgggctaagcagggcgaggcctgtggcgggttccctgggccccccgggaggggggcagccatcacaagcggaggttnagccgagcccccctaaatgtattccctggtgctggtagaagagtctttggggttgctcccgaaagccgtgctctccagcctggctgccagggagggtgggcctcttggttccaggctcttgaaatagggcagccttttcttcctatctctgtggctttcagctctgcttctatggtaattaggagaatagatgggtgatgtatttccttatgttgctttttcaacaaagcagaattaatgtagggagctaaatccagtggtgtgtgtgaatgcagaagggaatgcaccccacattcccatgatggaagtctgcgtaaccaataaattgtgctttctc

SEQ ID NO: 631978 - DNA, 1010 bp, Homo sapiens
gctctttctggtcaaaatggctggtaagcaggccgtttcagcatctagtgcaagtggctaggtatggtattcgaaaagttggtattagaatgctgcatggattcaatagatcatgggtgttaatgcagagattgatacaatatacgaggatgaagattgtataagaagccataagaagatttcctgtagaacctttgagtaatgacgaggatgtttcgccattaaagagggcacctggaccctgaacctgttatagcatcagatctatgccctaaaggatcagtggaactcaatatatgactgagcgaacaaatcttctaaccttgtaaccgtgattcttggaaatgaggttattcgggataagaatgatgaacacgcagaacgaatggggcaacatgaaggtaaatcaatgctagttgaaagtctcgtggactgtcatgcctgttactgaacgcactgggttaaagcgttgagagatcaagagcaattgttacagaaattattctgggactgaagcatggtttatatctttagaatgatctgtctattgtttaaacacttaacaagaaaggtaacaacgaagatccaataatactttgtggcggtacggaagtaatgtggctccgtcaggtacaacgactttatcccgcaactctttgccccgttgtaggccggtggtgggactcacgtatggttggttgttgtaccagcgagcgtccactgactgcgtgtctgacactgggtgagaaaccccacggacgcgttaagagagtctccagtgcgttttcgggaattctgggtcccccactctaataaacaaggtctgccaggggagaggtatgcatccaaagcatttccttagcaaggggtactcccccaatggcgtgtcaccaaggttaccaaacgtgagggacgctgtcactcggtgtggctcacagtggggtctggggattcacaattgagaccggcactctctgaaggggcctgcgggaacaggccaaaacaagcag

SEQ ID NO: 631979 - DNA, 106 bp, Homo sapiens
taggtaataatgtgattcctaagttttcaatcttagggaactgaaccgtagatgctgatgtggtcaacgtagtcatatggaaacaaatgaggagaatgatttcaat

SEQ ID NO: 631980 - DNA, 652 bp, Homo sapiens
cgctatacacaaaaatcaaatcaaaatggattaaaggcttaaatctaagacctgaaactacaaaactagaagaacacactggagaagtgctccaggaccttggtctgggaaaagatttttttgtttaagacctcaaaagcacagacaacaaagcaaaaacagacaaatgagattacattaagctaaaaagtttctgcacagcaaaggaaacactcaacagagtgggggagacaacccacagaatgagagaaaacattttcaaactatccatccgacaagggattaatgaccagaataaagagaccaaacaatttaagccaaaaacaaaacaaacaaacacacaaaaaaaacaaaagccaaataatctaaaaagtgggcaggtgggtggggtggctcaagcctataatcccagcactttgggaggccaaggcaggcaggtcaagagatcgagaccatcctggccaacatggtgaaaccccatctctactgaaaatacaaaaaaaattagccgggtgtggtggcatgtgcctgtagtcccagctacttgggaagctgaggcagtgagaatcgcttgaacctgggaggcagaggttgcagtgaaccaagatcacacaactgcactccagcctgatgacagagcgagactccatct

SEQ ID NO: 631981 - DNA, 974 bp, Homo sapiens
tcatttccagctgttggatctaaagtgagaaatttgcaactccttctttcacttgaacagttagaggccattgtggggtaatgaattggcctaatttcaatattgtccctcagggaattaggaggcctggcgaagaggaggagagaggggagagtggccagttggtggagcagtgagaacatagcatttgttaagtttgctgtcttcgaaggttgtggtttgtggtaccccaaaacaattaaaataggaacatcaaagatcacagagcagccgggcacggtggctcacgcctgtaatcccagcaccttgagaggctgaggtgagtgaatcatgaggtcaggagttcgagaccagctggccaccatggtgaaaccccgtctctactacaaatacaaaaaattagccgggcatggtggcaggcacctgtggtcccagctattcaggaggctgaggcaaggagaatcacttgaatccaggaggtggcagcgttagagtgagctgaggatcacaaccatgcactccagcccaaggtgacagagtgagattccttctcaaaaacaaacaccacaaaaaggggggggcggcattaatttcgttataaattaaaagactacatcggttgtgcaacaccgcagcaagaacagcgactagggaaatgaaaaaacaaacctgaagataacgagaaaacgtggaaggggacacaaggcggacacagaagccagaagacgcccccgcgacaaggacgagagcgaggagagagacgagacaaaaggagcaaaacagtaggaagaaagctagcggcaaagagacgacagcagagaggtagaacgtagagcgaagcacagagaagaaacagaagacagaagcaagaagaagtaacacgagcagggaagaagcagaataccaagtagagaaaaaagacaaggcaaaggaagctacagaagaggaaataaggcaggaagaagagaagaaat

SEQ ID NO: 631982 - DNA, 676 bp, Homo sapiens
gcggagggatgtggccctggaatattggtaggggggtgcccgggtggctgtcatgcaggtaccccgcgctggtgtgcctcgcctcgccgctcactttccagcgcacgcggacgccgcagcggacactccagaacgtgcctggccctgcagctgtgtgcctgcacgcgactggcgacccgggctctcccagctcattcccatccgtggtggagcagactgggtctgcggcgagcgctgcctatgacatctactcgcggctgctgctgggagcgcatcgtgtgcgtcaatgggcccgatacgatgacagcgtaagccagccttgttatcgcacagctcctcttcctgcaatccgagagcaacaagaagcccatccacatgtacatcaacagccctggtggtgtggtgaccgctgggcctggccatctacgacacgatgcagtacatacctcaaaccgatctggcaacctggtgcgtggtgccagggccgacagccatgggctccctgcattctctgccagacggcaccccagggcatgcgcccactcgctccccaaactcccgtatcatgatccaccagccctcaggaggcgcccggggccaagccacagacattgccatccaggcagaggagatcatgaggctcagaagcgctctataacatctagcaagcacacaa

SEQ ID NO: 631983 - DNA, 215 bp, Homo sapiens
agaatttgaatgtttatagtttaatggttgtttggaagtgatttaagtattagaggattgctttaggctagagtcataataggtaattcgtagattgagaaatactaggttggaatataaataggggaggatggtgggttcgccatgttatggtatgaatcctcgcatgtcagtaatcagtgatctattagctataaaaaagaaaatgaaagctc

SEQ ID NO: 631984 - DNA, 250 bp, Homo sapiens
agtctgctgaccttcactcaagtgcgcgtagtcttgaaagcagtgcgaccgctttgcgggtccggctgcaagagtttgacggagcgttgaaacaacttcagcgacataggcttttccacgctgccgcccttcgattttcagagctgaaacgccggctgcacagagttcgtctatgtggttcatcacatcgagagatacaggatcttcaaatgcatagccttcttcatcgccgatgttgaaacgccctttg

SEQ ID NO: 631985 - DNA, 280 bp, Homo sapiens
  misc_feature (35)..(35): n is a, c, g, or t
  misc_feature (61)..(61): n is a, c, g, or t
  misc_feature (105)..(105): n is a, c, g, or t
  misc_feature (120)..(120): n is a, c, g, or t
  misc_feature (123)..(123): n is a, c, g, or t
  misc_feature (127)..(127): n is a, c, g, or t
  misc_feature (141)..(141): n is a, c, g, or t
  misc_feature (151)..(151): n is a, c, g, or t
  misc_feature (159)..(159): n is a, c, g, or t
  misc_feature (172)..(172): n is a, c, g, or t
  misc_feature (174)..(174): n is a, c, g, or t
  misc_feature (199)..(199): n is a, c, g, or t
  misc_feature (215)..(215): n is a, c, g, or t
  misc_feature (234)..(234): n is a, c, g, or t
  misc_feature (238)..(238): n is a, c, g, or t
  misc_feature (273)..(273): n is a, c, g, or t
atgaacaaaaaggtcatcataagggacagcctgtnagtttatgcactgcatactgcaaatnacccactccagcaatgggaagacacccctaacattgcttctttncttataacggaaatnttntttnttatcagctttaanatggttcttntcactctntgcagtctccgtngnaacgtcccataagcccagggttttnagaccttttttctgtnctctaagcctacatatctnactncctaatggccttttcacttgattgacacatcattnagtttca

SEQ ID NO: 631986 - DNA, 297 bp, Homo sapiens
aggtggtgggagatgagtctcaaagctaagtaccggaaactgggcacagtggctcatgcctgcaatcccatcacttcccgaggccaaggctggaggatcacttgagcccaggagttttatatcatcctgggcaacatagcacgacctcatctctgctccaaatcactaataaataaattatctgggtgcggtggtgcatgcctgtgatcctagctactcaggaggctgaggtgggaggatcgctagagcccacagaaccaaagatacagggagccatgatcatgctactgcactcca

SEQ ID NO: 631987 - DNA, 99 bp, Homo sapiens
  misc_feature (80)..(80): n is a, c, g, or t
gcacgaggcagaactatcctagagattagccactatattttacttctttgccatcagcaagagtaggattcctaccttgncttgatgaaatcctactct

SEQ ID NO: 631988 - DNA, 168 bp, Homo sapiens
aaaaaaaggaatttttttggggataaataaaaacttgcctgataaactggaggcaatgtttggttcctccaaaggttttggtggtgtcgggggttttgccctccctcccttttaactgttttaaaccccttttttttgttaataaaagtggggcatttggccctttta

SEQ ID NO: 631989 - DNA, 105 bp, Homo sapiens
cctagttttagaagtgtcaatagcaggaggcagctctctagacatgaaggctattcacgtcccatgtcaagtctagctagagttcagagcaattgagaagtgcaa

SEQ ID NO: 631990 - DNA, 1206 bp, Homo sapiens
  misc_feature (340)..(340): n is a, c, g, or t
taacggcagccactttaattttcccttacacaaggacgtgtggctgggggcctaatggtcctcacttaacagtaaaaacaccaaaaattgtggtgtgctcactcttcttctcaagagaaatctcgagaaattgtgcgttacaaaaaaacacctttacattaaatttaagaaaatgtgattcactttcacgggcgttaaagtgcaacccgttctccaacctcaagagcagagttaacgagcccagcgggtgtctctcgtggcccaaagagacacctctcgagcttagagaacagaggaacacacgtgggtctcctatagcggctgtgggacacttatctcncacacccgtgacacgagacacccccgcaagagacaccaaacacaccacagcgtggtctctctttgtgccgagcctctcttgagagagaaaaaatctcccgagaaaaccactctcgagcccccgtgaacgcgcgttataattccccagaggcggaaccgagtctatacacttctccaattcaccagaggctccaacatatctcgagcacaccagagttctctaccaatctcccgagtgtgcgtgaatactcgagaattcaccaagctctctcagaggaacacattctctctttctcagaagggcgcttatattcccaggtttctcgagagagggctataacgcatgtagagggtgctgtcgccattttgcgcccaggggggcaaattttctcataatctccctcaaattataacccccaatgtgccagcacaatgtgcatacggcaattcttgctggaggtcccccggttatagaagacgcatttgggccgggggggaacacagtggacaggcggccccccgaactctccgctcagaaacctcccgtgtatgggcataaatctccccacaattcgtgctcgtgcaaacaaggggttgccacaccccatacgaggcccccagcgcacatggggcacccccaacccggatatccccaaccacgcggaagcataactttgccagccccccgaggaggggactgcacgaaacgaacaccttgaggaaacttcccaaggggacggcagtggcaaccgcccccaagccgcgcgcagacatcctccccgctatcgggccaaaccccgggtccgggacacaaggcccccgggagtaccacaatggccgcggcacccacgccccgaaaaagccccc

SEQ ID NO: 631991 - DNA, 405 bp, Homo sapiens
  misc_feature (14)..(14): n is a, c, g, or t
  misc_feature (379)..(379): n is a, c, g, or t
ggggctcaagaggngtcctcttctgtaagaggacaatgtctcctggagcttctctaaactgtcccattgaaatctgggcccttctgttgaagactgtccagagcacactctggtagcaggggggagttgtgagtgagccgttgtagcggaagaattgctccagctgttgggggaacagctctctcacgctgaagggaggcacagaggtcttctgatctttgtatcttatttcatgtagacgactcagaatgtgatcataagctggattctcagtctcgcccacctcaatgaggatgcctaggacagccaggccctgtggcttctgagctgcctcactcaagctgctgtaggactgggagtcatagtgaaccacgtggtntccgcaccgtggcttcactgttgatc

SEQ ID NO: 631992 - DNA, 1313 bp, Homo sapiens
tacgccgaagttgccaggtacatcgtgggattgctcgtgctctttcacgtcttcgcgcttaaattcgggtgtcttggatgaataatcaaaagctagcagaagccgaacggcgtatcgatggccagcgtttgtagcaactcattacaagacagagcatgcacacagagcaggtttgacccgtactcagttccgaagactgtaattattcgaatggcattgaactgaatagccggtactgagtctggaacgcgcgtagctaacgctatcttgatgactctactggaggcaacaagcttgagttaccggtcgcatttgcagggataacatctctatcgagcacttgctgtgtggctgtgtggtagatgctgggcccagtgtggtacaaggtggccagatgagcatgatgacgtagcagagtgatctgcggtgtacgcagtcccaaggaagatctaggagaccatgcaagcattctgcatcaggttcttgtaacacagttacctcacggcgcgtacaaattacctggaggaacagcgtgacgacagactgaccgtacatgaacgcgtgcgtggactgtactggaccgggatcgtatgcacgaagtcggagtaggacacaacgcctatcttactgcgtgacctcggatggtcttctgcgctacctggcaagcgactttaaggtgcagtccagtaccattcacgtaggcactcttactaacatgaccaactccggctcacacgaaggggagattgcagcccagctcttgggctggtgcacgctccttccacaattcagtggactccactgaccatcacgatgttccactgccaagcacgctggggcaactcctccggcaacacgtcagccgtggatacccagacgtgcttgcaaacccatcaacatgtccactaacgcacagctgttggacaccttccacacaatatataatcggaggacagggcccgcacaccgccagcattgccagcacaacagggtacggaaatcgcggaaaagccgctcggagcgacagaaaaggaaggtccagaacgacaacccacgcgacacgaggtccaggggaggccacccataaaggccaatgaagcacacagcccagcacgccagtcgcacaccagaaaggtacgacaacagccagaaggaaaaatcgagacaaggacaggcgacgcaaccgcgacacaagacaaaacaacgcacacgccagcgcgctgagcacgccccaaccgacacaaaaggcagcagagcccacaaaaccaccaagctatcaaagcaaaataaacgaaaacaacccacacacagcc

SEQ ID NO: 631993 - DNA, 132 bp, Homo sapiens
gctactctatgatgatccccccgctgtaccagttgcgatgggagccagggaagatggggtgctggaggagagctatgtggtgagccaatggagcacctatggacaatctgtgcgtctggcaggacgtgatga

SEQ ID NO: 631994 - DNA, 253 bp, Homo sapiens
  misc_feature (5)..(5): n is a, c, g, or t
  misc_feature (7)..(7): n is a, c, g, or t
  misc_feature (9)..(10): n is a, c, g, or t
  misc_feature (16)..(17): n is a, c, g, or t
  misc_feature (19)..(20): n is a, c, g, or t
  misc_feature (23)..(25): n is a, c, g, or t
  misc_feature (28)..(29): n is a, c, g, or t
  misc_feature (109)..(109): n is a, c, g, or t
  misc_feature (184)..(184): n is a, c, g, or t
ggcgntncnngacagnnannaannnacnnttgtgcaggtcgggggagtgtaaaatgatactgctgtgtggaaaacagttgggcatttccccaaaatttaaaaatagaantgacatatgacccaacaattccacttcaaggtatatactcacaataattgaaagcaaggtcttggagagagattngtataaccactttcaaagtagctagaccataaaagtgtccagctgcagatgaatcaatcctgcttatct

SEQ ID NO: 631995 - DNA, 173 bp, Homo sapiens
tagaatgagcgggaccagatatcagagaaccccggaagtctgtggggttctcgagagcctgcttgagaccaccccaggctgggggtgccaccccctgccatctgcctccatcttcacgccgcatcctccctgcctgcgctgggaggccgagctgggaggacgggtggggagaa

SEQ ID NO: 631996 - DNA, 223 bp, Homo sapiens
gcttatttcggtgtcttagggtctcgagcctgtctggcctagtctgggctcataaattcttgtcgactgcctgtgccgatgcacctacttctgtgcctgcatctgggcacagagtacacttgactgtgtcaaagtaatccactcccaataggccaccagtggtcactaagcatttctgggctagaagagcgagggcccagatatccatacaggacaaataaac

SEQ ID NO: 631997 - DNA, 272 bp, Homo sapiens
cctcttgtcatgactccctgattctctttctgggatgatgctgcttcagaacagggctttgggtctttcccatccgtttctcctttggcgtcttcttcagtctcttccatgtcatcctcatccttttcagggtcatctggatcctcccagtgaagcagacggttagggacttcagcaaggaaatgaccacagtcctgctgaatgttaaagtggacagccagactctgccggacagccaagctgtgataatactgctgaagggcccgagagta

SEQ ID NO: 631998 - DNA, 792 bp, Homo sapiens
  misc_feature (705)..(705): n is a, c, g, or t
  misc_feature (727)..(727): n is a, c, g, or t
agcggcattgcgcgcgacccggcggcgggacaggcttgctgcttcctcctcctcggctcaccattccagaccaaaattgaaaaaatggttgacctcacccaggtaatggatgatgaagtattcatggctttggcatcctatgcaacaattattctttcaaaaatgatgcttatgagtactgcaactgcattctatagatggacaagaaaggttttggccaatccagaagactgtgtagcattgtggcaaaggagaaaatgccaagaagtatcttcgaacagatgacagagtagaacgtgtacgcagagcccacctgaatgaccttgaaaatattattccatttctgggaatgtggcctcctgtattccttgagtggtcccgacccctctacagccatcctgcacttcagactatttgtcggagcacggatctaccacaccatgtgcatatttgacaccccttccccagccaaatagagcttggagtttttgtgggatatggagttactctttccatggcttacagtgttgctgaaaagtaaatttgtacctgtaaggaaaaatcatacaaatcagcatccagtgtggttttaaagaattctgtacttccaatttataagtgaatacttttctttagatttagggtaggaggggagcagaggaaatatgaactggggtaaacccatttgaatattagcattgcaanatcctggattcttgtttacatntggttagaatttcacatgtatcttaagttttgtccgagtaaggacttctataaatgggcaggacc

SEQ ID NO: 631999 - DNA, 921 bp, Homo sapiens
  misc_feature (834)..(834): n is a, c, g, or t
  misc_feature (856)..(856): n is a, c, g, or t
agcggcattgcgcgcgacccggcggcgggacaggcttgctgcttcctcctcctcggctcaccattccagaccaaaattgaaaaaatggttgacctcacccaggtaatggatgatgaagtattcatggctttggcatcctatgcaacaattattctttcaaaaatgatgcttatgagtactgcaactgcattctatagatggacaagaaaggttttggccaattctcgagtaagacgtagtagtgatgccatctatggacatagaaggacgatcaaatggcgcaaagtacatgtcactcgttccgaagcgaagatgaaccaagagtagcaaacgttgtaacgcacgtaggcccaaccgttgacactgaccgttggaaaacagtatctgattaccgatgtctgcgtatggacatgtgcgcctacctgataattccgttggtacgtgagtccacgagtccacgtcttacagacacaattccttgacaacgttcagaaggcgtatgttgtctgggaggacaccgggaatcgtacgctaacatctcaattgtcactattgtagacctagcgcccattgcccgaaggcgcagagatgatgagctctgtggaagtcttgttgtagcttgggatatggagttactctttccatggcttacagtgttgctgaaaagtaaatttgtacctgtaaggaaaaatcatacaaatcagcatccagtgtggttttaaagaattctgtacttccaatttataagtgaatacttttctttagatttagggtaggaggggagcagaggaaatatgaactggggtaaacccatttgaatattagcattgcaanatcctggattcttgtttacatntggttagaatttcacatgtatcttaagttttgtccgagtaaggacttctataaatgggcaggacc

SEQ ID NO: 632000 - DNA, 425 bp, Homo sapiens
gctctgtcagtatccagttgatttatattgatattgaattcaactatattgttactaatttctgcctgctagatctgtttctgatggagggtgctgatgtctcaaattgtgacagtggatccatctatttctccttccagttctgtttttgcgctacgtcctttgaaaatcagctgtcaggtgcatacacattaaggattgtcatctttttggaggattaactgttatgtcatgatgcagtaccattctttatccatcataactttctttctttgaagtctactttgtgtgaaatatagttactctttttttttttttgagacagagtttaactcttgttgcccaggctggagtgagccgagatcgcgccaatggcactccattcagcttgagtggcagaggtgagactcccatctcaaggtaaa

SEQ ID NO: 632001 - DNA, 220 bp, Homo sapiens
  misc_feature (220)..(220): n is a, c, g, or t
agcggtgtcatgatcagagtcaacagcagcactggatcctcttacaaatacaaattagcttttagggtttgcttatccagctgttagaggctagcggagattgtttattaggaggtgagtttcagttagccggatcattcacccactcagcttggtacaaacagatttctcagttaagagacaacaaaagctgtcaccacaaagacacaacaaagaccan

SEQ ID NO: 632002 - DNA, 1373 bp, Homo sapiens
  misc_feature (1373)..(1373): n is a, c, g, or t
gggacgccaggacctcacttcctcctctagccctgcctgtgtgcctcccagcacctggcccataccctgcagactggccccatggtctggtgcctgcgtggctataagcagttcagtgtggggatcaccttcatctgttgcgtggcatcctatgacgtgcacgtctgtgcgtaccatgcgagtggccgaggatccatatctgatgagtactgcctgtaatgagcgagtcttgactaaccaatttcgttccacatccgtacagagatttagccagactaggtggagagtagaatgaccatcgctggctcggcagaatgcatgtattgacaacagggggctgaatgcgtagagatgacttgggaccgcgtgacgaacttaaacatctggggtgtgtccggcgcacggacgggatcttggccgtatgggcatagggtagctcatgtgcggatggggtcggaacttgaccgggaccggccagtgatgcctccagtaggcgagtagaaactcgccgtgcacattgtgagtaggcttagtcttgtatctccacataggtgtggtcgtgggtgcatagcagcgtgtatcgcggataggaatatcatgtggcgccaacgagtaggactggataagggccctcgggaaatcagctcgagttgaatacgaacagtgaactgttgcggacatgtgccatgtgtaggtgactacctggcaccgcgaagactcgcaacatgaccatggacgtgaacgcggcagaccggagaggattctccatggagacggcgagacagaggacagccgtttgcctcccttggaggcacatccagtcagtagagggacaggacgttcccgagggacacacttgagaaggcacaactagcggaaacaaggggccgatgtccccgagggatccacacgtccaggggacaggaagcgagaggctccccgggacatgacaccacggagcggagcgcttgagcaatgaagaaagaaaacagtggggaaccaggagggagccccccacagagtgtgtgtcccatgtatgtcctacgaggagaaaggtattccgtcagggcctactgacacagtaacatacccatggtaagtaacctacacactgcgagagaagacggccagagaccgcgataagcacgagtagagacgccagctgtcacacaagacaagcgcgacatcgaaacagtcgtatcgcaacaaaactagctcagcagtcgaactatgtaagttaagctccactgctcgtgtcgttctagcgtttatcgtgtacttacttcagtcatcgaacgtatagtacagaaacacactctcgacagagcaacaagacgagcgaacacacaaagatcaacaagaaagagaacgcn

SEQ ID NO: 632003 - DNA, 940 bp, Homo sapiens
  misc_feature (853)..(853): n is a, c, g, or t
  misc_feature (875)..(875): n is a, c, g, or t
agcggcattgcgcgcgacccggcggcgggacaggcttgctgcttcctcctcctcggctcaccattccagaccaaaattgaaaaaatggttgacctcacccaggtaatggatgatgaagtattcatggctttggcatcctatgcaacaattattctttcaaaaatgatgcttatgagtactgcaactgcattctatagatggacaagaaaggttttggccaatccagaagactgtgtagcattgtggcaaaggagaaaatgccaagaagtatcttcgaacagatgacagagtagaacgtgtacgcagtcatcgtaaagctgttacgattagcatattgacacggcagagccagaatggggctacaaactgaagtgaaaagtatgttacccgtgtgcaacaaatcgtgaacgtttcatacatacacatatggaacaattaactaaagaccttcaagagcccacctgaatgaccttgaaaatattattccatttctgggaatgtggcctcctgtattccttgagtggtcccgacccctctacagccatcctgcacttcagactatttgtcggagcacggatctaccacaccatgtgcatatttgacaccccttccccagccaaatagagcttggagtttttgtgggatatggagttactctttccatggcttacagtgttgctgaaaagtaaatttgtacctgtaaggaaaaatcatacaaatcagcatccagtgtggttttaaagaattctgtacttccaatttataagtgaatacttttctttagatttagggtaggaggggagcagaggaaatatgaactggggtaaacccatttgaatattagcattgcaanatcctggattcttgtttacatntggttagaatttcacatgtatcttaagttttgtccgagtaaggacttctataaatgggcaggacc

SEQ ID NO: 632004 - DNA, 228 bp, Homo sapiens
agacagtttattccccttctgtttctctctaactcggcttataccaggggtgtgtttccactagatgctcacactattgaggttgctaatatgcattagagatttgggagtaaagaattccggagactgtgtgtggagtgtcctggctcagtatgttcaacggagtacattcgaggaccatgtgttagagaatcgtggtactgtgtgcccttgatggagaccgatttg

SEQ ID NO: 632005 - DNA, 134 bp, Homo sapiens
  misc_feature (38)..(38): n is a, c, g, or t
aggatccccgagtgtcttcaagaaacgggacgactatntggaatggccagagtattttatggctgtggccttcttatcagtcacagagaagcaaagatccaaattcccaggtcggcgcctgcatcgctgagatt

SEQ ID NO: 632006 - DNA, 340 bp, Homo sapiens
  misc_feature (28)..(28): n is a, c, g, or t
  misc_feature (60)..(60): n is a, c, g, or t
  misc_feature (174)..(174): n is a, c, g, or t
  misc_feature (276)..(276): n is a, c, g, or t
gcctgcgggcagccgtgccgagaatagnccccagcacccgcagctacccaacggactcgntatacgtgggggacctccaccccgacgtgactgaggcgatgctctacgagaagttcagcccggcaggcgcatcctctccatacggatcttcaggggcttgatcaccagcggctnctacaactacgcgtatgtgaacttccagcatacgaaggacgttggagatgctctggacaccatgagttttgatgttataaagggcaagccagtacgattatntggtctcagcgtgatccatgaattcgaaaaagttggagtgggcaacatattcgttaaaaatgtt

SEQ ID NO: 632007 - DNA, 1009 bp, Homo sapiens
  misc_feature (910)..(910): n is a, c, g, or t
gtaaagcctctggctgacctgcggccttctctgccttctcgactcagaactggtggactgcgtgtggtctggatccgttatcccccagtgaaatgccctggcagtggtttgcgctcatttattgggatgaacgataagcgctacagttcgtctctgaaagacaggctctccatcatgaatgacagccccagaatcaggtggtccgcttacaagtgacttaaacattgaaacttgttggacacagatcatcatatttaacttgtgcgtagcacaactctctggtacgtagtaggacttcgtttgcctcgctgtggcgtgcagtggactcctctgcgtcagctggaactgctcttcagaacttatcaatcgacaggggtcgccatacggtactatcccgctcgtgcgcaccccttcgcttccaaaggattcacctgctgttgtgtcaccatatggcctagtactgatcgtggctcagtggagctatttgccctcgaaactcggtgcacggtgtcttggcaaccgcacgtcgcggcgtggaagccagtcgatcgttgggacaacttttcccgcatgttcctcacgaggtcctcaaggacttcttagtccctcagagaatgtgttggaccgtgcacctgtcacctaggttggggtgaccgagacctaccatctgctatgtttgaattcacccatcatacctgacacccaaggtggactggaatgttgatgccgcaactttgtgttaaaagtgacacatgacgcaccgcggatccaatgaactgatatcctggagggcaagcggtcagtctttctcttccggccaaattccgaggagccctcttggattcccgtactccctaccgttcaatctgtggtggacgttggcacgaaaagcttttgccagttcactctntatggtcgctggtgcagcgtggttaggcacgaacagattgcggggcgaacaccccggttgtacatccttcttcccacgtgtatgcggaaggtttaatcc

SEQ ID NO: 632008 - DNA, 506 bp, Homo sapiens
ctgtcgcgcctggcgctttcgctttcacgcgcgctaccgccgtggtgaagctgacccagctgtgcgacccatcgtcattcctgcgggatacccttgaccagaaactgcggtgcgcgactggcgagcatgaggtgggcctgcacggatgctgtttgcgcgctggaagcgaggccgttggcaagcagatgctcctccagctccttgaccaccctcgaagccgatttatggctgttgtgggctgaaaccagggggtagccctcaatacgtgtttcaccgtgggcttggtcgtatttccccacgcccaaggccgccagcagccagtcggtgacactgcctttgactgagcgagcctcgaatgtggcttcaattgccttgcccagtgcggtgcctctgtctgaacttatcaagctgctgatcaactgccgcggattcagctgttcctgcgcggagatcgatctgccgttgagcagataatccaggacatgcttgaagggttttaatcggac

SEQ ID NO: 632009 - DNA, 145 bp, Homo sapiens
aattcaagcttctaacgatgtacggggacatgctgaggatgtaaggtaatacatagtatacatactgtatcacctttcgaaaatccaagaaaatcctgaattcttgaaacatattgtccacatcataaaacttgcacagaaaaaa

SEQ ID NO: 632010 - DNA, 346 bp, Homo sapiens
tctagaggcaccctgatattcgtgtccatcgttaaaaaatcaggaaagaacagatgctagagaggatgtggagaaataggacagcttatacacagttggtgggaatataaattacttcaaccattggggaagacagtgtgacaattcctcaaggatctacaaccagaaatatcatttgacccagcaatcccattactgggtatatacccccaaaattataaatcattctaatataaagacacatgcacctgtctgtttattacggcactgttcacaacagcaaagacttggaaccaaaccaaatgccctcctttctttatcgcctgggacacgaatgttcagggta

SEQ ID NO: 632011 - DNA, 930 bp, Homo sapiens
  misc_feature (56)..(56): n is a, c, g, or t
  misc_feature (135)..(135): n is a, c, g, or t
  misc_feature (141)..(141): n is a, c, g, or t
  misc_feature (155)..(159): n is a, c, g, or t
  misc_feature (166)..(167): n is a, c, g, or t
  misc_feature (181)..(181): n is a, c, g, or t
  misc_feature (184)..(184): n is a, c, g, or t
  misc_feature (187)..(187): n is a, c, g, or t
  misc_feature (189)..(190): n is a, c, g, or t
  misc_feature (193)..(193): n is a, c, g, or t
  misc_feature (213)..(213): n is a, c, g, or t
  misc_feature (220)..(222): n is a, c, g, or t
  misc_feature (228)..(228): n is a, c, g, or t
  misc_feature (233)..(233): n is a, c, g, or t
  misc_feature (237)..(238): n is a, c, g, or t
  misc_feature (240)..(243): n is a, c, g, or t
  misc_feature (252)..(253): n is a, c, g, or t
  misc_feature (282)..(283): n is a, c, g, or t
  misc_feature (285)..(286): n is a, c, g, or t
  misc_feature (288)..(290): n is a, c, g, or t
  misc_feature (293)..(293): n is a, c, g, or t
  misc_feature (297)..(297): n is a, c, g, or t
  misc_feature (306)..(306): n is a, c, g, or t
  misc_feature (308)..(309): n is a, c, g, or t
  misc_feature (314)..(314): n is a, c, g, or t
  misc_feature (329)..(330): n is a, c, g, or t
  misc_feature (334)..(334): n is a, c, g, or t
  misc_feature (337)..(344): n is a, c, g, or t
  misc_feature (373)..(373): n is a, c, g, or t
  misc_feature (381)..(381): n is a, c, g, or t
  misc_feature (386)..(387): n is a, c, g, or t
  misc_feature (389)..(390): n is a, c, g, or t
  misc_feature (394)..(394): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (404)..(406): n is a, c, g, or t
  misc_feature (408)..(409): n is a, c, g, or t
  misc_feature (412)..(412): n is a, c, g, or t
  misc_feature (418)..(418): n is a, c, g, or t
  misc_feature (423)..(423): n is a, c, g, or t
  misc_feature (425)..(425): n is a, c, g, or t
  misc_feature (427)..(427): n is a, c, g, or t
  misc_feature (431)..(431): n is a, c, g, or t
  misc_feature (435)..(436): n is a, c, g, or t
  misc_feature (439)..(439): n is a, c, g, or t
  misc_feature (441)..(441): n is a, c, g, or t
  misc_feature (444)..(444): n is a, c, g, or t
  misc_feature (447)..(448): n is a, c, g, or t
  misc_feature (451)..(451): n is a, c, g, or t
  misc_feature (458)..(458): n is a, c, g, or t
  misc_feature (465)..(465): n is a, c, g, or t
  misc_feature (471)..(471): n is a, c, g, or t
  misc_feature (476)..(476): n is a, c, g, or t
  misc_feature (483)..(483): n is a, c, g, or t
  misc_feature (485)..(485): n is a, c, g, or t
  misc_feature (496)..(496): n is a, c, g, or t
  misc_feature (504)..(504): n is a, c, g, or t
  misc_feature (506)..(506): n is a, c, g, or t
  misc_feature (512)..(512): n is a, c, g, or t
  misc_feature (514)..(514): n is a, c, g, or t
  misc_feature (519)..(519): n is a, c, g, or t
  misc_feature (521)..(521): n is a, c, g, or t
  misc_feature (523)..(523): n is a, c, g, or t
  misc_feature (526)..(528): n is a, c, g, or t
  misc_feature (531)..(536): n is a, c, g, or t
  misc_feature (540)..(540): n is a, c, g, or t
  misc_feature (543)..(543): n is a, c, g, or t
  misc_feature (556)..(556): n is a, c, g, or t
  misc_feature (559)..(559): n is a, c, g, or t
  misc_feature (561)..(561): n is a, c, g, or t
  misc_feature (564)..(564): n is a, c, g, or t
  misc_feature (569)..(569): n is a, c, g, or t
  misc_feature (587)..(587): n is a, c, g, or t
  misc_feature (721)..(721): n is a, c, g, or t
gttgcattgtacacttttaattgcatgggtagttttaaataaatggagaaagcacntttcagaagctacactagcaggaaaaaattccatcaagcatttacatagtaaatttctataatttcacaaaagattctngatctnacttgaagtatacnnnnnggaaagnnccccctcagcaggngtnccngnngcntacagaagcaaactaaaggncctaaannngggggnaagcnaggnngnnnnggggggggnngagaaatgataaagaaccattcataaatnngnngnnnacntcangagatttgngnnatganccttacataataggnntttnggnnnnnnnnaccacccttttaagataaaagtacaatcntaaaagcngtagnncnnaatnanagnaanannncnnacntccagnaatangncncaanaccnnggncngcnggnngtnaaaaganaataccngggggncatcnatgagancngaacaaatagnggaattcncnaggacngnatacncngnatnnnggnnnnnngaangangtacagacaggcntcncngcnatccnccaggcagtgtaatagtnaaggaaaagggcaacagtattggatcattccttagacactaatcagctggggaaagagttcattggcaaaagtgtcctcccaagaatggtttacaccaagcagagaggacatgtcactgaatggggaaaggganccccgtatccacagtcactgtaagcatccagtaggcaggaagatggctttgggcagtggctggatgaaagcagatttgagatacccagctccggaacgaggtcatcttctacaggttcttccttcactgagacaatgaattcagggtgatcattctctgaggggctgagaggtgcttcctcgattttcactaccacattagcttggctc

SEQ ID NO: 632012 - DNA, 269 bp, Homo sapiens
gcaggcccaggtgcgcctttctcagcatcttcccgcgtgaggctggtgggggcgggatggggggaagaggacgaacgcctagcgcccatgggtattggcctccagtgggtaggtgtggccatggatggagtgcggagagacttgaccttgggatggcctgacttactgaccgcagtgggcagctggactgggacggggaactgtggcaatgccctgggactggtgccgtgtgtggcgaagtgctggtgggcgtggcctgggtgctggag

SEQ ID NO: 632013 - DNA, 329 bp, Homo sapiens
catgcaggtgagccacaggtttgtctagcataccactatacacacacacgcacacacatgcgcactctcacatagctacacacacacaagtagtgcaattgagagctttgggccgtgacgctagaagcataggtatgttgttgtcgattgtggctcggtggcgctgggcgatacattcagcgatccacacgatgttgcgacactcctgctccttgagcttcacgaaggcatagaagacaccaaagtggaactggttcaggaaggccaacttgttcagctttacctcgtgctcaaagaatcggtcctccagcgtcttgtccggggttgtt

SEQ ID NO: 632014 - DNA, 143 bp, Homo sapiens
ctcatgcctcacatgattcaattccctcccacattacatggaaattcaagatgagatgtgggtggggaatacagccaaatcatatcaatttctaagcaaccatatttggatatttactctggaaatgtagttacaaatgagca

SEQ ID NO: 632015 - DNA, 703 bp, Homo sapiens
agcgggggagtttggtgatctatagcagccaaaggcttgtccctgacttcatatggctgctcctggctgagcgactgagtcgtccgtgatggaacacatgaggctaggcttttccgagatcgtctcagcgatggccgtttcgggtcgctggtatcgggggttgtgctcggtttgcaggaagcctgggtgcaggttcggcagaccatgtgaacacagctccgagctcggtgagcgaaatcgtgaagtggacccatgtggaaaatgaagctgtctgcccgagaattcagcgaaggcggaagccccggaacctggagctgtgtatctgtagccaggaaagagcggggctggcggacggtgtttgcctcccgtgagttctggcacaggttgcgagttatcaggactcagtcatcatgtataagcacttgtggagcatcagtaatggcaaggtttgtggatttcggcctccgactcgtgagatgggctattgacaagcagcatttatagtaccagaaagtgtggtggcgttgtgagagtataggaggagtgctggcacgagagatgcttagaggcgggaatcaagtttcatggtgctaccagagcaatcccgtgggaggcagctcgagattcgatgaaactgactacaaagtgccatgacgtgaaggtggtggtggttctacggggaacctcagagaatctatgactg

SEQ ID NO: 632016 - DNA, 370 bp, Homo sapiens
acccgtcgcgcacgtgtatcccgtactggaaggcctatacgggcaggtggtgggtgtgtgtggctgggtctgtgcttgctgcgtgtgacactcgcgccatcgattggtatatggttagctgtgtaggttagtaggcctagtatgagcgagcgttatggcgtggacgtgaaatcacatggctaggccggcaggtcattaggggggctgcagcagggccctgttaggggtcatgcggctgggttttcactcatctgggtcttacaatacaaatttaaatgcaaataagtgagagtggctatgcctgctttgctttgtgtgtgattttaggtcagcaaaacattcacatcttccacatagcagttggcatgta

SEQ ID NO: 632017 - DNA, 104 bp, Homo sapiens
cctgtgggtgtgtgcatgacgtgcgacgtgtgtgtaagtgtgtgggtgtgtgtgtgtggaactgtgtgacggggacgtgtgtacgtgttgttgaatgggacgtg

SEQ ID NO: 632018 - DNA, 554 bp, Homo sapiens
tatatcaagctagcagtgaatttagtagccaatagctaccagtactagggtagggaaatactaaaataatgatagatactagtgagagacatacaccaataaggtactgacatctacttctaagagaaccacacaaataaacaaaaccataaaattatatctaaatatgaaaaaagttctcacaagctaacaatgttataagtttacataagaacacttgaagcaatacaaacatcatgccacatgaaccaagttactgacaagatcacttgttgatagaggtccttaaataaatccatatgcctgaagtacaagatagactccccttacactatactgattgaaaaatacagtcacatctgcccatgggggagaactgctatatgaaccacttgaccagtgtaacaaaacaactagtagatcagaaaaattttatcaaacaacatttatcaggcattgactgtgatcatctatatacgacaaccaaagaggtaaagcccttaggatctatgtcccagcataactgtctggagaacgttccaggttgcagccag

SEQ ID NO: 632019 - DNA, 302 bp, Homo sapiens
gtacaagatgagttactatcgctttggacaggtttacacagaagccaagcgtcctccaggctttgaccgtgtccgaaatgctgatattgggaataaagactttgagcttgatgtcccggaggaagcatataccacagaacattggctgggcaggatatacacggtgaaggacctggataatcgaggcttgtgaaggacatatatgtgacgtgcagctctgatatgctttgcactgagcacatcacatttaggacgttgaagatattttttttttttttttttaatatgcagtttgtaagaac

SEQ ID NO: 632020 - DNA, 503 bp, Homo sapiens
cggtctttaaatctgggcagcatttgcttgtatttgggatggtgccaaaggccagcgtcgggatattgacatcaggaaatcctgattctggccgtcatcgccttccagaaggcgaggcccctcgacccccatcaccttcaacgcaaagccgcgcggctggggaatggagtcgggccgcaccccgccgggcgccgaggacagccgcaccaccacatcatgggttccgggccgcgcaaagatgccttgcgccagatgcgcgggcagatcatcgcggatggtgagccggccgaccagaacgccgtggcttttggcatgggcgtcacggacggcgtggcggtggcgctcgaactcctccatgttggcctcggccatcatggcggcgacctcgtcgatcagttcggcctcgttttcgacgggcacttcgatttctggcgcgtagcgcacaggacgtgtcatcgcatttcctttcgatggacgggcagcctcgggccggccctgaggat

SEQ ID NO: 632021 - DNA, 862 bp, Homo sapiens
  misc_feature (338)..(338): n is a, c, g, or t
  misc_feature (372)..(372): n is a, c, g, or t
  misc_feature (376)..(376): n is a, c, g, or t
  misc_feature (396)..(396): n is a, c, g, or t
  misc_feature (467)..(467): n is a, c, g, or t
  misc_feature (567)..(567): n is a, c, g, or t
  misc_feature (569)..(569): n is a, c, g, or t
  misc_feature (571)..(571): n is a, c, g, or t
  misc_feature (582)..(582): n is a, c, g, or t
  misc_feature (591)..(591): n is a, c, g, or t
  misc_feature (596)..(596): n is a, c, g, or t
  misc_feature (605)..(605): n is a, c, g, or t
  misc_feature (614)..(614): n is a, c, g, or t
  misc_feature (626)..(626): n is a, c, g, or t
  misc_feature (638)..(639): n is a, c, g, or t
  misc_feature (643)..(643): n is a, c, g, or t
ggttccgcccccccgcgcatgggcaggtaggctcggaccggcccgcggagctgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactggccttcaggatatactgattctactgctctttgagggcctcgtttactatctgaaccaaaagctttggcttcgtctccagccntcagcacttctcttctttgctagacccgtgtgtntatntgctttaacagcaagcaaanatggggccccaatttggagaactacccgacatttccaacatactcacctcttcccataatccctttccaanctgcatgggaggttctaagactggcacattatggtgctagattagtaaaccatgacttttcagatgagtagtgtcttcttatcgtcgcgatttactaccntntntccaacagaanaatgatganttgtntagtggtcngatacactnatagtgcttcanagttagcattannatgngtacttgtaactttgtctcaatatgtgctggcgttataaaatagatcaaagcagttctgggatatcctaatgcggggagcagctgagtggaataccaaaggctggtacagacaacgttgaatcgtggaggggtggaaacaaagggtggccgaaagttagggggtggaggtgggagttccaaacgagcaggatgagagggacaaatgtggacacacgtgg

SEQ ID NO: 632022 - DNA, 140 bp, Homo sapiens
aagcagttatacagaccacgatttaaaatatttcccctagtttattgggggggataggaagaaagatttgttactgtatttgtttaactacataaaattagatcaataaatgtcagcattggcctcgtgtgtacaaaccc

SEQ ID NO: 632023 - DNA, 888 bp, Homo sapiens
tcaaccatatatggtctagactatgtagactaacctacggctcctccaggtgctgacagagtattcgagccgaacaattatattgactaacactggtcatgattgtgccaaacacataatttgaatcaacaacaaaacactcgcacgaggcctaattattaagcatcatccctctacatatctttttaacccaagagtcaagaacaacctatttaagacgtgttcccgcgaaccattttcctccgaaacgcgcctaacaagcccccttcctaagtaggtaactacctgacttcatacaccctcacaagtcgatggcaagccgaagcggccgagattatccagtgagaggcactatcaacgacaaaaaaagtcggacctctctatagtaagtctcccgtacaaatctccttaattataacacttcaccgagggaaagaactaatcatattttatatcttcttcgaaaccagcacttatccccaccttggtatacatcacccgatgagggcaaccagccagaaacgcctgaacgcaggcaacatacttcctattctacaccctagtaggctccttcccctacttcatcgcactaatttacacttcacaacaccctaggtcaactaaaaattctaatacgtcactctcactgcccaagaattattaaatcctgaggcaacaattaatatgattaggcttacacaataacctttatagtaaaagatacttctttacggattcagttatgaattccctatagccatgttgaagccccatcggttggtaaagaatggcggagagacttaaatagggaatggaaataagggcaaattttttagcccttgaaaagaatgtacctttttaaatcatggggaaaaaagcgctggtgaa

SEQ ID NO: 632024 - DNA, 151 bp, Homo sapiens
cggcgttctttgtctgtcagtggggacgtcatcagcatgctggaagccattaatgaactaattcgtttgaccacatatataccaagcccctagtcttagagatagcctctgagacagagagccaagctaatgtggtcaaaacgaattagtt

SEQ ID NO: 632025 - DNA, 94 bp, Homo sapiens
gcggccgcctactactactactactgctcgaattcaagcttctaacgatgtacggggacatgtatttaaaacttggaactagaaaaacggctgt

SEQ ID NO: 632026 - DNA, 100 bp, Homo sapiens
ggcctgggatacccagtagggtatataaaattaccctgacggggtcgggtttacgacatatgccggcggttctgtcatctggggctatggtagatttagt

SEQ ID NO: 632027 - DNA, 406 bp, Homo sapiens
gctggctacggagggctgtcttttaatgcagatgaaaccctggatgggtaggggctcccagaaagaataaactttcttttctttgtatttgagatggagtttccctcctgttgcccaagctgaagtacagtggcatgatttcagctcaatgcagccacccctcctgagttcaagcgattctcctgcttcaccctcccaagcagctggtattacaggcgcatgccaccaagctcggttacttttttgtatttttagtggaagacagtttcaccacgttagccaggctggtcttgaactcctgacctcaggtgatccggctgcctcggcctcccaaagtgctgggattacaggcatgagccaccgtgccaggcctttaaaaacattttttctgagaccgagtcttgcc

SEQ ID NO: 632028 - DNA, 360 bp, Homo sapiens
  misc_feature (179)..(179): n is a, c, g, or t
  misc_feature (329)..(329): n is a, c, g, or t
atgctgttggcagtaacttcctagttaaatacaggcaatacaatacgagatgtgagtccaaatcagaatacctggaattctgagtaacctagaaattaagatggaggaggtggggagcagaccggattttcttaaaaagtctaacgttacaatcttgtaatttgctactttataataanatgcaactcatcctagcgggtgggacgccccaatgtgcagggtcaaggataataaactacagtgaagtagtctggaggagagaggctgtttaaatgcctgtaagcgctaaaactacaaggctattgtgaatcttgctgcaataaacatgngggtgcaggtgtccctttgatacactgaaaa

SEQ ID NO: 632029 - DNA, 105 bp, Homo sapiens
ggatggatgggattaatggcaggttggggcacagcaagagaaatgaccaggccaggcacggggctcacaccttgtcatcccagcacctttgggaggccgaggcag

SEQ ID NO: 632030 - DNA, 520 bp, Homo sapiens
  misc_feature (9)..(9): n is a, c, g, or t
cagcatggnacagatcaagaatctaaaactgaaaatgatactggtatcagttcatttgtctgctgcttataacagagtacctgaaactgggtaatttacaaataaaagaaatttatttcttacagttatgaaggccgagaggtttcacgttgagaacccatatctagtgagaattttctttctggtggggactctctgaagagtcctgaggaggtgcaggatgtcacatgatgaggggactgagtgtgctaatgtactggttcaggtatctggtcttcttataaagccaccagttccactcacatgataacccattaatccattaacccatcaatccattcatccataaatggattagtccatgtataaggtctctgccctatgacccagttacctatcaatagccttacctttcaatactgccatattaagggtcgttccaccatgtgaaatcgggggggcatatccaaaccatagcacacactgcctctccttgaggaaaggcctagagtcagttact

SEQ ID NO: 632031 - DNA, 1299 bp, Homo sapiens
  misc_feature (595)..(595): n is a, c, g, or t
  misc_feature (1299)..(1299): n is a, c, g, or t
gatgacgaacacaaaggggaacgaggagagggcgagccgagtatagtgtgtctctaggcctttcgagacacagacatggacgttgttccatgtaggcgcagcactatagtgcgatagtctactataggataacaggtgatacttgtaggacactcaacgggaactgggtacttggtcacaaaatggaatgcccgcactagaggtgttagccactggcaacagactcggtaaggagtctcatcaactgttcaccctcaggctactagctagttaggctacttagttggtacaagctaggaacagaagttcaatggggcaaggattgtcttgtgcacgaatgacgaagttcatactgtagtcagtttattagaagcaactacttaaatgcatcgtacgtaaagggacgcccgtaggaaatcaggcgtattcgcgttggaaagaactgctgttggcaagggggataacacttggatccaggaatagatacgcaatagcagagtccgaaaggaggacaagggtcacctgggtggttctaaacctaaaaatgcgaccaagcactgacatcccatcgctcatgaaggacacgctacgactntgtccgttgggagacacccaaatgcgcgtgcaccaggagcgctaggatgcgtatgcctgggagacccttatttgccactgaatcgagatttcgatcggccattaaataacggtggtttgaattagatccacacaaaaattcatacggtggagcctctggggggcttaacggaaaggaaacagacaagataagagcaaacaaaagatacacccaaggaggagcgctctatcaaaagggggcgcgcgcgctggggagaagagaccaaggagaggggaagaccagggcagactgggcgggcgcaccttccgtgggctaccgtacaatcgcgaatggcccggcggggtacgccgcccccgttctggtctaaaggggccacgaacacgggggcgagaagatcccaagcggcgcagtggtgcgcacccttaataagtagggggagatcgtcctgccgactcaagatttggcaacccacaaaggagccgcaacggcgtggaacaagccgggcgtcccaagcaaagacacgccccagggggcgcacaacaagcagactttccgcgtggaaccacggcgctggggcccaaagggccagtgcaagggacagctctgggatgcggaggaacccggggggcccaagggggcatcccgacgcgagaggcgggacgcacaagacagatgtcaggaggaggccaccaagacaacaacgn

SEQ ID NO: 632032 - DNA, 514 bp, Homo sapiens
  misc_feature (415)..(415): n is a, c, g, or t
taaaggtacaattcccattataattttcctcccacgaaaatagcctgtcttgcagtctttaaaaatctccagctccttcacttggggcttgggtggggggcacgtgggggcagcacccgccaggctctaaactcggggtgtggggggtgtctcggctcctttggcgggcattcacgaagactcagatctccgtgacatacttgtgcgtgttgaattgtgcacaacctcacacgagtatgtgtagctctcacattacagcttggggaagcacataggcattcgaagaacgcctcgcttcagaaaattgtgtctcccgtgacgtgcgtggcggccctccaccatagtgtttctcgaatgtgacgacatttctctttaagtgggccttgttccctgttgggcacgctctcgggcccangttaggtgcacgcgaaaataggcgtgcaccgtgtggccgccggccccctttgtgggcaccagacccattgggtccctctctttctctgtggctcatcct

SEQ ID NO: 632033 - DNA, 200 bp, Homo sapiens
acccagtttttcccccccccccttacccccctggggtaggtttcccccaggggtggcctcagtttttcctcaacagggctgggggcagccctttccctgcctagttcccgcctgagggccagcccccccccccgccttccgccccctgttcaggtttcctcccccccccagtgaaataaagcatccccccccgccgttta

SEQ ID NO: 632034 - DNA, 177 bp, Homo sapiens
gttcactttctacaccagccatccacatggtgctgacagagcatgagccttttaagcgcagtgcagactcagaattgaaggccttggttgtgcatggccctgaatgagcagcgtctggtgtcctgggtgaacctcatctgcagcaacaggatgaggactttgagaagaagattccaa

SEQ ID NO: 632035 - DNA, 343 bp, Homo sapiens
tcctgtttggagggacccagtccctagggcccaagactgggtgggaaagggggagtctcccggggccccaggcttattcaaaactggggtttttaaagtttcctttaccccgcccctgttgaacctttaaataatctaacctgggcatcaagctgttctccctctctcttttttttaattttattattattattttggccacatgtccctttctaacaaagtttatcggggctattaaagtgttttatttccccattcatattactcttgtatcgagtccctgaggtttaaggccacttagatcaaagttttaaaaaagtaaaaatatttccggttttggcca

SEQ ID NO: 632036 - DNA, 132 bp, Homo sapiens
ccaaggttgaaattaaccccccccaaaggggaaaaaaagggggggtcccccgggggggggggcggtttaaaaaaaggggatcccccggggggcaggaatttgggtttttaaaaaaaaaaaaccccaacaaca

SEQ ID NO: 632037 - DNA, 238 bp, Homo sapiens
gaggatctctaatatgctgtctcaacacagaataacccaccgcgaggacgttcaaatgcacccatcacagcccttattgaagtagaagtgatggatgaaaccaagtgctgctgttttttccaaacgaaggaaaaggaaaaccatacagggccacaaatgattttggacaccagaacagaatcctggggagttatttaacattttcatcttgctgtctttgttgatttaaattcatttt

SEQ ID NO: 632038 - DNA, 450 bp, Homo sapiens
  misc_feature (20)..(20): n is a, c, g, or t
  misc_feature (42)..(42): n is a, c, g, or t
  misc_feature (154)..(154): n is a, c, g, or t
  misc_feature (183)..(183): n is a, c, g, or t
  misc_feature (265)..(265): n is a, c, g, or t
  misc_feature (293)..(293): n is a, c, g, or t
  misc_feature (322)..(322): n is a, c, g, or t
gagtgaaaagggacagagangtatgtacaaccaacagtgccncccataagtccctgcaaaaaaacttttctgtcatatacccccggttatattcagtgtcaagtttgccatggatggatggctcagagattgaacttagtatacaacacatctnctctatagaatgtggccacatctgtagtncagtgcttctgcacttcctttacacatactaacactgccccagtttgtttgaaaaaaatcagccgccatcagtatcactggnagttatatatgatgtatgcccttattgnctcaagacagatcctgtggactggatttntccatgtactttgtgccaggaactatgggttgttggcataccaatgctctgagtcttaaaaatactgatttttaaaattgctatctggcagtatataagaaactctttgatttactgcataaaaaaaa

SEQ ID NO: 632039 - DNA, 683 bp, Homo sapiens
cactttgggaggccaaggcaggcatatcacctgaggtcaggagttcgagaccaacctggctaacatggtgaaaccccatttctactaaaaatacaaaaaattagctgggtgtggtggtacattcctgtaatcccagttactcgggaggctgaggcaggagaatcacttgagcctgggaggtggaggttgcggtgagctgagatcacaccactgtattccagcctgggtgactgagactctaactgaaaaaaaaaaaaaaaaaaaaattgattgctgtgcctcattacaaatgcatatgatgtttgaaaaaaaaaaaaaaaaaaaaaaaaaaaaaaaaaaataaaaaaaaaaaaaaaaaaaaaaaaaaaaaaaaaaaaaaaaaataaaaaaaaaaaaaaattataattaaaaacaaaaaaaaaatgggaaaaaaaataaaaaaaaaaaaaaaaaaaaagttttggcccctttggcccaaaggtttttataatttggaaatttttaatatttggcccaaattggggtccttttggcaaaattccccttttggggggtgttttaaacaaaaagggcccggttttaaaaaggtggatttgggaaaaccttgggttcccaaataaaaaccttggggaaaccctttttcgcagggggggattttaagggcgcccacaattgcgtttttc

SEQ ID NO: 632040 - DNA, 365 bp, Homo sapiens
ggatctaatatagtcataagagacattgtgacctcctccctgctctcttgaaccactcattctgggagaagtcagctgccatgtcatgaagctactcagggaggtccatggagaggtccacatggcaaggaactgaggcctcctgccagtagccagcaccatcttgctggccatgtgagcgtgccatcttagatgcagatcatacggccccagtcaagccttcaaatgactgcatccctacttgacattttgactgtaacctcatgagaaaccctaagccagaacaccagctaagccactccccaattcctcatcaagagaaactgagataataaatgtttattattgttttaagctaaaaaaaa

SEQ ID NO: 632041 - DNA, 120 bp, Homo sapiens
tttactctgacatatttatatgcacataaattaggagtgctctgacccctgcccgtggagccaagcactgagcagggaggtgaacgccagtccagagagaaggtgctggagcccctgctc

SEQ ID NO: 632042 - DNA, 127 bp, Homo sapiens
ttatcaggacagcattctcaatcaatccaacagtcatattcggttgcagtcttcatacacactacagctattgttagtgttgcctgcggacatcggctggccctctgtccatgatgatgctatgcgg

SEQ ID NO: 632043 - DNA, 773 bp, Homo sapiens
  misc_feature (579)..(579): n is a, c, g, or t
gagatgcctttgaaaaagaagaaacctttgccctgagctctacaaaaacccttgaagaagctgtcaacaacatcatcacatttcttggtatgcagccatgtgagaggtcagataaagtccccgagaataagaactcccactccctctatctagcaggtgtatacagaggtggctatgacttattggtgcggtccaggctggccctagctgatggagtgaccatgcaggtgactgtgagaagcaaagagagaacgcctgtggatgttatcttggcttctgtgggataagttcttgctgggaagggtgatgttgctatgccctccctattggtggtttttaggctagtggcatgatcttccaagaatcacacataaagattaataatgatgactttgaagaagcaaatccaagtgtttggccctgcgccagcagatcaaacatctgtctgtctgtctgtctttgagcatgagctttagagtttcttccctcatctcatgtctcactcactcagcctcggtgcgacaatgcagctttgagtgggcttgaaaatcagatactacttatgctattctacagctngcttagcttcattatatgcttctatttaatgtggtgaaaaactcttggcaatggtggaaaattttatcccagaagggtggagggggagggggaagcggaatccatttttgtcacaggttgttttattattgaaaataactcctctttccgtttcaagtggcttactgaattttaatttaaaaaggatttaattt

SEQ ID NO: 632044 - DNA, 272 bp, Homo sapiens
  misc_feature (118)..(118): n is a, c, g, or t
  misc_feature (249)..(249): n is a, c, g, or t
ggcaccgcttccgtgagactgggcgcgaggcgaccaggccgagaagtgctggcggtacacgtcatcgagttgggcgaagtggtagctgccggtgatcttgtcagcgaacttgtagtcnacgccgccgaagttgaagtgcttgccggtagcgccgctgacaaaacggctgttcttgttgttgagggcgatctcttcgtagtcagtggaatcgcggtctttggctttatccaggcggccgccggtaaacancaggttcttgaattctttggagg

SEQ ID NO: 632045 - DNA, 1015 bp, Homo sapiens
gagctgagcatcagagtccgcacttgctccggcgatgggcagaatagcgcgagggagcgcggggctagcagaagcgagagccgagtcgcggtacccagccaggacccatagccctccccagctgcccagggaagagccccagccatgtgaacaccaggtcctgtgctgcgacagtggaaaccatccgccgcagcgtaccctcgatgtccatccatcctctaactgaccgtggatgcgtgcgggcccatgcttgagaggcgtgaggagacctgcgctgccctcgcgtgttctactttcagaatgtgttgcggaaggaggtcctgccgtccatgcggaagatcgtcgccacctggatgctggatggtctgcgaggaatcagaagtgcgaggaggaggtcttcccgctggccatgaactatcctggaccgcttcctgtcgctggagcccgtgacaaagagccgctctgcagctgctgggggccacttgcatgttcgtggcctctaagatgaaggagaccatccccctgtacggccgagaagcttgtctatctacaccgatcaattccatccggcccgaggagctgctgctgaatggatctgctcctggtgaacaagcgtcacgtggacacctggcctgtaatggacccgcacgatttcatttgcaagcactttccctctccgataatgcccagaggcggaggagaactaaatgggatcatccgaaaacacgcgcagaccttcgtatgcctctgtgcaacagaatgtgaaggttcatttcccaagtccggcctccattggttgcaagcgtcggacgcgtgtggttgtccgcatttgcaaggtcctgaaaccttaagggatgcccctatcaaactttccctgttcgtaattaaccgggttcaaacggcctttcttctcacagagtgagtcagttgtaccctggattgcctccggggactggcagatgccgcatgaaggctgtctggggtcaagcgtggcaggccagagacatggacccag

SEQ ID NO: 632046 - DNA, 311 bp, Homo sapiens
atgctggtccgcgttgttcttgcagacactctgctgtttcctgccttggctgtggctacagcatggctatggaaagctgctgccatccactccaccttgggccatagcttggttctgctcctgcttgcagggacagctgagctggctatttcggcgcttcgggcaagaactgctacaggctctcctgggtcctgcaggtgtacagccgggcccctgccttgtgcctcagctctcgaggagctgctgctgccgggtgacctgatccaacctgataaggtgccatcttcagctacctctgcaaggaacccacg

SEQ ID NO: 632047 - DNA, 148 bp, Homo sapiens
catcccccaacaggcacctcagcagcagaacacccttcttcgttccttccaaggcacagcaggcccagcagccgggcagcaatcagcagggggcatttccagggcattgggccttcttgtcctttgcaggcacgcaggcagggggtca

SEQ ID NO: 632048 - DNA, 268 bp, Homo sapiens
cgggcgtcgcacagttcgcctgcgtatcaaacagcgtcactgccggaaagtctttcatgaccctggcactacttctttgtattctttgttcgagagcacttctgccgagatatagcgcacgggctctttaaaacccttttggttttgggttccaaacggtaatggacgactatcaacgcacgacatcggagagaagcaagctcaggatatcaatacgaacacactggaagcgtacgtgtgggtacgagctcgaaatttcggtaaatcc

SEQ ID NO: 632049 - DNA, 1090 bp, Homo sapiens
  misc_feature (284)..(284): n is a, c, g, or t
  misc_feature (1090)..(1090): n is a, c, g, or t
actagagactgcgcgtaaataaaaccaaagtatagatcagctcaattgctgtctgatctccacgcagccctattcgcaaactagtctgccgcgaatgatgagaaggttcggcatcactacctgtggacgtcctgtcgcatgcaggcgctgctcaaaagtcacacgaatggcatgtaatgtcttagtcgcatggcgctacgtcagccagagtagccgtctgaatccgaccaatgttgacagtcactattcggccgcagcagctcaacatacgagagcagtaccgntcagtggcttggaattactcacgcgtagcctgtcaacgtcacaagtgggcgtgcacgtcaatacttgcttcaggtctgtccttctttcactatctcaatacgggcgatgagtctaatatttacggactcagtttctctactcagaatcgctgagaacatcggggattatcctccggcttgcaactagtagcaactagacttcataggctatgtcctcccgtgaggccaaatatattctgaggggccgcagtaattacaaggttactattcgacatcccatacatggggacaggacctagtccaatgatatctgaggaggctactgcggtagacatggcccagcctcacacgatatcttgaggctttcagttcaatctgcgctgtaatattggagccctagcagaaaccacagcctaatcttgcggaaaagggtctaacatcccctggaatactccatccggaaagtctctcccctttaaaggtagaacccgggtaattttcttccaaagatagggtttcgacctgggcccgacgaatgacataccgaaacggcgatgaatgacccaggccggggtgatcttccccccacggtggtcgctccctcaattccccaccggcgtgtggcacaccacagttggtgatgacacgtatagagctagacaacgaacagcaaatcaccacaacgcgagacacacaacataacacccacaacaaggcaacggacgagcaaaagcacaagacggagaaaagaacgaacaaacgacgaacgaaaagacacagcagaacacagcacaagcagacaccan

SEQ ID NO: 632050 - DNA, 224 bp, Homo sapiens
  misc_feature (193)..(193): n is a, c, g, or t
agtcggtaccgggaagactgtctcgaagctgctgttcgttatgcatcgctgtgtcgagcttcgcgcgcgctctgggcggctggcgagaagaagcaagcggaagctgcgtaatcgaacgtgcatcagcgtcattgatcgctggcgtgtatcctgcattcaatttatggagtatttcaacatgggaatcgcaaanagaagacatcctggcgagcagtcgacaggga

SEQ ID NO: 632051 - DNA, 625 bp, Homo sapiens
  misc_feature (425)..(425): n is a, c, g, or t
  misc_feature (460)..(460): n is a, c, g, or t
tgcaggattcggcacgagtaatgattaaaaaaaaaaatagaatgaataaaacctggtatttgatagaacgggggactacggtcaataataattgtacatttaaaaataactaaaagagtataattggattgtttctaatacaaaggataaatgcttaagggaaggaatactccattttccatgatgtggttattacgcattgcataagtgtagcaaaatatttcatgtactgcataaatatatacacctggctgggcgaggtggctcacacctgtaatcccagcactttgggaggccaaggcaggtggatcacttgaggtcaggagtttgagaccagcctgaccaacatggagaaaccctgtctctactaaaaatacaaaattagctgggcgtggtggcgcatgcctatagacccagctactcangaggctgaggcaggagaatcgcttaaacccgaggnggcggaggttgaatgagccaagatcgcgccatttgacttcagcccaggtgacacagcaggactcatctggaaaaaaaaaaaatggtacacacacacacacacacacacacacaccccttgtacccacaacgaactttgttaggacaatattctcaatttgttctt

SEQ ID NO: 632052 - DNA, 161 bp, Homo sapiens
ctcaatcaaatttgtagtttgtaaaagtattttaacagctctgcggcaaagtgcaaatgaaaagtcttgatggcatggactgagcggggacagttggggattggagaaagggggaattggatttttggatgtgttttaggaagggagattccatgttaagg

SEQ ID NO: 632053 - DNA, 1047 bp, Homo sapiens
  misc_feature (395)..(395): n is a, c, g, or t
  misc_feature (1020)..(1020): n is a, c, g, or t
agggtggacatttttgcttatactctggcgccgatgagctatatcacttatttcgtgtgtggtcagttccattgaaatatagcaccacacgaagtcatgtctgtgggatctttgtgtgagtgcagtataagttattatgtgcggacagacttatttgtaatatagtgtgtgcttgaataccagacgtcgttgtatagtctacaagtagaatacttactcgtcaaaggggttgcgattcgtaagtgggatagtgaccacattcagatgggcgggattgtgcctaatatgtgagatactttaatatattgtgtgtcccctcgatggtgacgctctcggtgtacaacaactagcttcgtgactccccatgttgtatgtgttgtaggtactttactatnaggggtgtgtattcgtaaaaccgcgcttcgtttttcgtcgcttcccccatcgttagtcgctcctccagggttctcttcccctaataacaggggggctcagcagttcgtgtcccacagtgtcaactctctgagagggtgtctcatgcgtggcttgtggttcacatgaatcgtgtagtgtgtagtgtacacctcgcgcaaacatgtaatttcgcgtgtgcatgcttttatccttttccgtaggcccccgcggcgatttctcacaacttgccacacaggggtgtagtgcaactcagccctcgagcatcgtcatattggcccatggccgtgctagggcgaggagtaatggaggtagggactaggcagctctaagcccacggaagtcgccagcgtctagtacctgtgaggggcgtagcatctcatgcttagtgtattgcgccttctttaggctatcgcgagtacatcgctcttgtgttgagacgctgtgcctgcatgggagggaacccccctgcccacgtcactccaggtgaaacaagcggtcatgcttcaggggcccatttccagcttggccgctatctgtgaccttgggcaagtcactagacctctgtgtgccatcaacttcctcctnttacacgcgggacagtacatggcaccc

SEQ ID NO: 632054 - DNA, 419 bp, Homo sapiens
tggagctcgtgtatcaaattctagcaactacatatgccattcactgtataattgctcattagatacatgttagtgtagatggggaagatcggtaagtatacttaggcctcagagctcccatagaccattaacatgaattgtgacatccacggttagtaacgcaaaatatttacatcctgtatctattggactgaaaatggtatatgacgatatcatattatggtgctagacgatgtcctatatcaagtattgcagtactgagtgagatacgcagtctggtaagcaagtattagtaatgagtattatatctgataaagacactcataacatgcacatggtggtggcctcatataagatatagttgagtgctacccgttactgctgtatgtgctgtcaaagcactgaatgtatcacgaatt

SEQ ID NO: 632055 - DNA, 295 bp, Homo sapiens
gctatcagtgtttgtggacttttaaaaattagtttgaattttggaatgttctgtgacaagatataatttctcctattttgtacatttgaatatgccatgttgtaaatgtctgtattcagcattattgtaaatatctgcattttaaggatcatgaaagattttcctcaaaaatgacagaactctccatactagattgtgacacattataagatatctgattttaagcttttggattttgttctaaaaattaagtttaaacatgctgaaaattccataagaataaaattttgaaaat

SEQ ID NO: 632056 - DNA, 137 bp, Homo sapiens
agtcattacaccatgcatcgcatcatcatcactatcaccatacatcaccatcaccctccttaagctctacttctacctacgccatattctactccacctcatcatcactatcaccatcatcaccatcatcaccatca

SEQ ID NO: 632057 - DNA, 569 bp, Homo sapiens
ctggagaagaccaggagacccctagaggaaaatcccctgcccttcccaaggaaaccgattggcaccagggagaacgcctacccaggccgatatctggttaatggaggccgtgccgcccgcccataatgcccctgtgaccattcccaccaagccattgcccttcttaattttaccttcttttagcctgtttaacctttgtaagaacgccaagaggttggagtccagtttaaatgagctgtgctgccccctttcacactccaagagactatctgagccacgagaggcccgcgccctgccctttcccactctgtctatactatctcggctggcacagggagaggagaaggacttgcactgttggtgaaaggaaagaaagtggtggtggaaagaaattggggtgggacgaacacgtgaaattctagagttaaacccaagctggccccaaggtgtcctgcacggctgtaaatgccgtttatatcagagtgccctttttttttttgttcaaatgattttaattattggaaagcaccattttttttaataagccaataaaaagttttaaaacttta

SEQ ID NO: 632058 - DNA, 193 bp, Homo sapiens
tgatcagttcttagaaacagttaaccaaaatcaggaatccttgggggtctccttttcttcatcctttttctcatcttcaatctgggccttttctttgcaatcccttccgaaatctcatcttcttcacctgggttcccattcacatttcttcttccggtaggttcataaattggctttattattttcaaattgg

SEQ ID NO: 632059 - DNA, 83 bp, Homo sapiens
cggcacattgtcggttggaggcctgtggctgtggctgagtggtctgctgtctgtggcacccattaaagtgcagttccctccgg

SEQ ID NO: 632060 - DNA, 340 bp, Homo sapiens
  misc_feature (18)..(18): n is a, c, g, or t
  misc_feature (20)..(20): n is a, c, g, or t
  misc_feature (22)..(24): n is a, c, g, or t
  misc_feature (26)..(26): n is a, c, g, or t
  misc_feature (49)..(49): n is a, c, g, or t
  misc_feature (73)..(73): n is a, c, g, or t
  misc_feature (105)..(105): n is a, c, g, or t
  misc_feature (112)..(112): n is a, c, g, or t
  misc_feature (115)..(115): n is a, c, g, or t
  misc_feature (117)..(117): n is a, c, g, or t
  misc_feature (129)..(129): n is a, c, g, or t
  misc_feature (138)..(138): n is a, c, g, or t
  misc_feature (143)..(143): n is a, c, g, or t
  misc_feature (163)..(163): n is a, c, g, or t
  misc_feature (193)..(193): n is a, c, g, or t
  misc_feature (238)..(238): n is a, c, g, or t
  misc_feature (247)..(247): n is a, c, g, or t
  misc_feature (249)..(249): n is a, c, g, or t
  misc_feature (259)..(259): n is a, c, g, or t
  misc_feature (261)..(261): n is a, c, g, or t
  misc_feature (263)..(263): n is a, c, g, or t
  misc_feature (270)..(270): n is a, c, g, or t
  misc_feature (286)..(287): n is a, c, g, or t
  misc_feature (295)..(295): n is a, c, g, or t
  misc_feature (297)..(297): n is a, c, g, or t
  misc_feature (329)..(329): n is a, c, g, or t
  misc_feature (333)..(333): n is a, c, g, or t
ctcgtgccatttcggcanangnnnangccaccgtgggtggtcctggggnactcagagagaaggcatgtctttngggagtcagatgagctgattgggcagaaagtngcccatnctntngcagagggactnggagtaatngcctncatttgggagaagctagatnaaagggaagctggcatcacttagaaggttnttttcgagcagacaaaggtcatctgcagatatacgtgaaggactngagcaaggncntcctggcctntntngcctttntgggccatttgtactnncaagactntnaacaccccaacaggcccaggagtacacgagangtcngaggatg

SEQ ID NO: 632061 - DNA, 97 bp, Homo sapiens
gactgtcgaccaggttggggcatatgtggagcttaatatatcatatctaatttaaaataatttcactgaactaaactccattgctatttacctacac

SEQ ID NO: 632062 - DNA, 433 bp, Homo sapiens
  misc_feature (91)..(91): n is a, c, g, or t
  misc_feature (259)..(259): n is a, c, g, or t
  misc_feature (308)..(308): n is a, c, g, or t
gggggttcagcgctcgggtgaggagctggtggcgtcggcaggttcgaggcgattcgagctccagcttaaggggaactggcaactccggaanggggttgtttgcaacgaccgtctggggaagaaggtccgcgttaaatgcaacacggatgataccatcggggaccttaagaagttgattgcagcccaaactggtacccgttggaacaagattgtcctgaagaagtggtacacgatttttaaggaccacgtgtctctgggngcgactatgacaattccaacggaatgcggcactgaacctgggagctttnattatcaatagatgagaatcctcatcttcctgccccgctttcctctcccatcctcatcccccacactgggatagatgcttgtttgtaaaaactcaccttaataaagacttagatggaacaacaac

SEQ ID NO: 632063 - DNA, 1389 bp, Homo sapiens
  misc_feature (723)..(723): n is a, c, g, or t
  misc_feature (754)..(754): n is a, c, g, or t
  misc_feature (890)..(890): n is a, c, g, or t
gcgccttggctgttcgcgtatgccacctttatccgtcctctccctctttctggtgccttctttttgtgtgtgtcgctcttctccctctgttcgctctccttgtctaattctccaccctgcgtcccgtgctgtcgctgcttctatctgttgtggtcctcaccgacctctctcagctttggttacgtagcttatatctgtcttgcgtctcctcctcttctcctcgcgtttccgacgcgtctgtgctgtggccctttctgggtggccgtcgacgcttctgctggcactcctccggtgctcgtcactacttgtcttcctctttatgtctgtcctacaggctcgatataattaccgccgccgcctgcggcgtgcctcgtgttctgttcattcctttcttgcccagcttccgcccagtctgcgtctgctccttctcttctgttgtctcttgctcatccgtggcctccgtctacggttcgcttgtttgattgtgttgcgtttatttttttcgggccgtctcctggctgtgtttctgtttgttgttgtcttttctcatcgtggttcctttcctctttttttttttttattttcttttcttcttgagttcctttgctttggctcttttcttcttttttttcttggtgtctttttttttttcttttttgtttttttttttttttttttttttttttttttttttttttttttttttttttttttttattatanaaaaatgccacattactctttattgaatgcnagcgccagcaccggcccctttctctccaagcacaggggcacgcaggcaaggggcacgaaggcaaggggcctccgtcccccttggccaggaatgcaggtggaagcctgtggcctccacttaccatttcaccatacangccagcacccctcctcgcgtgccgtggggcctcaggctcgtgttcaaacttccgtgctcacagaagcctacattgaggggtgtgggcctggacacctcgcctcagcaactcacagcggaccgtgtgacaaacgttctcataggcaaatgtcaggctcagatgtcaccttgttgccccacagcctttcggcaacagccccgtgctctgggccaaagcccgtggggccccggtttgtgttgctcccctttttctccccactatacaagcctctccaccaatcaccagagccttctgcctcaggggtaccttcaaatgccggggtccccctacgtagaaatccttccagtcaggggccaataggatatacggtccaggtccccggggggcgaaaagaagggcccgaaacccggcttggttgacgcgtcccagctccttcaatatgtcactgggatattcctctcgcccccctgttttattggtctctgcgtgatcttacatt

SEQ ID NO: 632064 - DNA, 1083 bp, Homo sapiens
gccagcacacccctgtgtcacctcctctgcggcagcttgtgcctcgcaatgcgcagtgcctgcagcgcactgccggagtggctgtagctgcccggctgcggctgccgccctgcgccgggctgtgggcttgctgtggctgctgcccccgtctgctggccagctctgcactggcttgcgtggctcttgccggctgacccgtggtgtgcttcttgcaagctggctgccggtgctgggctggcattggggataactgcgggccatgtgttgcgcccgagatctgcctccgcaaggattgacgggacgttggtgggtccaggttggggcttgcttggccggtgcccccttgtctctgcctgctgttacctttggcacattcctcaatccaccctttcagcttcttccccttgccgccattccacttccagttgcgaagatactatcagcgcaaaggtataaatcacaccttaacagatgtgtgaacttcgcgttattccttacctaaccaaaggaacatctttaggtgagcgatggtagcgcttcgcgcaaaggttcccaaagaagaataaaggtatcggcttcgcctcttataaaaccaacagcgcactaatcagccgccaagaccagtattcaccaagacagttatccgaaaccatatgggataaccacaaagagaatattatgcgggaaaacgcgtccttagacccctatgaacgggttatatcacaatcacggcgaagagaaactaatgcccccgtttgcagtccaaccgtataacgcgcaccattaagtggcatattttgctagagttgaacaaccaaagaaacacccgggaagagaagccccaaggcaattcgcaacctaaactaatccccccacttaacttcagacggaaacaccaaaggggccacaagaggccaattctcatatggagcgaacaaagcaggccattatgttggacagcgacaccacttccttgggaatgacccatcccctacggacaaaaccgcgcgacaagagaaattccaaaaccacagtatcggatatatactcccacttggaaccataaattgcggacgaaattac

SEQ ID NO: 632065 - DNA, 207 bp, Homo sapiens
ctaacagataagaaatgctactgtggcggttacacagatgcttatttggtttttaaacaaatccaagacaaaagaaagaaagagggaacagtgctgcttgaaggtgggggaggagagggaatctcatctgtaaaatgcttttccaggcaccggaacctcctagtctagcctggcacacccatgtcacgtcaggttaggtctacctgg

SEQ ID NO: 632066 - DNA, 233 bp, Homo sapiens
ttacaaccccacgatcacaatgcatgtaaagtacgtgaaccggtcaggcacagtggctcacgcctgtaatcccagcactttgggaggccaaggctgggtggatcacccgaggtcaagagtttgagaccagcctggccaatatggtgaaagcccgtctctactaaaaatacaaaattagccaggtgtgatggcatgtgcctatcatcccaactactcaggaggctgaggcaaga

SEQ ID NO: 632067 - DNA, 235 bp, Homo sapiens
acttgagcccagcaggttgaggctgcagtgagctgtaatcgtgccactgcactccaggctgggcaacagacgagacctcatctcaagaaaaaatacaaatttagttaagtagagtataatatctaaatgtggctccttttagacctctttgtgatattgacacatgtacctagacggttgctgtgtagctataacttgatatatacactttatcattataactattcacataatg

SEQ ID NO: 632068 - DNA, 231 bp, Homo sapiens
tcatcgcgtatgagcatgttgtttcataatgggcattccatccaagaaagtcctaaggagataaatgtatgtttcataagtaggcattctggtgatggaatgtcctgaggtagataacatgctggattcggtctgcagcacatctcagcttattcattctgaactcagtttggacaaagtgtagttacgtacagacacctcagtttggtaataaatgtaccagaaaatgct

SEQ ID NO: 632069 - DNA, 366 bp, Homo sapiens
aaagtacgagtgaggtataaatgggtgtggaagaggtacaaagtcaagggtagagttacttgatcctgacgcttcttactgtacaaggggttccacagtatacaaacatgaaattgggaggtactttgaaataaagttggagtcattgtggtaccgatgtaatggctcccaggactgaaaggcgggttactcgtgacttaatgtcagatgcagttccaaactcatccgctaacatttgtgccactcgtgaaatctggtcttggggaggaatgatcaatgatatcatgctggtgccaatggccgcgggccgcctccaagctcttaatgagcttctggatcttccagatctccacgttcctgtcggcc

SEQ ID NO: 632070 - DNA, 110 bp, Homo sapiens
gggcctggtgctggtttctctaatacaaacacactgggatgtctatgtgggcaggcttgggggaagatcaccaggcatggcttgcaaagcacaaatcacaaatgcattta

SEQ ID NO: 632071 - DNA, 884 bp, Homo sapiens
gctcaacgcacggagggtgaggtcggtacgcggtggtggcgtacggcgccccggagcctgcgcaaacccaggcccagccccagcccagcctgcgggcgccggaggggccggaacagacccgggatccgccagcacacgcaaagcaaaaaacaagattaaagaaaacgtaaataccactcaccaaaacaggtaagtaaccaaaaaaaaaccatacgcatccctcaacgtccacatcatcaagaccaatacacacatacatatacactaacacaacatactaataaccaataacaaaagaaaactcaaaaaacaaaaacatgaagcaaaacacacccaaaaatcacgaactaaactcaaaaaaactctaaacctctcacataacccacaccaacaacaaacaagaaacatacaaaggagaaaacacaaagagccaaacacaaaatagaaaaagacacatacagagaaaaaaacaacagaacacccacacacagaaaaagtagtaaggcaaaagaaagctagacacaacagacacagacaaaacacaaagacagacagaaagagacaacagaaagtcacaacaaaggaacaaaaacacataagagctgaacaaaactgtaggctgaccaaacaaacctaaacacgaaggagcaggagtcacctcagcccaacgtagaaccaaatcaagactctaataagcgatccaatacgcccagaaaaaacaaaaacagaagatcacaacagagggacgacacaaccccaagacaaacaacagcgtgacacacgaactatagtacagcccagcactaaaaggggggtaaaacaacgaccgcgcgaccacgcggacacacaacactcagaacagcccaggagaaaagcagacagcg

SEQ ID NO: 632072 - DNA, 364 bp, Homo sapiens
gggggtatctcccctctgccaccccaatggtgaataaagattgttgcttgtcaaaaaaaaaaaaaaaaaaaaaaaaaaaaatttgtgggggcgcacaagaaaaggttattatttaacaatccgttggggcgcggcgcgcgcccaagaggatacagtagaactggggccacaggtggtaccaaaaggaagaaaccggggcatgaaccaggggcgggggttcccaccaaaaaaaaaaaagcgcggggggacaaaccggaggtgttcggagaacaaccacagagggggtcccgaggccacaagaggggatctacacacggggaccccccaggggagcacgaatatcaaaataaggcacgcggggggt

SEQ ID NO: 632073 - DNA, 182 bp, Homo sapiens
  misc_feature (177)..(177): n is a, c, g, or t
ctcaggtaatccacccaccttggccacccaaagtgttgggattacaggtttgagccgccacacccagccttgtttttaaatggaattacagtaattaaataaaaactgttccatggtctacttttaaacttgaaggattttttttctttttcttttctgtctttttttttttttttnttttt

SEQ ID NO: 632074 - DNA, 801 bp, Homo sapiens
gcctacacccaggccttcctcacgcaggctgccgagggctgcgcacgccgctctggattgggctggctggcgaggagggctctcgggggtactcctgggtctcagaggagccgctgaactacgtggtgctggcaggacggggagccgctagcagccgagggggctgtacctacgtagatgtggactggggccatggtcggcaccacctagtctgtgacaccaaagctgcagggtggctgtgtgtggggttagcagtgggcaccccgtccctccgccgaagaataagcttacctatggcagctgtcccctaggggactggtcgagacatccgtcgggtggattcccttccgggtaggcacgtgcgtattctttccacatggtagctgctgctgggccacaaggaggctgcagacaagcgcgtgccgagagagcgggtggggccgtccatgtcgtatccgtggatgagatggagaatgtgttgtcatgggcagcagcatgcagagctatgaggggcaaagtcgcgggccgcctggctggggatgaaacgtcgaccctggggattgggctcttggtctggcagggcatcacagttgtggaactagtccaacgtgttgggcccccggggcttgggggacccagcgatgctgagccacaacagcgtgctactggattcagagcaaagctgggctatggcgcccggcgctttggggcaacatcacatgggtgtcgctgaaggcttcctcgtgtcgggacagagcagctcctcccatacaggcttccagagaaccagcggctggtgtg

SEQ ID NO: 632075 - DNA, 187 bp, Homo sapiens
ttgaatgtctggctattttgtatttagtggagatgtgcatctccactttagtggagaccgtgtggacaggctggtctcgaactcctgacctcaagtgatccgcccccttcagcctcccaaagtgctgggattacaggcgtgagccactgcgcccggcctaacttgatgtttcttaaacttgtttgat

SEQ ID NO: 632076 - DNA, 503 bp, Homo sapiens
agcggggaaaaaaaacttttttgttttaagcagtactttgtgagttacaagacagcagcagctccttagtgtgattgccgaggccttttgggtttgaaaactctggttccttgtgtgaattgggtgttaggagttcttatggtttattctgcacgcctttactatggtcctttatttcactgaacacagtgaataccaaggcactgtttgattagagggttagagacgtaggggcaggtgattaagaaagaacatagaaaagctaataatgctcgctcaagcaattttcatgggcctaagtacgaaacttgagtgagctgagcagcaagtgtggaacacgctaagttcgctaaaaaagcgcccccaagggggccagaaaacttccgataagaggggaaaaatactttttgggttggggccacgcgacgtggctcgagacccccgaaagtggtgtttcccccaattttccggggtccccttttggagaacggcagaaaacttta

SEQ ID NO: 632077 - DNA, 1060 bp, Homo sapiens
tggaaacgaagtctcgttttggtgtgcccaggttggattgcaggggcttgatctgtgctcactgcaaccgccaccttccagggtttcaagtgattctccttgccatcagcctcccaagcagctgggattacagacgccttgccaccacgcccggataacttggttgtattttaagtagagatggggtttcaccatatgggccagggtggtctcgaactcctgacctcaagtgatccgcatgcctcggaatcccaaagttgctgggattacaggcgtgagccattgggcccagcccaaatttatatttttcacataactaatacaagaggtgaagtggctcctcccaagttagcagtgctgccggggccttggcccaggcctagccagtgggctcacctcataatgctcccaagccaaccctgatgctccgggctccagggtagaccttttccctttagaaggtcacagtgtccaggaagctctagtgacacatggtgtgaatgaggttgagcgctgactccatgttcagtattctaaagggctcgggagtacaaagcaattagcctaagattgccacagggaaagaagtccatgtgtcaagggcccgttctccgagtagggccaaagtatctcaccaggtgatctgcagactataggaccgcagaactttcgctatattcatcagtaaatacacattctactgtccacatcactagactaagccaattcaatatacctggggcactagaaacacagctccgtatgatattaaaccccggaaaacatgtcaatatatgtccctatacacgcaggatggccgactggcactagacggggcgaacaaacctggcgtaggcccataccatcgaagaaagaggaggctagaggaacaccagggcccacaatggtagaccaccgacattcacaaaagaacattacccacgaggaaaccgaggagacataggactatggcagagctcgcgcaatgacgaccaagaggttgcacgcgccaaggccggaacaaccgtatgacagatcacaagcagcgtggagacaaact

SEQ ID NO: 632078 - DNA, 182 bp, Homo sapiens
atatagcacattgtaaaaccctgtactctactaatatacaaaaaaattacccgggtgtggtggtgtatgcctctactcccagctacttagtgagtgctgatgcagtagaattgcttgagccccagaggaaaaggttgcagtgagccgagattgtgccactgcaatccagcttgcctctggtg

SEQ ID NO: 632079 - DNA, 142 bp, Homo sapiens
cctgtatctggatcacaatgccagcgggtggcaaagtatagcgtcgcctatagaggagcgtgagaccagaacgctatggacgatctagcattttagaagtcacccaagcgaattcaccccgaaagcagcgagatgtacggcg

SEQ ID NO: 632080 - DNA, 492 bp, Homo sapiens
caacgtctgtgtcattagagagacgtgtgtcgctgcgctggctaatttatatataactaggtagacgtgtgtagtggataccgtattatagagcagaggtacaatccagatgtagattcattgacgggaaacatctttcgcgtgtgggatctgtggctgccaggcctggtgagacgaggattcaggagacggggtaagggagtgtatattttcagcagtcagcacctaggttactttgtgtactctacaaatacccagtgaggggagtatatgtttacccgtggctgctgagggctcgagatgagggtcagggtccggatcagtgtgcctgctgccttgggatcttggtcctcagtcagaggcacttcctctctctaaccaccccctaccccaagccagacaatctgttcacgggtagttggtacccagtgacccggtcagagtcgggggtctctcagcccttctcaggatatacccatgcacattttcagg

SEQ ID NO: 632081 - DNA, 518 bp, Homo sapiens
gacagaggacagggaagaaatgattccatagttttaaagtcttagggaactgatgcgaatctgatgggcatagtagcatatggaatcgaaatgacgagaatgatttcaaccagggttaggtcctaggtaacatacaacgttgtggaagcttattcattttagggtttacgactgcctctcagaggatcagactggccttgcccgttcttccttccctcttgctagctgctgtgatcacagctcttctgctgctctgcggagctgtccctcctaggttattcctgctgtttgctctctcctcaggattggagatacccagtacaccttgctccttcttttccttgaggctttataactttacataagggggacaagtttacctaacaacacagggaagagtctaatattaagaaatatgcaaagttcttttagtcgtggatgctggtctatcactcctgcaacccttttgagagtaacggaaagctctgttgagtctcaacttttctttcagtgggcag

SEQ ID NO: 632082 - DNA, 728 bp, Homo sapiens
gcttttccccactgttctggagggaaggggaaggagggggtcttcagcgctggagccaggctggtgtgtgctgggctgagatgagcatgagatattagggaggtgcctcatgggcgtggtgcatgtgccctgcgggctgagaactgaggaagagtgccgcagaacgttgcagggtctgcggacgcgggaacgtgtcctgatgctgatacggaggggagccctcagtcctgcggtgatgctgggagtgagtgagtgcgagtggctgagatgcgggttatggtgagcctgaggcttttatgggcctgtgtatccccttcgtcgccggccccagttctgcactcacctctcgtgcccggactggtccgcacatggtctccgctctggtcccatgtcgcgctctggtggttggggatggagcgggacgcaagtgggtgtaagtggaggctaggtgttcgtgttcttctatcagtgcctactcccgcaggtcctcagctggttgcctggggaggcggacggggctcctgaggggtagaggttgggtgggcacctcgcctgagggtctggtgtccggctttggcctctgttggatcgtcaatcaccaaagttaactccctctgaagactccaagtcccttctttgtactgtccttgtgagtcagcgtctgggcctgggtgtggtccctcctcatacttcttgttcctagggacaaggggtcaagccaggatgtg

SEQ ID NO: 632083 - DNA, 1083 bp, Homo sapiens
ggagcggtcagtgatcatgagggagagtgcgttggagccggtggcctgtgccctgaggcgccggcggggggtccctgtgcacgcctgtgacggtggtagaccctgctaggagaagctggcctccatgctaggagactctgctgtgtgagctgtgcagtggaggcctggctcgaagtgcagggaggcctggcagtggtccgtgcggccgcatccagagctggcctgtggctgctctgagtcgcagcacacgatcaccaccatgcaacaccttgagcagcagaatgctggccaatggccggagcgcgtgagctcggcacgccaaacggccgcccaagagcgcgcggtgcgcctgtggcagcccaggtgcagccggcctgcgagtgccaaacgcactggagcttgcttggattggacgcgcggggaacgcgtccagcggtatctgcgtcttcaagcgcaggagtggctgcaagtcccagtccatgcgcttttaccgagaacaggggcaacccaggagcgccgtatggggccccgggtcgggcaccaagatcgctgagccatggggccccgagaaggccagtgcgctgggagggcccgatacaggtatgggaacgacagcagcatcgggacgcgcaggggaggccagagggtgggacagtccacgtggagcccaaatacgtgtatattgcactagggagacaacgcgggaattggccaggtaccgtgggtaccagtgatgcccattcacgaaacgcggtgccccgtattacagcgacgccacgggaaaacagggtccgccgttgccaaggtgggcaccagcgctgacacacgaacgccccagtgggtcacaaatgcccagtggtctcgattcgggccaccttagtgggcaggcccggattgggccccgtgggcacttgccggccatggcacaaggccacacaaagaccctggagaaaaggccacgcaatgtcacgatggcagggcgatagaggcaggccaccaaagcgcggcactgtggaagcgacgccgaaaagaaggaccttacgccgcacaaggtgaaaacaacgccgcggagcggggaaaaga

SEQ ID NO: 632084 - DNA, 1067 bp, Homo sapiens
tgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaaagtaggtcaatttcgtaacagtttatttgggacacaccctgaagctttggtttggaatttaagaaatgagtttcagggatttggacaaaccatttggttaaccagctgtcctggggctatggaagaagatttcattttccggcgcatccacttgtggcagtccaagtcctctagtgcaacgccatagcaaatataaaggatttactatgcacggtgatacattttatgggagtggcctcaagccaagatagtggaatttatatgaaggggtgtgaactggtatttctttactactatagtagttaagttataacttggcatctataatggagctttctcatctggtcaaaggctagggtttccttaacaatggttacaattctagatctatccacctggtttttaatggtctacaaaccattaatggtaaatatggtcttaagagtcagtcatgggcttgtgtcaatttacccttggacgagttccacaaggggtagtagagtggttaaacgtcttgcctctagttactacccagtattcataattggtttaccctttactgtaattgggtcctcttagaaagtccgaatcatcgtgatctaatagacggcttagtaaaccagagtttgaacagggcgtatttactacatacggtattatattagagcaccaacggtgttacttaaggtggttatgtgaccagtattttacagttatatgttaccatggttccgcgaaacaaccttagcgcggacgccaggaccttcaagcctctcgccatcacaaattcacccgcgtcaacaccaccagtccaaggacacccacgaacaaccctcacaaacagcgcgccccactcaggatcacacctcgcccgaatcaagccacagacaggtgcacgtcgccaccacgccgtcttgtgtccccacggc

SEQ ID NO: 632085 - DNA, 118 bp, Homo sapiens
catcgatctgacgaccaagaaccttggatgcccatggcgcgaacatgtcgggctgtacaccgaaaatggcaaccaggaaagtttggagactgtctccatgcaccatgccttgagctag

SEQ ID NO: 632086 - DNA, 539 bp, Homo sapiens
aaaaaaaaaaaaaaaaaatttttatttttttggaaaaaaaaaatggccaacaaaaaaaaaaaagggccccccccaaaagggggaaaaatccggggacaaaaaaaaaaggggtctccccaaaaaaaaaaaaaaaaaaacctcacattttgggggggtgggaaaaaaaaaaaaaaaattccttcttttgaaaaaattttccccccaaaaaatgaaaaatatttttttttttttcccccctttttttaccaaaaacccccccttttttttcccacaggaaaaacgtttataaatttctcccccgggggggggcgaaatttaccccacccacttttttttttcaatcaacaaaccctctttcactaaaaaacataaacctactttctattttttatggcccaacacaaactccgcgcaaaaaaaaaaataacatttctttctgtgtaaaatatattaaaccgccaatacccaccaaataaaaacattaaaaatacaaaggtaaaattggggggtctttcaggaggcacacaaataaaattttc

SEQ ID NO: 632087 - DNA, 113 bp, Homo sapiens
  misc_feature (30)..(30): n is a, c, g, or t
  misc_feature (32)..(33): n is a, c, g, or t
  misc_feature (76)..(76): n is a, c, g, or t
gggatgaggaacgtcactgggatgaggacncnnctgggatgaggaacgtcactgggctgaagacaactcttgtgtngtccgttgctttgagtcctttgagtggctttcctcgt

SEQ ID NO: 632088 - DNA, 177 bp, Homo sapiens
ccctaacccctaaccctaacaccaaccttaaccctaggttcattactacatttgtattgactatgtcaatgttgattattatgatcgctgtcttaggactgcatggcagcgaggggattgtggatcttatattaatgtttttgtattgaggcagtgcattagcactacaggtgcttg

SEQ ID NO: 632089 - DNA, 840 bp, Homo sapiens
  misc_feature (221)..(222): n is a, c, g, or t
  misc_feature (295)..(296): n is a, c, g, or t
ggcggcggagccgactcgtcgcggcgaggcgcacgcggtccgcgccggcgtcagtctgggattggcggccgcgattcctccgccccctgccaatcgccggggacgacttccgtgggtttttccggctctcccgcgtcgctaaggagcgacgggctgtctggccagaccccgagttctctggtgctgctcagctggctgcgacgctaggaggccgcgctccnnccccgctaccatgaggccccggaaagccttcctgtcctgctgctcttggggctggtgcagctgctggccgtgnngggtgccgagggcccggactgaggattcttctaacaggagaaaatgccatttgaggaatgaagaggaggaggacgtgaggaatgactgatgatgacggaagaagacgagcttggaaggtaaggggaacgaaagattggagtcttggtcctaaaatgatgcaaactttgataatttttgtggctgagcaaagacacatgggctgcttggacgttttatggcgtccatggtgtagtgaccatatgcaacgcaggtttgctccgggaatatgaacaaattttgccgagcattattacaggataaagaatcctccgcatttcctgtttgccaaagactcgatggcaaccctcagcgtcttgtgcttgggcagcaagggtttgactgtgagttgtgctaccccaacgattaaggatcacttaagaaaggtggcagtgtgtagaactacacgagggggtccagaaccgggagaaatggtgccccggtctgagaagtctccagccgacgggagcatctcaacaaagtcacctgtgttgcccacggcattgg

SEQ ID NO: 632090 - DNA, 184 bp, Homo sapiens
  misc_feature (3)..(3): n is a, c, g, or t
ccnatctcggtcgaatattacatacttttaagtaagccgaatgtcagatatacaaagaacaaagtatagaatttgggaagaagtgtgggccagagtcaatgcttggaaacacttggatgcaatttactttgattccagtaggaagctgcatatgaataatggagaacaaaatctggacattcga

SEQ ID NO: 632091 - DNA, 446 bp, Homo sapiens
cctagcttgtccagcttgaggtactgcacatagagttccagcgtgagacaagccccaggtatcgctgcccaacaagcgcgtctgggtgcgttgttgatgatcataacggtcgttgtgctgcccgtgctgtggccgcaacagcatgccttcatgccagataactttctgagcctgcatgtcactgcgccaccaggccggcgcgtgagccagcaacgcgtataccggtcagatccaataccagatcagcacggtaacgtcgtagcacggtcagcggaatcagcagccgccactggacattgggcaggtctcgctaagccgccagcacccccacgaaacgacggtcaggtccgatacgaagcatgagccccaggcggaccccagggcgcaaaccacgttcgtcgctgataacccagtccttggacagcgtcagctgcgcatagccatac

SEQ ID NO: 632092 - DNA, 101 bp, Homo sapiens
attggcatcttcttctgccccctgctgccctttatccaaatgattatgcttttcatcatgttctactccaaaaatattgaagccttcagctgactgtggcc

SEQ ID NO: 632093 - DNA, 880 bp, Homo sapiens
  misc_feature (30)..(30): n is a, c, g, or t
  misc_feature (64)..(64): n is a, c, g, or t
  misc_feature (74)..(74): n is a, c, g, or t
  misc_feature (76)..(76): n is a, c, g, or t
  misc_feature (81)..(81): n is a, c, g, or t
  misc_feature (86)..(86): n is a, c, g, or t
  misc_feature (92)..(93): n is a, c, g, or t
  misc_feature (127)..(127): n is a, c, g, or t
  misc_feature (146)..(146): n is a, c, g, or t
  misc_feature (151)..(151): n is a, c, g, or t
  misc_feature (160)..(160): n is a, c, g, or t
  misc_feature (165)..(165): n is a, c, g, or t
  misc_feature (168)..(168): n is a, c, g, or t
  misc_feature (170)..(170): n is a, c, g, or t
  misc_feature (178)..(178): n is a, c, g, or t
  misc_feature (189)..(189): n is a, c, g, or t
  misc_feature (196)..(196): n is a, c, g, or t
  misc_feature (209)..(209): n is a, c, g, or t
  misc_feature (213)..(213): n is a, c, g, or t
  misc_feature (219)..(219): n is a, c, g, or t
  misc_feature (280)..(280): n is a, c, g, or t
  misc_feature (283)..(283): n is a, c, g, or t
  misc_feature (290)..(290): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (304)..(304): n is a, c, g, or t
  misc_feature (306)..(307): n is a, c, g, or t
  misc_feature (309)..(309): n is a, c, g, or t
  misc_feature (312)..(312): n is a, c, g, or t
  misc_feature (320)..(320): n is a, c, g, or t
  misc_feature (336)..(336): n is a, c, g, or t
  misc_feature (347)..(347): n is a, c, g, or t
  misc_feature (357)..(357): n is a, c, g, or t
  misc_feature (374)..(374): n is a, c, g, or t
  misc_feature (402)..(402): n is a, c, g, or t
  misc_feature (424)..(424): n is a, c, g, or t
  misc_feature (452)..(452): n is a, c, g, or t
  misc_feature (454)..(454): n is a, c, g, or t
  misc_feature (576)..(576): n is a, c, g, or t
  misc_feature (607)..(607): n is a, c, g, or t
  misc_feature (619)..(619): n is a, c, g, or t
  misc_feature (874)..(874): n is a, c, g, or t
gttaaaaaaaaaaaaactccagtgataaangtccgtaaccgatggtcagcataaaaaaccaatngcaataaaangnccggntcttngaaggnngatccctcgaagtgtcgcggaaggaaaggccggnacccctggagaccccaggnccgangaccccgtnccgcnatnanaaaaccgnaacccacggcngcaagcngagctgcaagaanaaanaggggnatgccccgcggtccctagggcaggaggctgaagcagatacagggattacacttttgcaggntcnggggganggggaagnanangnannangangagggaanagccagtgctaagganttcgttgcctntcctctctcnattcactctccgcagtnagagttaaaagcttatatggtcaaaganaaaaataaaaaaaaaaaagtanaaaaaaaaaatagaaaaaaaaatacttntnggagaggcgccgctgcggctccgcggagctttcgttctttttttaatgcagtttcccttccgccacgtgagttccgccttttggccaagagtttagccgcgtcctaggggagcagcaggganggtcggggtcggggccccgggcggggctctnaaatgccgcgtncacaaaggacccaggggacaattgttggagaggtggaaggtcccgagcgagcgcctctcccgctgcccgccagagtcaggcttctggtccctatggaggagagggccgctgggcctagggtccttgtgacccacaggttctatttagcatttgatcttggaggttttgagctccttcacctgtgagtgtagcgccttgtggacagcgagagtcctggactggcagaatcctttcccacactcttgacacttgaangggctt

SEQ ID NO: 632094 - DNA, 734 bp, Homo sapiens
gccatgtgatgccccgcggtgtgttcccccgggtgtcccagccgcccgtggtgttggtgctcccggccaagatcggcagctccgtcgggaagaagaggctcctcttctccccctatcgccaccatcagctggtggaggggaaaacattttgtggcggcccctctcgtctgggggtgcccccaccaagagcggcaagttgaagtctgccctcacgccactaggtgggcgccgacaacgaggtgtggtggcgcgacgtcacgcgtcagcttgtggaggtctcccccaacaaattctggtgtgcgtgcgctccctgcgggacataccagtccagaccccaggtgcgcggggcgccatatatccgtgcggggagggcccccccgcctttgcgcgtgggtgaaactatccaggaggcgcgtctcctcccgccgccgctggcccactgtggtgtgcacacgacacgcagttcttcgcactggagagccgtgcccctatgtacaccagatccatgcctcaccgtgcacggcctccgacaccccgcggtctggagcgcgcgggaccctggtgctgtgtatcgagaatggacgccaccgaaaatggccccacgccgaggaggcccttgccgcccctcgatcaccccgtcccgacgccccccctcgtcctctgtacaagccgccctcctactactcccctccgcgtgtaacaaacagacgacgcaggctcgcccacaaaacaaa

SEQ ID NO: 632095 - DNA, 149 bp, Homo sapiens
tagtttagaagttcaatagcaaagaaaaaaagaaaagaaaaccacagtgaagaggccgaatttaccccgaccttggcaaaggctcacccaaaaagcaaaagggaaaagtaattttctttagtgtattttaaacacggcattcagttttt

SEQ ID NO: 632096 - DNA, 425 bp, Homo sapiens
tttttaaccaatcaaattttgtgacaaaggcaattatactcttatttcccagggtgtgcccagacacataagccaacaacacccacaggcattcacgcaaatatatgcatagatgcccagaatgtccacatagacagtcacagggaggtgcacacaaggatagtgggtttatacatggacacatggacccagaaacagatacctccctgggctgtgcacacatcataccccacccttgctgacatcactgcctttgctcagagctcctggctctgcagtttgggctcagttccttcaggctggaacccagcaggacccagcctgggctggctgggctgagctgtactggacaagatggggcagggcagggccagccagggcgccacagatgagctcaggtgtcagactccgcccgtggggcttcc

SEQ ID NO: 632097 - DNA, 952 bp, Homo sapiens
gcggctgcggtggcgtgagcgggaccattctggctgttgtctggacaagcaagtcgtaatgaggtggtgagaggatggaagctgggccaacccacgagaagcaatcacactagatttacatcttcttggtgaccccacttctcgactgttcagtgccagtcctgcgcggacttggcgaggtcggcgagaaatatggcggccccctctagtgaaacctgcggaggctgaccctccgctgtggagggctgagcgtcgggggagccagggtcttctgcgagtcgggacgcgtgcgctcggggtgccctatgctgtgtgtagcctagggacttggtgccttgtattccagccactccagccatggctgaaaggggccaatgtagagctcgggctgtggcttcagagggtggaagccccaagctgtggcagcttccatgtggtgttcagctgcaggtgcacagaagtcaagaattgaggtttgggaacctccacctagatttcagaggagtatggaaatgcttggatgcccaggccagaacgtttgcctgcagagacagaggccctcaggataacctctgctagggccgtgcagcaacgggcccatgtgcggatcacgcacgcctgccacagactccccactgcgctctgcctcgtggagatctgaaacagacggcaccatggctccagatccccggaatggtggatcccaccggcagcctagatccgtgcacctggaccaacgcgcacagccgcacggacggccgcccgtgaatgcggcccgaggcaggctacactgcaacgcacggcggcggtgcaacccagaccatgggaacccctggtgcagcctcgccgctgtacactgcgcgcagcgcacctccggcacctccacaagccgcccgcacgctccaatcgcggcgtgaaccttggggcaatccaatgacaatccatacgacca

SEQ ID NO: 632098 - DNA, 232 bp, Homo sapiens
  misc_feature (64)..(64): n is a, c, g, or t
  misc_feature (135)..(136): n is a, c, g, or t
  misc_feature (229)..(229): n is a, c, g, or t
aaatgtatgatcagaaaataggtacgcttttaaaatatttgaacagaaaagctacaaataaatngagcaatgcttttaaaatcatctttgttttatagactttttctcgcatgaattacattttacaatttcatnnggcatattcgcactttaagtactgacgaagaagactaaaacaatcattttttaacaatatttaaaaggatcatatagtcgacttttaaaacanccc

SEQ ID NO: 632099 - DNA, 368 bp, Homo sapiens
aagctatccccagaaagattcgggttctgctcctaccacttgaagttcacggcacacgcaggcaaacagctcctgaacatgtccaccaccttcatgggcaggtccaggccactggaggacgtgtgcagacagacacccaggtccgccgaccctgctaggcaagaggggtgggtcagagcgctggtctgtgccctgggaacacaaatcctcccagcacagtgagacaacatcccccgaggggagtgagaattggataaagcccccgacagccccaagcacaagtggcttaagctggccaagcagccacacggcctggctgggacatctgaaaatgtaagctgacacttcttatacataaccacaagaaa

SEQ ID NO: 632100 - DNA, 646 bp, Homo sapiens
  misc_feature (583)..(583): n is a, c, g, or t
  misc_feature (585)..(586): n is a, c, g, or t
  misc_feature (590)..(590): n is a, c, g, or t
  misc_feature (622)..(622): n is a, c, g, or t
  misc_feature (627)..(628): n is a, c, g, or t
  misc_feature (632)..(632): n is a, c, g, or t
  misc_feature (636)..(636): n is a, c, g, or t
ccccccccctcctccccacctgggggggggggggggggggggtttttttttttttttttttttctaaaaccaaaaaaaaaaaaaaaaaagaaaaaaaaaaaaaccccccccattgaaaccggggggggggggggggggggaaaaaaaaagaggcggtggtgggtaaaaaaaaaaaaaaaaaaggggggcgggcgcccaaaaaaaaaaaggaggggccgcgccccccccctttggggggggggggggggggggggggcggagaaaaaaaaaaatttttcccccccccccccgccggagagaaggagacccccccccacctttcttggggttgggggggggggaaaaaaaaaaccccccccttttttttttaaaaaccgccgggccaaaaattgggggggggggggttttttttaaaaaaaaaagggggggccccggggtgttaaaaacctcctcttgagggaaaaaaaaaagaatttgtttttaaaaaaggggggctttttaggggggtttaaacggggtttaacccttttttggggcgcaagtgcccctctccaaggttgggggggtaaggcgctaaggctgnannttgnaaaaaggctcaagaaaaaattcttggggaagnaaaannaacnttcntgctcgtggc

SEQ ID NO: 632101 - DNA, 259 bp, Homo sapiens
  misc_feature (74)..(74): n is a, c, g, or t
  misc_feature (118)..(118): n is a, c, g, or t
  misc_feature (123)..(123): n is a, c, g, or t
  misc_feature (135)..(135): n is a, c, g, or t
  misc_feature (174)..(174): n is a, c, g, or t
  misc_feature (176)..(176): n is a, c, g, or t
  misc_feature (204)..(204): n is a, c, g, or t
  misc_feature (233)..(234): n is a, c, g, or t
  misc_feature (241)..(241): n is a, c, g, or t
  misc_feature (250)..(250): n is a, c, g, or t
aaaaccctgccccgccttcccctccaattgccgtgcccactgtctcttttaaatagactctgtcctcatcaagnctgttctctgtcccccaaatatgccgtatcttccttatgcatgnatttnttcccagttccntacaatcttataattagtggttacgctaatctatatgtntntttaaactcatagaattgtatacaaaangtcaactgtactgtgtacacacatttaanngataaantgtgttctnttaacgctt

SEQ ID NO: 632102 - DNA, 287 bp, Homo sapiens
  misc_feature (58)..(58): n is a, c, g, or t
  misc_feature (168)..(168): n is a, c, g, or t
taagagcctgcacgtcgcctatgccggatatgcaataggtcgattataaaaaagagtntgtatatggataatctgcaaacaaatattgctgtagtgactcagcaaagagccaagcatacaaaaactcgctactacattctatgcgatgatttttttggtcacggcatntaattgcggtgatcgtgcaagtctctcaatggcagcaacgccaatgtctcatgaactgggaattgactcaatcactatggaatatatttactcggactttgcatggacctatgtaatta

SEQ ID NO: 632103 - DNA, 522 bp, Homo sapiens
tggagcctggttctccttagtaggaaactttgggggacagctgaagtagtcaaaggcagtggagtagatcttctcgcgaaacacattgcggatggttgcattttggacccacatcggcatgcaggagggacagccccagggtcagcagcttgaagcggggcccgatggccgacacatgccggttcatgctccccttggcccacaacgatgttcagggacatggagcgctgcagcaggctggagacagatctccacttggtcagagctgcagtacttggcgatctcaaaacgctgcaccaggaagtcgatccagatgtagtgaggggtcacttcgcagggacaagggtttgcgtagacttgcttacgaggcagacagggaggtctgcttcctttatctcagcagaacccaggccaaattactgctccactgtcatgtgccagaccctgccatctcccgaatgaactacaggtacagaaggactgtcagctcctcagagtgccaagggccagaaaccgacaaaa

SEQ ID NO: 632104 - DNA, 122 bp, Homo sapiens
  misc_feature (77)..(77): n is a, c, g, or t
  misc_feature (107)..(107): n is a, c, g, or t
  misc_feature (112)..(112): n is a, c, g, or t
ctcactgcagcctccgcctctgggttcaaaagattctcctgcacacctgtagtcccaactattcgggaagctgaggnaggagaatcttttgaacccagagcggagtnatccngaattctttg

SEQ ID NO: 632105 - DNA, 411 bp, Homo sapiens
tatccaaagatctgtaaaatcttctctccatctaatgactagtcaccatttggagctggggagggacgctcattattcccatcaatattacatttggctgctgtggatttgatagtcctcgctatcagatcactgacaaagcaagtacgcgcttgactgtcctctaatacaccttccggaactgaacccatcactgagggaaggctctgtgctttagcaacacttgtgtcaacagtacattgttccaatagttgagtttccaactctttgtgaagagcttttcctcctaggggtagtgctccccaacaatttagaactgggattccttcatatatctatagagtagtctaggatactactattttaggagatcaaatgtggtttccttgatattttcctcaacttctgcag

SEQ ID NO: 632106 - DNA, 159 bp, Homo sapiens
taatacaaacacggtctcacatacttgaactcctgtatgtaagcaatcctcctgctttggcctcccaatttttttggattataggcatgaaccaccacgcccagcctattactgaagtcgacgcggccgcgattttagttggtgttgttggcccgccct

SEQ ID NO: 632107 - DNA, 256 bp, Homo sapiens
catcactcattcgctctgtattctcagagtggcattcattcattcattcattcatttactcatttgctccacacattccgtcactcattggctgtgcattctcagagtggcattcattcattcactcatttactcatttgctccacacttgtcaggaactagtgggcatcatgcattcactctttcatttattcactccacttttagggagaaaaccctacacgtcattgatttatgtattcagccattcgtttat

SEQ ID NO: 632108 - DNA, 298 bp, Homo sapiens
agaggctgagaacgggtagggagagagtgagagtaagagaataatgacttaatgggtacaaatatatggtttgacagaagaaataggagagtacataaagacaattagacaaaatctggaaaacaattcatgatttgaatgagaaaatcaacagagacagatataaaaaagaaccaaacagaagttctagagctcaataattcaatgaataaatgtaaaaaatacatgactagatctaaatgagacagactagaccacggggaaggaacgaatttcttggagacaggtctgtttgtag

SEQ ID NO: 632109 - DNA, 104 bp, Homo sapiens
tgactaccaagctgtcgatgatgaatcgaggccaatcttgagggtgcgacatcagcgaggatgacattgatgatggattcaggagactgtttgcccagtggcag

SEQ ID NO: 632110 - DNA, 191 bp, Homo sapiens
gagaagtgtacttaccctactgataatgtgttgttgccatgtctaatcctgctcagtactgaaggacccgcacggatacagacttttggtgtatgtgcttggctgaggagccaatggggcgaagctaccatctgtgggattatgactgaccgcctctaagtcagaatcccgcccaggtggcattcggccat

SEQ ID NO: 632111 - DNA, 728 bp, Homo sapiens
gctccggcatagacgtgtgtgggttgtcaaggcaggtcactctgcccctctgagcctcagtcttcctgccagtgacgcagtggagactggcactgactgcctcccaggagcgtcgtgtggccttgacagtgagagaggtggtgtcatgtgcctgtgttcagcattgcctggtgggtgccctcagtgcaccctgcaccttgtggggctcctgtgccccctgttgatttggcccctattctcaatggttacctggtgctgggcttgggtggggacttgcttgtactaggatatagtgggggtggggccaatgaccaggctatgtggttggttgtgttggcacccatgtgaataggaacccagttgggcctagaggcaccttgtgtagagacaagtgtagttgttacaccacttacaggtttggagacttgcaacacctatactaccttagactttactatatagcggtgttacttactttaacttggtgagacgcctttgcatgttacttatgtgtggagctaacccccccgtttgcatatgctatttgccgtaaatgataaaaacttggagggtgtaaagaaaaacggtctcgagaatgattctgacaatgggtatggaagcgcacattaacttatcataaagaggggaactgtatggcgaatttcgcctatgttttcagattgtttatgactaaaaaacgggcacaaacatgtaccttatgaccaata

SEQ ID NO: 632112 - DNA, 149 bp, Homo sapiens
agagcaagactatggttagaatagggtggatggagagcgcgtgtatatgcgggtggcactgcccacggtgggcagggcggtctctctactcgaaggtgaccacgtatagatactgagacggtgaagtggagggtgaataggtcacggcg

SEQ ID NO: 632113 - DNA, 402 bp, Homo sapiens
  misc_feature (63)..(64): n is a, c, g, or t
gggctggcatggtggctcacgctggtaatcccagcactttgggaggaggattgcttgatccannaagtttgagactggcctgggcaacataatgagacccctgtgtctgtagaaaagaaatagaatgggtgcagtggctcatgcctgtaatcctagcactttggaaggcctacatgggtggatcgtttgaggccaggagtttgagaccagcttgggaaactctgtctctgcaaaaaatagaaaaattagctgggtgtggtagtgcatgcctgtagtcccagctactctggaggctgaggcacgagaatcgctggaacccgggaggcagatgttgtagtgagccaagatggtgccattgcactccagcctgggtgacaaagggagactgactgtgtctcttaa

SEQ ID NO: 632114 - DNA, 545 bp, Homo sapiens
  misc_feature (200)..(200): n is a, c, g, or t
  misc_feature (351)..(351): n is a, c, g, or t
taatcgagctcggtaccagttcgacggagactctcgtcattgtcctattatagacaatgacgagagtgaattaatttttagttagcatctacaggtgcaaagctgaagcagagttcccaccatcatactgtgagctccctcgaaggctatatgtaccctaatcttcccagtccccagttgtctctcccacgagaaggaanggctgcgcttactatatgacagtatcaggcatcagatctgtcatgcctcatgtcttatgcatttaggcacctaggcatagtagcaaaacgagctcatggaaacatgcccagccagggagacaggccgctcaggaagagagaactgcccagngtctgtggcagcgcatgacgggcagtggctattgccaccaacatgaggaatcccgttattggaactccaacctgagaggtagtgagcttggagggtttctttgtttgtctgtttgtctgtatgtctgtttgagaattgcacacaattacgacagtcatttttcccagaagtcctctctaagagcctgtgctcat

SEQ ID NO: 632115 - DNA, 456 bp, Homo sapiens
cggatccactgcaacatccgctcccacattaaagtaattcttctgctcagcctccctcgcagccggaactacaggtgcccgctaccatgctcagactatgtttgtatttttagtagagaaggggtttcgccatgttggccaggctggtctcgaactcctgacctcatgatccgcccgccttggcctcccaaagtgctgggattacaggggtgaaccaccgtgcccagcagcagtgtgaatttcattaccttttttcctgggtgtttttatcaagaagggcttgtgtgtgtgcgcacatatgtgtctttaaactcatttgttaatcttgcccatgtataaattaagatcacagatcttgtttatgttaagagctgtgagattttggtgagctgctgcttctggaatgtatacctagtgaagaggcagcattgcgtaccagaaagagctcacgtttcg

SEQ ID NO: 632116 - DNA, 280 bp, Homo sapiens
tgtcttgctttgtcgctaaaaaattaagacaggtcctgctttgttgcccatgctggagtgcagtggtacgatcttggctcaacgcagcctcgacctcccgggcccaagtgattctcccacctcagcctcccaagtagctgggattacaggtacaggtgatgaccaccatgctttggccattgtaaccattttatctttttttttttttttttttttttttttttttaaaaaaaaacccccccctttcgccaaggggggggtgtgcgggccatatttcctt

SEQ ID NO: 632117 - DNA, 118 bp, Homo sapiens
acaaatatagggtaccgcataactattctctaaagatattactcagttctagctagtgcccagttgtctccaccaccacctctgcctccctaacaagaagaaaaaatgggcaatgacg

SEQ ID NO: 632118 - DNA, 247 bp, Homo sapiens
tgtggcatgttccctgagaaggaggtgattccttccagctgagcttggatgcgagcaccttgtgggcacctgggagtgacatgcttggtcttacctgactggccttgacttttagccgtggtgagaccccgagtcatataaatttgctgtgctatgccacacttctcacctacagaaacttagtttaaagccactaagtttgtggtaatttagttggctttaggccctctgaagggtacacgattta

SEQ ID NO: 632119 - DNA, 792 bp, Homo sapiens
  misc_feature (772)..(772): n is a, c, g, or t
tagttttatttaagtagatctttgttgttctttcaacccatctgtacttgcattttgcttgactccagcaatccattgccgtcttgcgatcaggctctaataactggcaatttctgtgtagtctagtagatacactgtccacaatggcatcttttccaggcaacacaactttctcagccactttggattaatatgattggcctaatctaagcactctgcgaagatctatccccttgaccatcccactatatgttgtgaggacgtctgtcggcatgaaaagtgtctctacgtctttgacaatgaattgataaggacaagttaatggacctgtgtggtagctagctgtttgaaaccgccctgcatatcttctggcattttcccattgaggatccccagacccatctccaaactcgcatctatcgcaatgatcaagcataggtactatggtacttgactgaagatgaatgctggcagcagaggaacccaatgctgcagttccatgatagagatcccccctctcgatgggccatgaggatgcgtctcgtcactgcgaacgaacgtcgattaggttacggagttcatagttaggaaaacttgtgcccttgtatagtgtcccaatgggctccccaatgcagcctctgagtgcaccctgtcccactctggcatccccctgctggtgtctagtgttttatttccctctcctcgtccttgtgattgaaaggcagtaaactaagggtgtcaagccccattccctctctactcttgacagcantaacgacgggtgtattgtgg

SEQ ID NO: 632120 - DNA, 370 bp, Homo sapiens
  misc_feature (14)..(14): n is a, c, g, or t
acgctcgctctgtnggggggcagatacaattcttcaggatttaggcaagatgggttaaagactaaaaatacaatcaatgggttaaaaaacaaaatctggctgggcgcagtggctcacacgtgtaatcccagcactttgggaggccaggagggtggatcacgaggtcaagagatcaagtccatcctggccaacatggtgaaaccctgtctctactaaaaatacaaaaaattagctgggcctggtggtaggcgcctgtaatcccagctacttgggaggctgaagtaggagaatggtttgaaccctggaggcagaggttgcagtgaaccgagattgggccactgcactccagcttgggcaacagagagagcgt

SEQ ID NO: 632121 - DNA, 252 bp, Homo sapiens
cctccatggtgcagttgttcaacaaatgtaaattttattcccccttcaaagttaagaaattagtgaattatggacaaaatgagtctagttaaaagaaaaccagttaaacaaacaaaataaaactatagacaaattaaagttttcagagtttaactgaccaaagaacaatttgagaattggccagccccctgaactagaataggttcagagtgactcttgggttgtcacatggtcagataatatttatggaca

SEQ ID NO: 632122 - DNA, 809 bp, Homo sapiens
agggttgtctacatagcgggcaagtgtggtctggtgcctgtcttggcagaaaactacaataagagcgataattgtgaggatacacctagaggcagggtatttctgctgtacgcagtggtgaagaagatcagcttctgacctcacctgggacaatctgaaaggcaagaagtcctggcatacggcgagttggcagaaccgctggctggaactatcactccatggtgcctgctctacaataagatcaatcactgcagatttgatggaattgtgtgcatgtgaaggttgtgcccctgggtctagagaaagactccagtctctgtagagctgtgtattgggctcaggcctaaatcctgtgtgaaccccaaccaacaaagagggatatctacggctacacaggcgcttctcaggtgtctggttgagaacgggatgatgtggcctattgtgaaacacgcagacgtgttccacagaatcactggggggagaatgaccctgtatccatggggctaggaattcttgaatgactcaggactatgagtaggtggtgccttgatggtaccaggaaaatctgtggaggagtatgcgaacttgccacctggcccagagtccccgaatcaggctgtgtgatcaacacggaagagataagggaagcttgcgtccaaaaagatcattacgtcaacaggaggcgtctgattggaaagcaagcgtactgactggatcgggcaattgaggtatgttccgggtcggaaaccaggagcttctgtcagagatgaccaggttgtgcgggccgaattcatgagtgaaacaatatg

SEQ ID NO: 632123 - DNA, 126 bp, Homo sapiens
  misc_feature (29)..(29): n is a, c, g, or t
  misc_feature (52)..(52): n is a, c, g, or t
ttccatggagacgagagcaggtggaagantatgtaagatctgaaacactganattgtctgcttctcatcttcagtgagattccaaaggatagtacagtgacagaacaagaataggcactctctaca

SEQ ID NO: 632124 - DNA, 664 bp, Homo sapiens
gcggcaggaggaaaaatgtttattttcaacgggggggatcgcaacagtggcttattaccaacaaatttttatagaacacccgctgggtgcaaaatggcttctaataactacaaaaaatattccccccggtaggaaatgctgcccacttgttgctcctggttgcttttgtggggggccttcctacaaaggtggccggggcaacaaattttgtggtttataataacaaaagttggataagttgttctcatacttaatacccaacagggtggtaatttacctactgggggcgccttatttgttattacccgccccaaccgccgcccctgtggaaaaagccttatgtaaaaaaaaaaaaaaagatttttttctccccaccaaaaactctttatttttttttgggaacaacacctgaatcccggggggggctttttggagaaaacaacttgtgttttaaaacgtaaaagggggggttccttcgttggaaataaaaaaaaaaaatcttagagggggggccccctctctcttttttaccgggccccataataggaaaaaaaccctactttgttttttaaaaaaaaaattttttacccccacaccccccccacccgggggggggggccaaaaaaaaaattttgtttagaaaaatttttcttttaaaccccag

SEQ ID NO: 632125 - DNA, 302 bp, Homo sapiens
taagaaagatgcctccttgtgtctcactgttttctagcactgaaacatgatacactttgtatccacctgcagaataaaacaatccagacaggcgctctgtaacttacacatcacttgattaaaattatagcctccaaatatagtgttttagaaaaggcactgtacatttttagaggcattgtaatgtcatttcccacctttaacccatttaacattgtttatattttaaaaaaatttcccaattttacttgttaattaaaaaacccctgaaattaaatcgtaaccatctcaacccatgtcgt

SEQ ID NO: 632126 - DNA, 715 bp, Homo sapiens
  misc_feature (336)..(336): n is a, c, g, or t
  misc_feature (511)..(511): n is a, c, g, or t
  misc_feature (574)..(574): n is a, c, g, or t
ggtgtgagatggtatctcattgcggttttgatttgcatttctctgatggccagtgatgatgagcattttttcatgtgttttttggctgcataaatgtcttcttttgagaagtgtctgttcatgtcctttgcccactttttgatggggttgtttgtttttttctttcattgctcgtgcttttactgtctgccttttcgattatagctgtctttgtagacgtgattttgatttgcatttccataatgaatagtgatgttgagccaattttcatatgtttgtggatatttgtacatcttctttggagagatgcctatttaaatcctttgcctatattgnatttggtttatttgccttgctactattgagagtggtatgattcctttatattctggatataagacccttatcagatatatggcatgcaaatattttattcattgctgcaagttttgtctctttttgatggtatccgttggagcacgaaactttaaaattttgatgaagtcgaatntattttttctttcattgctcgcgcttttgctggtgcaccctaaaaatctttgcctaaaccccngggtcaggaaaattcactcctctattttccttctagttgtacagaattttatgcctataccttaggtttttaatcttttgaatgctttttgtgttcggcgtgaggatagggcattgagttttcttacccctttgtgggttt

SEQ ID NO: 632127 - DNA, 163 bp, Homo sapiens
ggctgggattacaggcaagagccaccgaacccagccaatattggactttaaataatagccattctgagggtggtgaaatggtactccatgggtggttgtgatttgcatttctctaatgatcagggatgagcttttttttatacatttcttggccaggtgtatg

SEQ ID NO: 632128 - DNA, 383 bp, Homo sapiens
ctggaattctgcacgcgcacagctgtgtgtacacaagagaagagctctctgtgctcttgggagctctataaaaataccttgtggcgctgctcctgcgttgagaggcgagccaacacctgtggcgcggggcacggctctgcacaggcccgagtctcaacggacttgtgcaccccgagttgagtccgagtggcgagctctgcctaccggctcttgagcaatttggcactgtggtggagggccagctggtcacaagaaggggattgtgaatgagacaagttctgttgtaacggctgtgagacagggccacttacctctatgtcacgtggggggttctctctagggcctcaagaaccctgagtgaggggcaccccaccggcccatgg

SEQ ID NO: 632129 - DNA, 140 bp, Homo sapiens
ctagaaagctcttaagactcctccaaaagactacagattattaatcaatgtacacaaatcagtagcactcctatacaccaccgatgcccaaccattggatcaaatcaaggatctaaattcccctttacaatagctgccaa

SEQ ID NO: 632130 - DNA, 273 bp, Homo sapiens
  misc_feature (131)..(131): n is a, c, g, or t
cgaggatccgggtaccatggcaagtctcatgaggctatttaccgaatttatcctctgtctgaccatgattttttccctcaaatacaaccactcctcgacttttcaccctcaaagtataaaaagtatgaaanataaacaagctcttgcactgtacacttagaagtgtacaattaaagcattatagagctatctacacaccgataaatcccatcgaatcttgaataatccatcaatacgtagaacgcaagggtgcagacagaactaaaaccaact

SEQ ID NO: 632131 - DNA, 82 bp, Homo sapiens
acaaagatacttttaatactttgcggtgagaggctggagagtgctacaacggataagaagaaataaaatataaattctaaag

SEQ ID NO: 632132 - DNA, 208 bp, Homo sapiens
agtattcatgaagatacagtgagtcccaggtagataaccctgtcccagggtgtcagcaggatgtgtggtccacaatctccctcaatgcacagcatgagtcacaaatgtccatccacccacaggcctgtgcttgccgtgtgtgtctcctgcagtttgcactgttccttgttataaaacaagactatgccaataatgttatctctgttca

SEQ ID NO: 632133 - DNA, 136 bp, Homo sapiens
ttacagctaataccagacactgccgcactgtctatctcagctcagtgtctggccatattcttttttttctcttctttttggaaaggcacccccagggggctttcagggtacccgagctcaattcggaaccctgggc

SEQ ID NO: 632134 - DNA, 423 bp, Homo sapiens
cattctgatacagtcataagtagtgtgatgcacacatataatgagtgtacatacagctgaccgcaatgaactatacgacgcatatctcggcacatatcctatatgatataagcaacacatgattgatactttatatcatctctggattacttaataccaagatacagtgtaaatgccatgcaaactacctgtaacactatattatttagggaataatgaccaaaatagtctgtacagatgcagtgcttacaaatattaatagacccaaggttggtcgacatccatgtggatgtggaacctgtggttacagaggctgactctttgagccatactaggttcgtagccctttattgacattcaggatttagtcagaactgtatgaggaacagagatcattttatgaataaagtaagtcaggaaggt

SEQ ID NO: 632135 - DNA, 1005 bp, Homo sapiens
gagtgggggccagctatcagttttggctggtggtgcatggcgtgtgtggacaatagggcgcgtcttgtccgtgactggttgtggcgccaaggggtcttcctctggtgggggcaccagggagctcagaacgttttttttgtagcgcgcgggtgtccccttcgtgggggcgtgtctacagttgcttcttggcgcccccgcgttgtctttgccaccgcccgttgggtgttgttgtcccaagacgctggcgcccgcgttgtttgacgtgggcgttctccgttgtggggttcaatacgcttttggcgggccgtcggcgtacgactcaattgcttgggggctcccccgctggatgagggggcccccctgttgctccgcccccccagtttggtgtagtggccgcccaccctgggggttatggttgttttttgcctccccggcgttcgcagaatatctgggccccaagtgctgattccccttctcttcgggggttagagccccccctgcgataaaccacaggcttccggtgctcgcccttataagccagcacgcgtgcagtcaataggctttatgggaggggaccgccctcaacaaatgctggtgcgcgtgggcgaaatgacgcggttgacccccagaggtccgtattgtgtccccgccccggtcccacaaaatcgtttgtcgttctcccccccggcgggcaaagggattggtgtggttgtctgccgccccctcgcccgggagcccaattgcggtgagaaagtctggtcgggccacgggttttcggaccgctagtgaggtacacttggttttgtttgccccggcatgtcgcccgactccggcccgccggtatttttggacgcacaactcgctcccgttggagcctcgtcgttgccatcgcctccccgcggccgtcctcgctaggatcccacccgtctcccactattcctcttctcgcatttggcggacggagtatttcccccctttgggggccttccccccctaaacataaca

SEQ ID NO: 632136 - DNA, 908 bp, Homo sapiens
  misc_feature (152)..(152): n is a, c, g, or t
ggtgtcccccttaagccccccgcggggatgttgtttttgggtgacacaccaacgtgggtgtgtttgccgacgggccctcctcggcgggtatttgttctggtgcgacgacgtgccgcccgttcgttgcgccaccggtggtgaggggtgccganccgcctgctgccgcctcactggggcgaagtatttccattccgtagggggcgctttgttaagaagtgctgctgagcgcgcggtaggttacgcacttctgcactcgaaaaggggtgttattctgggtaagactacgtatgctcgtgtctatttcaatagatgattatttgttcaacacatgcgcttataactacatggggccaacatttcttccccccacttccctctcggacaaacaccattggccctgtactaccttcgtattcctactcagacatacccacaggttgagaaagattttgactccctgtgccgtgttcttctactcccaggaagctctttttatttgtagttctagttatggatattaataaaatgtgtcccccgctatgccatggcaattaatctccacacacacgaacgccgcatttgttttagagcacccacacatcaacgtgctcgccttttggagtcattcccgccatccaacaattcatctcggcgactctctccaataatcccatccccaagccggcctatctttcgtctaatccaccactctgagtccttccacggggagtgctttctcttctttacaccctatttattctttctgtttatatgcagtgcttcctaagaacacgcccaaaagttctgttagtattaccaccgtgctagatataataaacgctatgtctattccctttctcgcaaatttttttccctatactcatcaccccccccggccacaaaacaaa

SEQ ID NO: 632137 - DNA, 331 bp, Homo sapiens
ccttcctagagggtggggccgcctggctgtcccgcctgtggctcggtgccttctcggagccagcatccgctagaccgaactaggactggtaggaggggtgatcggcccaacctcaggccccagccgcgggctgggaagtgttccccatggacgaggggcaagcccctcgcatgtcagggtgtcgtctatgtagacggggaatctgcctcctctcaaaggggaattctttcagcgagtcaagccccgtctgatacggggctgactcaagggcagagccccaaagaggacctggataggttgcgagaagtcggagatcaaggggggtccgggg

SEQ ID NO: 632138 - DNA, 367 bp, Homo sapiens
  misc_feature (171)..(171): n is a, c, g, or t
  misc_feature (212)..(212): n is a, c, g, or t
  misc_feature (224)..(224): n is a, c, g, or t
agtaaaaagaaagaaaaaatattataaatgtacctccgcaggctcagccacaaactggggctgtgtcagggccacatgaggaacgggttttggaaggcgcccatggcatgtgggcccggtctcatctgctctcctctacccccagtgtgtgcatacaccttctgaccaggnccaaactgtaccggtcaaagctgccaagatggaatacgaanttcaaagttccnccaacccgcctcaacctggaggcgcatcacactacatggcaagctgacctgtgacttcaaagattaaatgtgtggcctttgtactgaaatcaagccagccaatgtgcccccacataaaggcacgctgcctttgctccctttga

SEQ ID NO: 632139 - DNA, 224 bp, Homo sapiens
aaggatcccgctcgtaatagcgggcatggggctcacgctgtatcagcacttggaggcagagtgcaatcaagtcaggattctgacagcggcatgtgacggcactgtatctcagctatcggagctgaggcaaaagaattgttgaaccccgggaggcagagggttggcagtggagcccgagatcgtgccattgcactccaggcctacaagtttcgaatcacatcagt

SEQ ID NO: 632140 - DNA, 492 bp, Homo sapiens
cgagtttctggtgcttgtaatcgggtcgtgtttcgagatttacttgatggcggttctcagcctcgggcttgtggtgtcgatcgtggaggagaggctcggctgggatgccattcgtgttgggtcgggtataatggcgggcgggagattgtccgggtgggcgctgtcgggtctgttcgtgttggtatcgggcgcgatcgcgagggatctgcagagaatgatggacagtctggatttgtctttagagtcaacgacatcgacggtgatgatggtagcgacgggggttaaagataaagtggggttaatctttttgtttgggatagttgtggtttggagttacattgttaccacagttttttactgcgagtgtagaaagcgacacgtaggtaggggtgaagatgagagcgttacagtttagaaatgtaatgttttttcaattctttttaagccaatggaacattttgttgctttcaatgataaaaaaaaagtcgacgc

SEQ ID NO: 632141 - DNA, 223 bp, Homo sapiens
gagaaaatgaccagtgccttcagtcgcagcaatcaccttgggagactgtacagtaacattattcagtgagagatcagaagaacaaatggcatcttttcagaacgctgtcaactgttccacacccaagtctgttttccagttgcacagtcttggatactctgaacattctctcagagttaaggctcaggttagtgatgctccaaccagagcttataactcacat

SEQ ID NO: 632142 - DNA, 103 bp, Homo sapiens
gcgtcgacggggaggtggtccttgagcccaggaggtcaagcctgccatgagtcaagatcatgtcactgcactccagcgtggctgacagagtgagcccgtctcc

SEQ ID NO: 632143 - DNA, 200 bp, Homo sapiens
tcgataagggccaagcatagtggggtatctaatcccagttgggtcttagctattgtgtgttcagatatgttaaatgccactttcgtagtctatttgtgtcaactggagttttttacaactcaggtgagttgtagctttgttggggaggaggtgatctaaaacaccctttacgccggcttctattgacttggcttatcgag

SEQ ID NO: 632144 - DNA, 188 bp, Homo sapiens
tgtcggacttactctcctacctaagtgcgtgcggacacccgatggaagattcgatggacatggacatgaccccgctcagaggccgcagaactatctattcggtggtgaactaaaggccgacaaggatgatcgcattgaggtggataatgatgaaaatgagcaccagatgatctctgaagaagcggaca

SEQ ID NO: 632145 - DNA, 237 bp, Homo sapiens
catagctgactctagaggatacacccaccgccagtgagactggaagcatgactggagacgccttaggaatcaaaacgcaagctgaagggcacgcagcacttcttacatgcctgcagaaggaggaagagagagcagatggaggtcccacacacttttaaacacgaagatcacatgagagctcactatcatgagaacagcaaggggtaaatctgcccccatgatccaatcacctcccac

SEQ ID NO: 632146 - DNA, 667 bp, Homo sapiens
  misc_feature (106)..(107): n is a, c, g, or t
  misc_feature (122)..(122): n is a, c, g, or t
gaggtggcagagctaggatttgaacccagacaatctgacttcatgattttgcatccaattcgtgtctgtgccttttaaagggtgaggtctgtgtcactttgggtgnngagggggagcatggngggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagccacaa

SEQ ID NO: 632147 - DNA, 630 bp, Homo sapiens
gatgccacctactattggattcgactcccactactaggtatctacccagaggaaaagaagtcattatacaaaaaagatactggcaaaggcaggtccatagcagcacaattggcaatggcaaaaatatggaacggcccacatgcacatcaatcaaggagtaaagaaaatacggtatatgtataccagggaatactactcagccataaaaagatcagccagcggatcttggacaaagcaaccaaaaccatagggggggggacgcacaccctatccaaaaaagggggcggggataattagcaagccacatgtagaagaaggaaacgggatcttcctctttcaccttatgcaaaaatcaactccagcaacatccaggaaccgggagggaatgggagactattattctaagtgaaatatttaggattggaaaaccaaacatggtatgtcctcactcatatgtgtgagctaagctatgaggacaccaaggcataagaatgatacatcagtcttgggggactcagggaaaagggtcggggagggtgatggatacgagactacacacggggtacaggctacactactcaggtgatggtggcccagagtccagcaatcataataagagaattgtcatgt

SEQ ID NO: 632148 - DNA, 820 bp, Homo sapiens
  misc_feature (634)..(634): n is a, c, g, or t
  misc_feature (711)..(711): n is a, c, g, or t
gcgtgaaacttggtggaagacgcgttgaccagtcgtgtggaatcgaaagacagcggggtaccctgcgcctatgtcggacgactgatcggtgaagtaatctcccgaatgggatgaaggaggagcgtgatcaggcagctgtttgccgccttcggcagcgactgacgagacgtgcgagcctgaagttcaccaaagatggcaagttggccgcgaagttaggttttatggggttcaggagtccgaggaagaggcccagaaggcacagaagcatttcagcaagagcttcatcgacacatcccggatcacagtggagttctgcaagtcattcggggacccggccaaagccagagcctggagcaaacgtgcccagaaaccaagccaggcccaagcaggctccaaaagactctactactccagaaattaggaaagatgagaacgaggaaaaaggtggcaggtcaactggagaagctgaaggaggatacagagttccaggagttgtctgtcagttcatcagaggcgggcgtcaggcgagccacttgggcgaagtgatggccgtggatgctgagccctcgaaagggaagagcaagccggcagtgactacctgaagttcgactcccgatactgggcggagagtgangaggagggagccgggggaggcctggaagaagaggcaagcctagaagcaagcagtgtgaaaaggggcggggacatggntaccgaaaccacagggaggcggcgccctcccgggaaaagaagagaaacggcagggaaggcgggcccgaaaagaccgacactagagaacgggggcacaagcgcggaaccc

SEQ ID NO: 632149 - DNA, 216 bp, Homo sapiens
  misc_feature (43)..(43): n is a, c, g, or t
  misc_feature (76)..(76): n is a, c, g, or t
  misc_feature (124)..(124): n is a, c, g, or t
  misc_feature (151)..(151): n is a, c, g, or t
ttggatttagggtccttttggtctgtcctgcgggacacacacntaagaccatggaaacttctcccagaggacagcntgagggtaaagtataaattgctctgggaaggagagagggagagaacangctgtgtctgcagttcatgttgtgtgnagttagaagtcattcttgtctgtagtaaggtgcaataggtagggttttgccttgttttgtaagtc

SEQ ID NO: 632150 - DNA, 584 bp, Homo sapiens
cggagtctcgctctttttgcccaggctggtgtgcagtggtgcagtcttggctcactgcaacctctgcctcctgcgttcaagtgattctcttgcctcagcctcccaagtagctgggattacaggcacctgccaccacgcccagctaattttgtatttttagtagagatggggtttcaccatgttggccaggcggtcctgaactcctgacctcaggcgatccgcctgcctcggcctcccaaagtgctgggatcacaggcatgagctattgtgcccactcagaacaatatattcataaaaataaatacatattataaactggcaattccatttctcagtttatcctagataaaaagttgcactgcagcaatttttaagataaaaattggaaacaatttaaacattcatcagaaagaaatatatatattccatagtataatctccacactatggaatattatgtgatatgatttgtcactgtgctccacccaaatctcatctcaaattgtaatccccacatgctgggggaggggcctggtgggaggtgactgaatcatggggggcagacttctcccttgctgttcttg

SEQ ID NO: 632151 - DNA, 1141 bp, Homo sapiens
tctcttgaaaaaaaacatgtcataaattttaaagtggttaggtccccatttacagcattccgtgaattcaacaagcagaacaccaaagggagttcaaataattccaattaaacattctcatttaaataagtggcgcttatattgtgatataaagaaattgtgcctttcttgtggtattacacaccgtggaatgtgttatatattctcccatatgtgttattttacaccaggggtttacaaaaatgtgtcctcctcatttataaaaggtattaccccccaaaggagataactcgtacaaaacaaacaagagggtttctgagaaattatacaaacaaacacaaacaaaaacacacaaacaagacaaaaacacacaaccacacacaacacaaagcaaaacaacaagaacaagcacacaaacgaacgagaccagacaaaaacaaccaaaaaccacacaccgcaccaaccaacagaaagcccaaaaacaaaacacccggaaaacagaagggagaagcagagcagagaaggtaccacaaaacagagcagcgcgggcagagacgacacgaagggggcgcagcaagacaagagagcagaacgaaaaaagaacgaacgcacgacggcgagaggaagagagagagaaagaggagcaagaacgagacggacagggagaaagacaggagaagaaatacaagaaggagagaaggaaggcgaggagagggagaagaagcacgaaacgaggagacggaggagaccaaaagcgcagaacaacaaggaagaaagagcaaagcaaagaaagaagaaaagcagaacgagaacgaacaaggaagcgagagagatgaggacgcccgagagaggacaaaagaagagacgcaggagaaagaagaaaaaaaggcaagacaacggacagcagagagaacgaggagaggcaacggggtatgcagcacgaacgagagaaaggacgcggcactcgcacggaagcgagaaaaaaaagaagacagaagagagaaggaaaaaaaaacgagaaagaaacgcagaggagacgaacagaaacaacagcacgaaaagagagagatgggaaacaagaagacaaacaaaacccagaacaagaagcaagcaaaaaaccgcgaggaaggacggagagacg

SEQ ID NO: 632152 - DNA, 153 bp, Homo sapiens
acagtcagctcgggcccgaaatcctaattacggtcatatggttatgagttatacagtatatagacttttatagattttctttctttttttttttggcaccacactcacagcaggcagaagttcggggggccaggaatctaatctggggccaca

SEQ ID NO: 632153 - DNA, 275 bp, Homo sapiens
  misc_feature (193)..(193): n is a, c, g, or t
  misc_feature (208)..(208): n is a, c, g, or t
  misc_feature (261)..(261): n is a, c, g, or t
ctctagaggatcccccaacgcatgtgccgctcccaacgcatgtgccgctcccaaccatgtgccgctcccaacgcatgtgccgctcccaacgcatgtgccgctcccaacgcatgtgccgctcccaacgcatgtgccgctcccaacgcatgtgccgctcccaacgcatgtgccgctcccaacgcatgtgccgctnccagccaggcccatnagattattactatatccacaaaatgattaatcaatcattaaatgggccatttncaccttgaatttca

SEQ ID NO: 632154 - DNA, 919 bp, Homo sapiens
  misc_feature (10)..(10): n is a, c, g, or t
  misc_feature (71)..(71): n is a, c, g, or t
  misc_feature (76)..(76): n is a, c, g, or t
  misc_feature (80)..(80): n is a, c, g, or t
  misc_feature (83)..(83): n is a, c, g, or t
  misc_feature (113)..(113): n is a, c, g, or t
  misc_feature (120)..(121): n is a, c, g, or t
  misc_feature (131)..(131): n is a, c, g, or t
  misc_feature (136)..(136): n is a, c, g, or t
  misc_feature (140)..(140): n is a, c, g, or t
  misc_feature (143)..(144): n is a, c, g, or t
  misc_feature (151)..(151): n is a, c, g, or t
  misc_feature (157)..(157): n is a, c, g, or t
  misc_feature (162)..(162): n is a, c, g, or t
  misc_feature (165)..(165): n is a, c, g, or t
  misc_feature (188)..(188): n is a, c, g, or t
  misc_feature (202)..(202): n is a, c, g, or t
  misc_feature (207)..(207): n is a, c, g, or t
  misc_feature (224)..(225): n is a, c, g, or t
  misc_feature (233)..(233): n is a, c, g, or t
  misc_feature (235)..(236): n is a, c, g, or t
  misc_feature (248)..(249): n is a, c, g, or t
  misc_feature (271)..(271): n is a, c, g, or t
  misc_feature (283)..(283): n is a, c, g, or t
  misc_feature (290)..(290): n is a, c, g, or t
  misc_feature (300)..(300): n is a, c, g, or t
  misc_feature (313)..(313): n is a, c, g, or t
  misc_feature (320)..(320): n is a, c, g, or t
  misc_feature (323)..(324): n is a, c, g, or t
  misc_feature (347)..(347): n is a, c, g, or t
  misc_feature (356)..(357): n is a, c, g, or t
  misc_feature (366)..(367): n is a, c, g, or t
  misc_feature (369)..(369): n is a, c, g, or t
  misc_feature (374)..(377): n is a, c, g, or t
  misc_feature (382)..(382): n is a, c, g, or t
  misc_feature (384)..(384): n is a, c, g, or t
  misc_feature (392)..(392): n is a, c, g, or t
  misc_feature (399)..(399): n is a, c, g, or t
  misc_feature (414)..(414): n is a, c, g, or t
  misc_feature (416)..(416): n is a, c, g, or t
  misc_feature (418)..(418): n is a, c, g, or t
  misc_feature (424)..(424): n is a, c, g, or t
  misc_feature (426)..(426): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (440)..(440): n is a, c, g, or t
  misc_feature (444)..(444): n is a, c, g, or t
  misc_feature (446)..(446): n is a, c, g, or t
  misc_feature (463)..(463): n is a, c, g, or t
  misc_feature (475)..(475): n is a, c, g, or t
  misc_feature (492)..(492): n is a, c, g, or t
  misc_feature (502)..(502): n is a, c, g, or t
  misc_feature (510)..(510): n is a, c, g, or t
  misc_feature (517)..(517): n is a, c, g, or t
  misc_feature (538)..(538): n is a, c, g, or t
  misc_feature (541)..(541): n is a, c, g, or t
  misc_feature (549)..(549): n is a, c, g, or t
  misc_feature (551)..(552): n is a, c, g, or t
  misc_feature (554)..(554): n is a, c, g, or t
  misc_feature (559)..(560): n is a, c, g, or t
  misc_feature (564)..(564): n is a, c, g, or t
  misc_feature (570)..(571): n is a, c, g, or t
  misc_feature (576)..(576): n is a, c, g, or t
  misc_feature (578)..(578): n is a, c, g, or t
  misc_feature (881)..(881): n is a, c, g, or t
ggggtgaggngagggtgttgggatggtgggtgggtgggtaggattgagtgaagaggagggtattgggaggngtggntgtnggnatgaggtgattgataggaaggggatctagntagggannaggggaatgntgggnatgnatnnatggttntgtttntatanaanttgatgatgtgagatattggagntgtgaaagaggaanagtanagaaatgtgggagtgannttgggtgntnnattgagatggtnnaggggtttagagtgtgaagagngaaggggaaaanaggaggngaagtgtggngtggggataattnaagatgnagnnaaatgtggaactaaggtgggttnagtggggannagggaaggnntnatggnnnnagtgnanaattgtgncccaacnccgggaatgaaactnangnatatgngnaaangnanatgaanaaananacaaaaacacacagagnaaataacattantgaaagaacctggaggntattaaatanaaaatggnagttttntttcaaagtgaaaatatttgnttntttgatantnntnagtgnnttgnagtgtnncaatnanagaagagtagatatgggaagggccaagaggagtatgttgcgagtggccctacaagtccatgtgtgctgaagtccctatagcaaccaccttactcttcagcccagtagctgcctcccatgtgaccattcacccgattggcaccattgctggagctactgtcacagggactttttgtgcaggtggtcacatcttcttcctctgagctgctctccacatcactgcgatcatccttcgataccagaatggatagattcctagtcgtgtaaccataaaaacagcactgaagatcacaaaaagggtgtnacagagccgctgatacttggcataattggccagtttgg

SEQ ID NO: 632155 - DNA, 349 bp, Homo sapiens
  misc_feature (47)..(47): n is a, c, g, or t
ttacccattatatgatatacttaatctagcactaaaccaagtgtttngcacctaattaaaaagggccaggcatggtggctcatgcctataatcccagtgctttgggaggttgaggcaggaggatcaattgagcccaggagttcaagaccagcctgggcaacatagcaagacccctcatctctacaaaaaatttaaaaattagctggacatggtggtttgtgcttgtagttccagctactcgggaggctgaggtaggaggattacttgagaccaggagtttaaggctgcattgagttgtgattgcaccactgcactccagcctgggtgacagagcaagactctgtctcca

SEQ ID NO: 632156 - DNA, 564 bp, Homo sapiens
ctttatggtaccattgaggttacagttatgtggcgtgctcttagtgtatttcaggaaaaagctgatggactaagaccgagcttacagacgtgggtttctacactgagcgcaagggctgactacgctgtatttcacaaccgagccctagcgccagctcagcaccctacgctcaggaagcggattttgcacacacactactgcattcatacagagttcactgaagtctattaccaagtgtcttttatgaataaacaagtacaaagtccaatttggatggctgctataaaatacttaggaatctctgcaatactttactacaaatacaaatgcccaagaggtcagggaaatcagcctgaagaactgggtacaggttctattctttgtggaaatttcagcctaggaatgttattcccggtacagatgtacacagtcaaaaaggcttatcgagctgtttgacgagttcttgaagtgttctggatcagtgatctgcctgtgaactttagttcacgctgaagacagtcttctcagttttcatgactgtgaagtgtgaaaatggaacgcatc

SEQ ID NO: 632157 - DNA, 189 bp, Homo sapiens
cactctaaggaccctctgctcctcttcatctgagggatgacagaaattacacaggctcatagatctgtacactctaccttcctgtggcagtgatatgggattcattatgaatcatttgtttacaattgacgtccactgtggcattggaaagaccagtggggtctgactacaagtttaaacattttcttt

SEQ ID NO: 632158 - DNA, 225 bp, Homo sapiens
ttgaaattgactttgtccccccaaaaacgtgtgccccctttggggaaaaacttcgtcccaaccaaaaggacaaaatgtgggttattctggaaacccccgtttcccaaatttttttgcatattcatttgcccaattttgttttggttggacaagcgtgtgggcttcaatgttaggctttttatatgtatatcctgttatcaataaaaccattatcccagtggttta

SEQ ID NO: 632159 - DNA, 610 bp, Homo sapiens
  misc_feature (177)..(177): n is a, c, g, or t
gcccagtgaatggttccaagccacgaggcacacctgggtgtgtgaacacagtttgttagccccgcgttaacactaagctgggaggttttctttggcgcccaattggttgtttcccccctcgctgagatttctgtgggtgaattctgctgtttgagataataagagaaataaggtatncacacgcggctgttcttctggtcctcccagagaacttggaatttaaaggtgtatggaagggaactgtttgcccgcgatcactcactgaattgggaaccccgagctgcacactaccacgctgggttatctatgaactccgctgaaggttctaacttcacgaactttcctcggccctccctcccaaccccgcagatgccacgagttcttctgaagaaagagaggctctgtggtgtataactccacgctagttagatccaagcccaatgtggactgaattctgcttgttgatccgtgttgaagaaagtgccaaagggacttttatatatttgaccgctgtagggaattgtctattcctgatataattaccgtagtgactcttgcttaaggccagagtttcagatttactgtttggaataaaccccacttcttcatg

SEQ ID NO: 632160 - DNA, 101 bp, Homo sapiens
gcacgcaggatgccaagaagtcctagagcgcccggagcccccccccggcctccggaagatcagggatcaggaggggagaagaaggagcctctgctgcctcc

SEQ ID NO: 632161 - DNA, 754 bp, Homo sapiens
  misc_feature (279)..(279): n is a, c, g, or t
tgtgcccttgtcaggagggtggtgtttgtcggtcgcccttcccggtgttggtcccctcttggggaaaacacccgttgtcttggcgcggtatgttccccacaggaggtagatttccccccccttggggggcgcgctctttatctgtcccgatcggggtggcgccctctatttttctcggtgttgcacgaccacagcgcggcatgctcatcgttgccgcgacacgcgcgtgctgatccgcaagtgtctccgcacattgaagagtaaggttccactatcacnctcagtcacatccacagtgagaggtggggcccaaatagagtttgttcctttttaccctctccacaccccagctgcccctctgctgttgtgtaggtgtcgcccgtcccacccgctcatatagggctgtggcggagttagtgcattgtacccagcacactagtagaggtgtgtgtcaccgctcagatgtggcctctcagtgacgacgtctcacacaaatagtctgtcaccccacacacagaggagagcgaatacgccgcgcacactgtgtgtcacctgacacagtaaagataaggagggcagggggcaatagtgaggatcctgcgttcacaccacgtttcacggacacctaatggtgcttgggagagactgaagtctctcttataaagggcaattgttcatttatcttctacggggagcacccctcgatagagtggtgagacactctcttctgtccccatcaatagtacagaacaaa

SEQ ID NO: 632162 - DNA, 942 bp, Homo sapiens
  misc_feature (680)..(680): n is a, c, g, or t
ggcgctcgggggcggaacgcggggatcatggaagctgataaagatgacacacaacaaatcttaaggagcatcgccagatgaattataaacgatgaccaaaatagggacctaattgatgaaattacaacaggaaaaatattcagctaaggaaggagatccaaaagcttgaaacggaagtacaaggaggctaccaagagatccagatacagaggattatcctgaaacaaagaggatgaacttctcaatcagtggaaacctcccgtgagaatgacagccagttgggtcaaaattattctcctgtccggatccaaggtgaagctcgaaaagttcctttatgagatacacaaaagggaccagcactttatccactcttggaaaagcgaaggaaggtgggctccacaactggtggtcagggcattgcagtaaccttccatggtacaggattaaagattgtaaattctggaggtacgggcccaagccagttcccattaacaattcaggagtccagcatccaggtcacattgtacgaaagttctaaaacttgaacaatccaattgttactggaaatgcctgaacacgtggggtggagactcaaatgaaagaacaactaagagtgaagctttaaaagtcccgaatctggaggcggcgaggtgaaccgcgtggactaatgacggacagtncgggaggtgaggccatcagttggtggcatggagtgctgcacaacattttggacagaacgataccctctttattaaatcacactggccatgaggttctggtccataccggattcctgacagtatcgatttcggaactcaaaggcgggctcgggagggcgccagggtgagcatgtgggtaaacacccttcggcaatggggcgcagtgcgttcagcactcactgatgtgatataatccgcgggaattcacaacctctctatcttt

SEQ ID NO: 632163 - DNA, 883 bp, Homo sapiens
  misc_feature (1)..(1): n is a, c, g, or t
  misc_feature (56)..(56): n is a, c, g, or t
naatgtcaggctggtactggtcctggagttatggatactcgctcgccttcatgcangacatgtacctcctaaatggctctactttgaaccttgctgggcaaggaatgagattttcaatgtgaaagccatctacctgtgtgcaagctcctgccggccaaccccagaccccagcactggagccagtgcgcctgtgcccgccgaccctcagcatcctcctcagaaatggctggtgagcatcagtgaagcccctgtgccatgcctccacctgagcctcagtgatgctcatgctttaatgtgatggagtcatgtgcacgggtgtgtcctcaacccctccagtgacccattgctgccctagggtgatgccagacactggtgcctggcagtttcctccctaggtgaagcttcagtgctgctcccatgttggagcccagagcccactgttgggtgaccctgtcatgcctggcttgcagcaggggactggctctccagacataggccccactgggacagctgagtggtagctttatatgatccccaaccggggacagcgggatctgacagtccctcctccagtgtggcttgcagagaactttaccctgcgaggagggctcggaatggctgtgccaagccccaatgtacttgagggtcgccacgcacagacttgaccctgagacatgccatggtccctgaaaggtcaacaccaccaaggatgtacggcgagtcaacgcggacggtgggatgacggcatccttgacttcctgcaggaaccaacagccccccaagaatgctcgaccaattgatgccctgcttggcccaacgactcctggccccccagtaagccttctcacgcttgccccaggaggctcctgcccacctgcgtcga

SEQ ID NO: 632164 - DNA, 594 bp, Homo sapiens
  misc_feature (3)..(3): n is a, c, g, or t
  misc_feature (71)..(71): n is a, c, g, or t
  misc_feature (74)..(74): n is a, c, g, or t
  misc_feature (93)..(93): n is a, c, g, or t
  misc_feature (113)..(113): n is a, c, g, or t
  misc_feature (121)..(121): n is a, c, g, or t
  misc_feature (124)..(124): n is a, c, g, or t
  misc_feature (132)..(132): n is a, c, g, or t
  misc_feature (134)..(135): n is a, c, g, or t
  misc_feature (137)..(137): n is a, c, g, or t
  misc_feature (139)..(139): n is a, c, g, or t
  misc_feature (141)..(145): n is a, c, g, or t
  misc_feature (148)..(149): n is a, c, g, or t
  misc_feature (151)..(151): n is a, c, g, or t
  misc_feature (154)..(154): n is a, c, g, or t
  misc_feature (159)..(163): n is a, c, g, or t
  misc_feature (169)..(169): n is a, c, g, or t
  misc_feature (174)..(175): n is a, c, g, or t
  misc_feature (183)..(183): n is a, c, g, or t
  misc_feature (198)..(198): n is a, c, g, or t
  misc_feature (200)..(200): n is a, c, g, or t
  misc_feature (207)..(207): n is a, c, g, or t
  misc_feature (214)..(215): n is a, c, g, or t
  misc_feature (229)..(229): n is a, c, g, or t
  misc_feature (238)..(238): n is a, c, g, or t
  misc_feature (245)..(245): n is a, c, g, or t
  misc_feature (266)..(266): n is a, c, g, or t
  misc_feature (272)..(272): n is a, c, g, or t
  misc_feature (274)..(274): n is a, c, g, or t
  misc_feature (278)..(278): n is a, c, g, or t
  misc_feature (281)..(281): n is a, c, g, or t
  misc_feature (287)..(287): n is a, c, g, or t
  misc_feature (289)..(290): n is a, c, g, or t
  misc_feature (297)..(297): n is a, c, g, or t
  misc_feature (301)..(302): n is a, c, g, or t
  misc_feature (307)..(307): n is a, c, g, or t
  misc_feature (310)..(310): n is a, c, g, or t
  misc_feature (312)..(312): n is a, c, g, or t
  misc_feature (318)..(318): n is a, c, g, or t
  misc_feature (323)..(324): n is a, c, g, or t
  misc_feature (346)..(346): n is a, c, g, or t
  misc_feature (359)..(360): n is a, c, g, or t
  misc_feature (379)..(379): n is a, c, g, or t
  misc_feature (396)..(396): n is a, c, g, or t
  misc_feature (407)..(407): n is a, c, g, or t
  misc_feature (415)..(415): n is a, c, g, or t
  misc_feature (449)..(449): n is a, c, g, or t
  misc_feature (491)..(491): n is a, c, g, or t
  misc_feature (495)..(495): n is a, c, g, or t
  misc_feature (499)..(499): n is a, c, g, or t
  misc_feature (521)..(521): n is a, c, g, or t
  misc_feature (541)..(541): n is a, c, g, or t
ctnttcaatcatggtgagagtttgtatgattaataagatgctgctttttcatgaaatgcttggcggtgaanganttcttagcctgtgagatgngaccatcccattaactttgncgtttctnttnattaatanannangncnnnnnatnntnaanaaaannnnnaagatnttaanntttttatnataattatttaaatntnaggtaantttaatnnatttattaattttnttttttttnttttttnattttttatattttatttttnattttngntttnttngttganannggttggnagtnnttagnggntntgagangagtnntggttgttgaaaagatagaggnggagaagagttgnnggatgggttgattatttgntagagaattgatagttngtgtttttaanagtttganttaaaagtttaatgtgaaaagaaattgtactganaggtaaaggaggaaatggtgatgaagtggggttatgtgagantgtntatntttttataagataggtgcagantgtttgtgttagttataggnttaggtaaagtatgttgtggttggtgggttgtgcagggatctctcccaccact

SEQ ID NO: 632165 - DNA, 287 bp, Homo sapiens
ggagttcctttgtcttaaaatctcctgatgactaaaacttaacaccaactggtcttcatttaccaatggtcttctccttaccattagagcactcagtaactgtacaaactgtgtgagcgtgtgtttgtttggctgaactgtttttattggtggcttctgtttttatggtttcagtctttttcccacttgggtagatcaactctacctgacttggtcaaatccgagggaacgttccaaattatagggaaacaaggcctctgaatgggctaaattcccatagctggggg

SEQ ID NO: 632166 - DNA, 363 bp, Homo sapiens
tctgtctggagatcaccacctggactggttcctcggcccatctccctgtggaagtctacgtatcagtgtgtgttatttcgcaaagttcactttgatgtgacgaacagtgactgatattcaggtgccccgatggatgggggcggctggactgggcagacttagatgctgtccattgctttgaactcgcgtgagggctgcaccgggttcacgtgcttcttctgagatgcccgtttaatcgttggtctgtgtctcgatcctgtttctctctcttcaccaatggcttaactctggtgccttcatcttccatgacacagcaggaaggttgagggaagccataccctgtgactttaggtatttggtaga

SEQ ID NO: 632167 - DNA, 214 bp, Homo sapiens
tagtctgggtgatgaggaactagtgtaggagtatcggggtaattatagtaacaacaacatattaggatactagtatcagagatcaggtcgtccttcagtgttgtgtatggctatcatttgttttgaggttagtttgattcgtcattgttgggtggtgattagtcggtagttgctgagatatttggaggtggggatcaatctagaaggaaaataa

SEQ ID NO: 632168 - DNA, 178 bp, Homo sapiens
acgaataacactccccacttcacattttacagtataagaaaagcctacggggtatcaggctataccaccatgataactttgaagaaacaataaactgtagaccctaacagtgtgatatttgggggttcctgtggtaatgtacttttctgtttaattaccgtactttttacaggcacgg

SEQ ID NO: 632169 - DNA, 1498 bp, Homo sapiens
taggtttgagggggaatgctggaaatggtaaggggtatggagacatgtcatataagtaatggctagggtgaggtggtaggaagttttttctcataggagggtgtatgagttgtggctcgtagcggaactcgggggtatgcgtgtctcgaattctcataaaaacgaggggaggtttaaaagttagggctctggggtgacaaaatagtgttgtggtggtagaagttctcagggggaagaaggtgcgctccaatatgtgtgtgtggtccccataggaaagaactgggtaggtgggtgagaggggtggttctacttataactacagtggttgaggtgttattctcgggcttaatgaaaagaaactagtgtgcgcagacagtgtgtgcgcccttggcgagagcggagataattctccagaattgtgtaagaaacccccatagagagcatctttaagttctcgagaggaactctccccccttttcgagggcaaaagtgggctccagaagtggtgggggtgtctccggcgattgtgagctcactcgtgggcgccatagagatgtggtggggcagaaacattacagaacactccaaaatatcatataaggtggggcgccccaaaaggcgggggtgcctcctacggatggaaaacgatggggcgccgacggggagaagacaataaacacttccacggagaaggacggcgtggagatccccccgatggaggctgacgatggcaggcgggacgaacaacataaacgaagagggggtggtgcggatgcagcagaagggggagatctccacacacgagaggagggaacgacccccaccaccataataataatattattaacggcgtacaaatgcttggtgtatgacggcacacatcacggtctctactagcaacatacgtggtatatgtgggggccccataaagggcgagggagtggcagcacctatctccacagataatgcttgtcaacagacaaactatgcgggcttagggtggggagaccatacacaagtggggctacctcgcacaaagatggtgtgtcctccccccggaacataccaacggggggagagcggataaaaacttactggcagcgacaagacatcaagatggcaacgagagtctaacaccaataccccccgctgagagaaattcccaacgaagaaggagaacaactatcgcgcagggcatacaaccaccacagggggcgcataaggcgggccccaacataagaaaggagggctggcgcgcgccctaacagcgaacatactattaacaaacactaatatgaggagagagcgcccccccaaccaggaacgataagagcaagagacggagtactggaacaccccaccggggggggaggcaatcagggggggacacatatgtgaggacgaccaaagcagcgggagagagggccaccacacaccagcgcgagtacgcaacaacagagacagcggccgccagatcgacgctgggcgaccgacaggc

SEQ ID NO: 632170 - DNA, 238 bp, Homo sapiens
gctgtcccaagagaaacaaacaaacaattaccaggcttggtggccgcacctgtagtcccagctactggggagagggagtggcaagggtctaggatgcaaggatcatttgagcccgggaagtcgaggctatagtgagccatgttttatgccactgcactctagcctgggtgacagactgagatccagtctcaaaaaaataaaacaaaataagacaaatcaattcacagacaacatttac

SEQ ID NO: 632171 - DNA, 212 bp, Homo sapiens
tatcacattgtgtacggaaaactcaaggtgttagtaagaagtaccctataggtagtcaccacggtggtaaaggaagatagttgtagcaggatacaggcccctactcttgcttcactagtatacataccagcagcagcttcacttttactctagggcttctagcacagttttcactacaaagggcttcatggtccacataagcctttgggaaa

SEQ ID NO: 632172 - DNA, 620 bp, Homo sapiens
  misc_feature (11)..(11): n is a, c, g, or t
  misc_feature (74)..(74): n is a, c, g, or t
  misc_feature (91)..(91): n is a, c, g, or t
  misc_feature (99)..(99): n is a, c, g, or t
  misc_feature (160)..(160): n is a, c, g, or t
  misc_feature (286)..(286): n is a, c, g, or t
  misc_feature (319)..(319): n is a, c, g, or t
  misc_feature (340)..(341): n is a, c, g, or t
  misc_feature (402)..(402): n is a, c, g, or t
  misc_feature (451)..(451): n is a, c, g, or t
  misc_feature (475)..(475): n is a, c, g, or t
  misc_feature (483)..(483): n is a, c, g, or t
  misc_feature (530)..(530): n is a, c, g, or t
  misc_feature (539)..(539): n is a, c, g, or t
  misc_feature (582)..(582): n is a, c, g, or t
gtgtttgggtnaaatcgttttccttaccaactctatacagattgtgtatttaaatatgactaatttggtaaggntctatttcttaacaggnagcatggnaaaatttcaaaatgacaagccaatgctaaacatgtaccacttaaccaaaaatatttagttntacgacagctagctagaacacccaagtccttctgaccaagccaattcaggtacttgaacaacagccaaataaataagcaccattctaatcaataggttcaaatgaaaacagaatgttttgataatnttttgggtttaacacataacacacaaaattttnaaaagtggtttggctggtaannatagtgggctttttaaacgttttattgggtgggtgtggggggtcgcgcctgtgatcccggngctttggggttaccggcggggaccccccccccccggggcccctcctgcntctttacaaataggcatctggggntaagagtnaccatttgggattttaggtgaacggctgggtaagacactactcttgnttttgggcngggggggatgtctacacatggtcttggttttggtcaaactttnaatttcggggggatggggatttgttttcttttcattgc

SEQ ID NO: 632173 - DNA, 916 bp, Homo sapiens
  misc_feature (730)..(730): n is a, c, g, or t
cagtgagatgcttaaatctgcagtggagggcaagagacacgaccccaggagacagcaactggtctctgaggcggtggaaccagctccctgttggagtctgaggccttggtcctactcccagtttcactcctggtttgctgaatgatctggagatctctgggccccacggctttccatctgcagagcggaaagagtggatgggaagtttctaggttccctccacttctcatcattgccggcattcgcttataacaggggtcggactcctctctgtgcacctgtcctgcgggcagacctaggaaggatgccaggaccatgcccggtagagggctcagttggagtttcagggatgagcacctgcctcgggggcctgaaggaagcccatggaaggccatggccaaagaagctcatcgccctggggccagaagaatctgcccatcagatggtcctgtggaggatccaggagctttctgactgagtatggagggaggaccagcaagaccccttcatactggctgacctggacatactggccagccgccatcaggccttctgccaagccctgccacaggtctcgcccttctatgcagtgaagtgcaacagtagcccttgggtgctgcgtgtcctggccgccctgggcaccggctttgactgtgccagccaggtggaactggagcaggtgctgggcctgcgtgtggccccctcgcgcatcgtctatgccaacccctgnaaacctgcctcccacatccggtatgctgcccagcacggggtgcagtcctgacctttgacagcgaggaggagctcaccaaggtggcccagaccacccaggccaggacagtcagagcacctttcctctgagcacaagttcggggccaggctggaagctgttgggacctggtcacgtctgcaaaaactg

SEQ ID NO: 632174 - DNA, 556 bp, Homo sapiens
  misc_feature (539)..(539): n is a, c, g, or t
gtttatcgtctcttcggttcggttgccactgttgctctgtctcgctgttcttgtggtctggtcgtcccctctttctgattcctttggcttcctccccccgtaccgtgttctccatccccggtgttattctcaccatttccgctgtagttcgtctgagcgctccccgtttgtctctccggatcccattggttccggtttcttggggtttcccttggtttcgtaccatccctcttcatgaaccctgtctgcctgtggcttcatagcattcgcctactccgtgaagtctacgggacatggaagatggttggcgacgtgaccggggcccatggcctatgcctccaccgctcaagtgctctgaacatctgggtccctgattctgggcatcctcagtgaccattctgctcatcgtcatctccagtgctgatcttccaggcctatggatagatcaggaggcatcactgaggccacgagctctgcccatgacctgtatccaccgtactccaacttccattcctcgcctgcccccgagcatactcgangggggccccctcttatt

SEQ ID NO: 632175 - DNA, 879 bp, Homo sapiens
  misc_feature (876)..(877): n is a, c, g, or t
gttttttcccttcggtgtgccactgaagatcctggtgtcgccatgggccgccgcccgccgtttgtaccgtatgtaagaacaagccgtacccaaagtctcgcttctgccgaggtgtccactgatgccaagattcgcatttttgacctggggcggaaaaacggcaaaagtgatgagttccgctttgtgccacatggtgtcagatgaatatgagcagttgtcctctgaagccttgaggttgcccgaatttgtgccaataagtactgtaaaaagttgtggcaaagatggttccatatcggtttgcggtccacccccttcaaggtatccgatcaacaagattgttgtccttgtgctggggctgaaaaggctccaaaacaggcttgcgagggtgccttgtggaaaagccccatgggcacactgtgcccagtggttcacatttgcccaaagttaatcatgtccatccggcaccaagttgcaagacaaagggagcattgttgatgaaggccccctgcgcagggccaaagttcagtttcctgacgccagaagatccaatctcaagaagtggggttcaccaaggttcatgctgatgatttggcgacttgtgctgaaagggctcatccaagatgttgggcgtcaatgacttcccaggtgtggctctgaaaatgggggggcctgaataatggggttccagggttgggccctttatattacataattattctggcaaagaaaaacaaaaaaaatttggggccgcaagtttaaactttgtgggggccaataaattgttgtcaagaccgcagtggtccacaaccggggcgggcaaaccgttttgtttctacgtgtctcaccgccggaaaaaaagagaagaaacaaaacagnncg

SEQ ID NO: 632176 - DNA, 355 bp, Homo sapiens
gaacccctttttttgccgggccgggattcccaagctccggggggataaggcagtttttcccccacgggccctccaacccaaatcaaattaaaaggggggggttgccggcaaaaaccctttggtaggtaaaaaagaaaaaaaggcttctgttggttttaaaaaccaaaaaaaccctttggtgggaaaaaaggccccagtccccaagaaaccgccccccttaaaaaagccccgcaaaaaaaaacccttctccaggggggaagaagcccggggcataaatttttaaattttttttttccataaagggcaaatctttttgggcggcttttttttaataaagccctgtttttccgggcca

SEQ ID NO: 632177 - DNA, 545 bp, Homo sapiens
  misc_feature (461)..(461): n is a, c, g, or t
tttgttactaaatcgatctcaatgttactagttacttctaaccctaaactgatcccctcgatgtctctctgattcatccctgtcatctgattttggtttattatcatggtcacgtcttattgactcataaactgatcgctcattaggtctctgctttaaggcttcagctcgttctgattttaaccgaggtgattcatcattgagtatcttgtttatgtttatcacacttcaggttttgtctctgtagatcgcttttcagaatccctcctattgtcttgcctgtttctttgattttacaggtcgcccttcatttttttgctttggagtttcagggcggctctcacctttttgctttggagtttccaggccttccatcacccttctgttttggggtttcaggatgcccatcactcttttgttttggagtctcaggccggctttcacccttttgctttggggtntcaggccttgattttgttgtttctgatctgccattattttgtttgttgtcatttggttttgtgtcagacagtctattttcactt

SEQ ID NO: 632178 - DNA, 122 bp, Homo sapiens
tgtataacttaacacattgggctgtccaacttctgtaatatcatttttgtattgctttgttttgttttcactttctctgaaactacctcatatctctttcctcaatgaacagagtataactg

SEQ ID NO: 632179 - DNA, 439 bp, Homo sapiens
ggaatgcacgagtgtgagagagagggcacttgtctcccttcaaggctgatggaaggtaggatatgtgagtccttcctcttaagtggcaggaaacagatattattactctttatctttatttatcccctgagatactcagaacatgaggaaacacatattttactcatcattactggatttttgcgaccacccactctattccattttacacaacacctcacagacattttaacacagaaaggccaggcagcgatggctcacgccatgtcatcacagcactttgggatcacttgaggttaggagctcgtgaccaacctgaccaacatggtgaaaccccatctctactaaaaatactaaattagctgagtgtggtggcacaggcatgtaatcccagctatttgggaggctgcggcaggagaactgcttgacaccaggaggc

SEQ ID NO: 632180 - DNA, 244 bp, Homo sapiens
atgtgccctcttgcccattcaaggaccttggcttgtccttcaagtcagggctccatgggcttgtactgccgccgcccaaagctcccagcaggttgtaatagttggtggtcaggaccatggcgcccctgtccatcaggctgtagtccgactgcagaaccacaggagttccggatgtgctgctccaggtcgtcaaacacctccatcaggcagtcctggaagaagctgggcttggcatcgctgctgg

SEQ ID NO: 632181 - DNA, 320 bp, Homo sapiens
ataagcgggtgcagcactaattaagaggactataacaacgccactgtacactttgtttgacactcgtctgatgaaaagtctttcgtaacttaacattccacacttacatttaaaaagtcccagaacatataaactatccaatttacaactaaggtgggtatctgtcaaaaccttaagaatagttactcttcccaagagacttacagcgtctaaggggggggaaagacagcatctgagcagtacaagtcaagctgataaaatccaatacagaatatctaatacaccatcagttattttactgagaatagattctgctgccc

SEQ ID NO: 632182 - DNA, 381 bp, Homo sapiens
  misc_feature (11)..(11): n is a, c, g, or t
  misc_feature (135)..(135): n is a, c, g, or t
  misc_feature (176)..(176): n is a, c, g, or t
  misc_feature (179)..(179): n is a, c, g, or t
  misc_feature (183)..(183): n is a, c, g, or t
  misc_feature (190)..(190): n is a, c, g, or t
  misc_feature (194)..(194): n is a, c, g, or t
  misc_feature (217)..(217): n is a, c, g, or t
  misc_feature (247)..(247): n is a, c, g, or t
  misc_feature (270)..(270): n is a, c, g, or t
  misc_feature (299)..(299): n is a, c, g, or t
  misc_feature (302)..(302): n is a, c, g, or t
  misc_feature (309)..(309): n is a, c, g, or t
  misc_feature (322)..(322): n is a, c, g, or t
  misc_feature (330)..(330): n is a, c, g, or t
  misc_feature (338)..(338): n is a, c, g, or t
  misc_feature (350)..(350): n is a, c, g, or t
  misc_feature (373)..(373): n is a, c, g, or t
cttttcccgcnccgtcgggaggtcctcccggaattgggccggagcccaaaaaacccagtgtgaaaagggcccatgggttttaggtcccctccttcgcgctggacgcgggcagagcggggtccctttctgtttctnccaaaaaacgtggagggagggaaaagggaggatggcttgtnctnaaanaaccaanaatnaagtcgggcacccgggatttganaaatgggaaatccatggcccttgttcgggnccccaggctttgccgacggggtntttcctagttccgaaattgcccaggcccnccnccccccnctttgcaagcagngggaacgncttccccntcgcttaatttntttattaaacttttcccctattnttttttta

SEQ ID NO: 632183 - DNA, 99 bp, Homo sapiens
ctagaagattcagcaaagtacttttgtgctcttggggagccgagcccctttcctacccgtttactgggggatggcttaaccgcgtacaccgataaactc

SEQ ID NO: 632184 - DNA, 243 bp, Homo sapiens
cgatctagaggatcttccgctctcacccaccccaaccagtgcaattacttagtgcaacttaaattcagaagggacggggaacacagagtcgtggagagttttgaatctctcagcaaacaggaccaagacaggaaagctcagaaacaaagagacagaaggatgcaacagaagacgagggcggtggtggggacggcgtcatcccgctggacggcgctcagctctgggatgatgtggtggctggtg

SEQ ID NO: 632185 - DNA, 482 bp, Homo sapiens
  misc_feature (437)..(437): n is a, c, g, or t
  misc_feature (441)..(441): n is a, c, g, or t
  misc_feature (443)..(443): n is a, c, g, or t
  misc_feature (447)..(448): n is a, c, g, or t
  misc_feature (450)..(450): n is a, c, g, or t
gctgagacttactggcctgcattctcagaaagttaggcattcctaccctctaggattgaattgggacccctttcctgtaacatatttctggtgaccacagaagggactaagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccncttnantttnntnataaacttgtttttgctttgcaaaaaaaaaaa

SEQ ID NO: 632186 - DNA, 465 bp, Homo sapiens
  misc_feature (124)..(125): n is a, c, g, or t
  misc_feature (319)..(319): n is a, c, g, or t
  misc_feature (403)..(403): n is a, c, g, or t
  misc_feature (441)..(441): n is a, c, g, or t
ggatgcgagctaaattccattatttaggacataagccggaaaaaggcgacccccggcggcgttactaaatatctttcattatccgaggaccatcttctcgccacctgccccctcacgatcaacnnaggatacatcctaccgaaactttcgatactatcggaggaccaacattagaccataaataacaaaaccacgaatgaaaaaaactaacgccctcaagaaaagttctctagcataaagacgaggcgagaaagccccgatcccactctcagctagcctcaccaatatacccattcaaaaccatgaaagaaagagtccncatactgataaaacttagttatatatagattcagctgagattacacctactcccatcaccaatctagccctataaccattagcntagaaagcaataaaacccaaaaaatttaacagaagatntacaaaagatatcgacagaatcct

SEQ ID NO: 632187 - DNA, 833 bp, Homo sapiens
  misc_feature (6)..(6): n is a, c, g, or t
  misc_feature (21)..(21): n is a, c, g, or t
  misc_feature (32)..(32): n is a, c, g, or t
  misc_feature (42)..(43): n is a, c, g, or t
  misc_feature (52)..(52): n is a, c, g, or t
  misc_feature (63)..(63): n is a, c, g, or t
  misc_feature (67)..(67): n is a, c, g, or t
  misc_feature (79)..(79): n is a, c, g, or t
  misc_feature (89)..(89): n is a, c, g, or t
  misc_feature (114)..(114): n is a, c, g, or t
  misc_feature (132)..(132): n is a, c, g, or t
  misc_feature (163)..(163): n is a, c, g, or t
  misc_feature (211)..(211): n is a, c, g, or t
  misc_feature (218)..(218): n is a, c, g, or t
  misc_feature (266)..(266): n is a, c, g, or t
  misc_feature (340)..(340): n is a, c, g, or t
  misc_feature (385)..(385): n is a, c, g, or t
  misc_feature (459)..(459): n is a, c, g, or t
  misc_feature (502)..(502): n is a, c, g, or t
  misc_feature (514)..(514): n is a, c, g, or t
  misc_feature (588)..(588): n is a, c, g, or t
  misc_feature (593)..(593): n is a, c, g, or t
  misc_feature (597)..(597): n is a, c, g, or t
  misc_feature (612)..(612): n is a, c, g, or t
  misc_feature (631)..(631): n is a, c, g, or t
  misc_feature (692)..(692): n is a, c, g, or t
  misc_feature (701)..(701): n is a, c, g, or t
  misc_feature (727)..(727): n is a, c, g, or t
  misc_feature (821)..(821): n is a, c, g, or t
ctctgntcgtcctgttgctcntggggcccggnggactggtgnnttgcagaanccccacgcganagcntgcgggaggaanttgtcatcancccgctgccttccggggacgtagcngccacattccagttccgnacgcgctgggattcggagcttcagcgggaangagtgtgccattacaggctctttcccgagaagcgcgcgtggggcagcngatctcnaagtattctctacgggagcagcacctgttattcacacgaaggcttttngaggacccgatactgggggccacccttcctgcaggccccatcaggtgcagatgctgtgggtctggttccaaganactgttaatgatgtggataaatcttggaaggagctcagtaatgtnctctcagtggatcttctgcgccttttttaacttcatcgactgccaccaacacagttactcccactgcctccttnaaacccctgggtttggccaatgatactgaacactactttctgngcgatgctgtgntggcgcgggaggtggtctgcaccgaaaacctcaccccctggaagaagctcttgccctgtagttccaaggcaggnctctntgtnctgctgaaggcagancgcttgttccacaccagcnaccactcccaggcagtgcatatccgccctgtttgcagaaatgcacgctgtactagcatctnctgggagcngaggcagaccctgttagttgtatttnatgccttcatcacggggcagggaaagaaagactggtccctcttccggatgttctcccgaaccctcacggagccctgccccctggcttcagaganccgagtttatgt

SEQ ID NO: 632188 - DNA, 225 bp, Homo sapiens
acaatccctctaatacccacttaatgtcctcagaaacacagctgagggatccatcttcatatgactcctcagagacacataacatgatattaaaacactcttacccacaaaaaacgcacagacgagggattcttcaaataataggaataagcaatgtgaaataccttagaataaaccaatgcagctcttttcaacatcattatacatcctggcaaaactagtaag

SEQ ID NO: 632189 - DNA, 150 bp, Homo sapiens
cggctcacgacggtccggagatcgagagtatcctggctaacacggtaagagcctgtctctagtacagtacaaaattagctggtgtggtggtgcctgcctataatcccagctactcggaagtgcaggaaacaggacgcgggatcctctaga

SEQ ID NO: 632190 - DNA, 371 bp, Homo sapiens
gtacgcattgacgtcatcaggtcttacataaagttctgactggaatcaggtcaaaagtttattcccttccttttcaacttgcccaatcaagaagctgttcctattagaggggaaaaagaacaatcatcagagtaacacttgtgccattttaaacaagtcatgctccccaaagagcaccattccactaatgctagttttattgatgatggcaccaaaaaaaaccatcctatatacccttattcatccctttcttgagaagttggttacaaaccaagaaaataaagcctcaaggaactgtatttgaagacaaagcatcttgggattaacttgcaggtagcttcatactcttcttcagagaactaaccaggact

SEQ ID NO: 632191 - DNA, 1195 bp, Homo sapiens
tggacaagacaaaggagttttatatttattcaagcagtaaatttccaggggtaaaaagaggccacaagttaatgtggttaaaaaaaaaaataaaccatcgtgcctacccaaggggcggcattaaaggaacccaccataagaacagaaaaaagagaacagtgagaacaaccaccgggcagaacaccagccaccgcgggagcctcagattcacgggatacagaagcaccctcccctatacaacgcgaaatccacgcgggaatatcccagtggggagaagcacaagtctccaccgggtgggtgagaacgccagacagaagctcggggagggtggcgtgcacaaaaagttcctcagaacaaaccctcagtgggccagaaggccccgcgcacacctccacagggaggcgcacctataacacgcagtgaagaaaacgagatcgcgggtacgcgggggaatattctccacagagacagaacaagagaatctgtggtgcattgggtggcccactcccgtgaagagttgtggcacatctccacaccccacacccagaggtatctttataacgcagggggtatttatatccgcgcttttttctcacaacgtgggggtcacgttttatatctccaaagtgtacacgctactataaagggcctctggggcacttaagaggggggtatacaagggcgcacagttaatatctccccaactttctttaccccacacccgctatacacgagggccctcaaagagacaaaagggggcgaccaagagggctgcaccagggggcgcaacgcgcgccacactcacaggggacgatcgcccccaagggcgacacccaaagggcgccctctagtggccaggcggcaatatacaaaaaaacctgggcgaacaaaatcggggacctgggggcgcagaaaaaggggcgcacaccatgtagaccgacgctcaagaacaaaaccaccatggggacaccatattggggcgcacacaccacgaggcgaacagagagaataaggagcaggcggcgaacaccatatggcggggcaccacaaacaaataccacacaatcaacctactattaaataaaacgcacccccaatccagaaaaaaaaagaacacacaccaggaaagctcccttcaggacacacatggagcccacggaggagaacagggcccctgggggacacacaacagggg

SEQ ID NO: 632192 - DNA, 1027 bp, Homo sapiens
  misc_feature (18)..(18): n is a, c, g, or t
  misc_feature (90)..(90): n is a, c, g, or t
  misc_feature (198)..(198): n is a, c, g, or t
  misc_feature (201)..(201): n is a, c, g, or t
  misc_feature (205)..(205): n is a, c, g, or t
  misc_feature (211)..(211): n is a, c, g, or t
  misc_feature (213)..(213): n is a, c, g, or t
  misc_feature (227)..(227): n is a, c, g, or t
  misc_feature (232)..(232): n is a, c, g, or t
  misc_feature (240)..(240): n is a, c, g, or t
  misc_feature (257)..(257): n is a, c, g, or t
  misc_feature (265)..(265): n is a, c, g, or t
  misc_feature (269)..(270): n is a, c, g, or t
  misc_feature (304)..(304): n is a, c, g, or t
  misc_feature (341)..(341): n is a, c, g, or t
  misc_feature (352)..(352): n is a, c, g, or t
  misc_feature (378)..(378): n is a, c, g, or t
  misc_feature (402)..(402): n is a, c, g, or t
  misc_feature (431)..(431): n is a, c, g, or t
  misc_feature (433)..(433): n is a, c, g, or t
  misc_feature (447)..(447): n is a, c, g, or t
  misc_feature (454)..(454): n is a, c, g, or t
  misc_feature (456)..(456): n is a, c, g, or t
  misc_feature (514)..(514): n is a, c, g, or t
  misc_feature (526)..(526): n is a, c, g, or t
  misc_feature (535)..(535): n is a, c, g, or t
  misc_feature (564)..(564): n is a, c, g, or t
  misc_feature (566)..(566): n is a, c, g, or t
  misc_feature (568)..(568): n is a, c, g, or t
  misc_feature (572)..(572): n is a, c, g, or t
  misc_feature (638)..(638): n is a, c, g, or t
  misc_feature (650)..(650): n is a, c, g, or t
  misc_feature (673)..(673): n is a, c, g, or t
  misc_feature (778)..(778): n is a, c, g, or t
  misc_feature (826)..(826): n is a, c, g, or t
  misc_feature (840)..(840): n is a, c, g, or t
  misc_feature (857)..(857): n is a, c, g, or t
  misc_feature (870)..(870): n is a, c, g, or t
  misc_feature (910)..(910): n is a, c, g, or t
  misc_feature (912)..(912): n is a, c, g, or t
  misc_feature (924)..(924): n is a, c, g, or t
  misc_feature (930)..(930): n is a, c, g, or t
  misc_feature (932)..(932): n is a, c, g, or t
  misc_feature (941)..(941): n is a, c, g, or t
  misc_feature (1019)..(1019): n is a, c, g, or t
tatagtgggaagtgattnaataccaggagctgagtgcactgggcagcaggccagcagacggggcctgcaggggcgaaggcacggctggcngcccgtgcgcaccgccactctcctggaaccgctgctggccgagccacagccctgcggaaattctactgcgtgtggcagagaccgatgtgcaaaaagtttctggtgaangtnttanggaaantnctccaagcactaangaaancaggaccntgcctgtcctgaccgtngccttgcncganncctccctggcggtgctctctggctctctccaaanaggacgcttccttctctgattctaaggaaggcctganacagccctganggcttaatgtacagtgcggccaggtnctggcactgcacgcaggatctttngttagctgcatccatatcgtttgcacgananctgacggcacagangcgtaanangcgtgcacggcggggagctggggacagcagccaaagcatggggccaccaaggccaaanagttctggaganaaagtgtanaatcaggagacccgctccatccctcacananancaangagcccgagcgccgcgtcagcttggcgtacgtcctgctggagctcttgctcaatccgcccttcggngtggggatcttncttccggcctttgaccccaaggngcctgatgcggccacagctgagcttttccctggctgcagtgccggggccttctgcagaatgtgtgtcttgcgcaggttcatcgtgcagccggctgggcccatcangtgagctttccatgcctcttctccagggctgaagttctcatgacacangggacaccggtttnccagcttctccggtttngcagggttgcaanccttgtgttttatgtgtctgggcagctcttccttgaaaanancctcactgcaanggtaanantttccaaanccgtctttttttgtcacattccgtcagcaagtgctccgtcagactggatatctcgacaactgtttgcagtggtcacancttgtcag

SEQ ID NO: 632193 - DNA, 759 bp, Homo sapiens
  misc_feature (79)..(79): n is a, c, g, or t
  misc_feature (87)..(87): n is a, c, g, or t
  misc_feature (90)..(90): n is a, c, g, or t
  misc_feature (464)..(464): n is a, c, g, or t
  misc_feature (604)..(604): n is a, c, g, or t
  misc_feature (607)..(607): n is a, c, g, or t
gcttggaggttggcggtgcggggctgaaggctagcaaaccgagcgatcatgtcgcacaaacaaatttactattcggacnaatacgangangaggagtttgagtatcgacatgtcatgctgcccaaggacatagccaagctggtccctaaagacccatctgatgtctgaatctgaatggaggaatcttggcgttcagcagagtcagggatgggtccattatattgatccatgaaccaggaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgagtatttaaaagatgttcaatacactgtttgaatgtgctggtaactgctttgcttcttgagtagagccacncaccaccatagcccagccagatgagtgctctgtggacccacagcctaagctgagtgtgaccccagaagccacgatgtgctctgtatccagaacacacttggcagatggaggaagcatctgagtttgagaccatggctgtnacngggatcatgtaaacttgcgtttttgttttttcctccgggtgttgtaagtgtggtgacttcggatttatagtttcagggtactgggaactttccattttattccaagaaatctgttcatgttaaagccttgattaaagaggaagtttttatta

SEQ ID NO: 632194 - DNA, 934 bp, Homo sapiens
aatactacacataaagtcaaccaacatcacgtaataaactatgtttgtacgacaactacacatactgtaactccccatcgcccgcattttactccatatggtctctcccaccacctgccctttattggagcccccccaatttgacaacctaaagtccgtccgttccgcaatcaccgtttccctcccccgcgcaatgttgtataaccccaacctgggcagggccacattcccaaagacaactgtttaccccaacccacgtggttggcccaaaattctggcgtttttgtggcacttgtaacacgcgcggcaaattattttcctttcctggccaagttaaagcctcccccccaagggcgccttcaattaagaaatctttttcacaccccacccttgtgggtatgtcaaaagatacccctcttgctcgcggccccgaataaaagttcgcttttttttaaaaatctcgtcctaccaagtatggttcacactcctcctcaccaccacctctgttggtaaatttccccccccgctgggacaattgtaagatattccctctctccgcggatgaaccaccccgctttctaattttggaacataataacacacccccgctggctggaaaaacaacattttgctctagggagccccctgggggggtagacctgaacccgagaagagtactactggtgaaccccagaaggttcccaccccttaacggcggtttcccccgcccaaaatctctgggagtggcgtttagtaaaaacgatgtgggtcggcgaccactccacctagtcggccgcagaaatattcttaagaccgagtacaactagtgacccccgaagatcaaactaacaaagtcgggcggattgaacctgggagaccccaacaccggggacccaaaaaaggtctccaattttttgaaaaacaaaccaaaaca

SEQ ID NO: 632195 - DNA, 186 bp, Homo sapiens
cattcataataaaactgttcataaaaacaaattccaggaaccatctaaatgttcagaagaacacggataaacaagctgtggtaatacagtcatctctatttgttgtttgagatcggttccagacctcccttggatactgaaatttgcagttgctcaagtccctgctaccaaatggtgtagtatttg

SEQ ID NO: 632196 - DNA, 727 bp, Homo sapiens
  misc_feature (8)..(8): n is a, c, g, or t
  misc_feature (70)..(71): n is a, c, g, or t
  misc_feature (94)..(94): n is a, c, g, or t
  misc_feature (100)..(100): n is a, c, g, or t
  misc_feature (146)..(146): n is a, c, g, or t
  misc_feature (157)..(157): n is a, c, g, or t
  misc_feature (164)..(164): n is a, c, g, or t
  misc_feature (169)..(169): n is a, c, g, or t
  misc_feature (172)..(172): n is a, c, g, or t
  misc_feature (184)..(184): n is a, c, g, or t
  misc_feature (191)..(192): n is a, c, g, or t
  misc_feature (231)..(231): n is a, c, g, or t
  misc_feature (239)..(239): n is a, c, g, or t
  misc_feature (249)..(249): n is a, c, g, or t
  misc_feature (258)..(258): n is a, c, g, or t
  misc_feature (287)..(287): n is a, c, g, or t
  misc_feature (306)..(306): n is a, c, g, or t
  misc_feature (408)..(408): n is a, c, g, or t
  misc_feature (448)..(448): n is a, c, g, or t
  misc_feature (450)..(451): n is a, c, g, or t
  misc_feature (458)..(458): n is a, c, g, or t
  misc_feature (460)..(460): n is a, c, g, or t
  misc_feature (470)..(470): n is a, c, g, or t
  misc_feature (496)..(496): n is a, c, g, or t
  misc_feature (515)..(515): n is a, c, g, or t
  misc_feature (525)..(525): n is a, c, g, or t
  misc_feature (695)..(695): n is a, c, g, or t
gtcaaganaaaaatcaaatttaaaatcactatctgatggaagcttatatgccttatgaatatatacatgnntgcatatatacatctctgtatgnatcacncaaagcaattttaaacatcattcttttttgtatttaaaattgcccntttaaacattnagaagtnccagnggnggaggctttaanggaattnntccctagagtaaatttcttggattgaaattgttccagtncttctacnggtagtttanctctgggcngtgaataacacattatctgttgcaatgangctgcttgaggctgacagngaagtggatatgctgtctatttccaaaagtagtcagctcgtgatagtgactatagaaaaagcagtgctgagaatgtgagcccggactacgcaaaaccagccncagaactgccacctccaaaggcgggggccactggagcccngnnaggaccngntgccaaggangctggaagtcctgaaaatccaggtgntccaaaactggaagctgcngggcttttgnatgaaaatgatgcagccgatgtgacttcaggcttcccaaatccaaaagctggagcagaagtagagatacctgaactggtagaggctgcagctccaaatgctggggaactcccaaaaccagcagggcttccagaagaggcagcagcaaatccagagtttgttttaaaactnaagttctgagcattatcactgctgctgttatt

SEQ ID NO: 632197 - DNA, 162 bp, Homo sapiens
cgtcagtgaaatcaggattagtcttagctatatctgtggctcaagtggtagtcggcagagggcatcaatttttttcatagacaagaacaacttgccatgtatggtcaatatatcacaaagacacttgcccagtttagtgccatcctgatttccaccttgcct

SEQ ID NO: 632198 - DNA, 1115 bp, Homo sapiens
  misc_feature (1108)..(1108): n is a, c, g, or t
ggttagagtctctcttcacccggtcggcatgtctatagtcacgagtctgctgaatggagtccgagactagatgacgggagctgcttctttgtgagcggttggcgcttgtgaaagcccctgatggaagcgccttctcgcatggaccctactctgtgacgcgcagtgttggagagattgctcgaacggacatgctgtggttcatttgagtagtattcgacatgcaccaaagttgctctcgaggatggccaattagtgggttggtcgagcaaatagtgctcatctgctgtgtccgtattgggtggtagtgccagactatgatgtgcgatggggccaccatcacattcgttgcatgagtagaaaggatgtgtggcacaccgaattgatcagacatgaccttcatgtcacagatttctcagagaactgggtggtccaccataacctggtgcctgtgatctttggtcggtgcctgtcaaagtaagactgccatgaatgaacatcactgtaacaagatctattgtgaattctgtggtacctgttggagtgaatgagagacttgtaaattggtggctgcactgaagatgcaccgaagaagaaaagtgtgcttgagggcttgtgctacatccctgtgtctaaggacacgatgagtggtggaaatggtgacgcatgtggggagtgtataagatatgcgatactgtgaatgggcgaatgtgaaggttagaaataagtcctgttgaagacagccatggtagtgcttgaattcagcctaaaggtcgaaggtggtcttggaaactgtggtgcgcgcgtgcaacgtggttactcggtggcgagtgatatgttcgcctcgggggggaacctcttggtcgtcgttggctttggggcccccgtggggtggtgccctcggcggcagtgggcgttgctgcctggttgtcttgcggggcgccttgggacagtcgcctgttgcttccctgcatctctggacttgccgtcgttcgctggccgttgggggcctaatggtcccccgagcctggcggtggactcaacccgttttggcaccggctcgtttctcgggcacacgcgcccccccggtctccggtgccctttcttattnttcgttt

SEQ ID NO: 632199 - DNA, 397 bp, Homo sapiens
  misc_feature (45)..(45): n is a, c, g, or t
  misc_feature (57)..(57): n is a, c, g, or t
  misc_feature (66)..(66): n is a, c, g, or t
  misc_feature (68)..(69): n is a, c, g, or t
  misc_feature (125)..(126): n is a, c, g, or t
  misc_feature (131)..(134): n is a, c, g, or t
  misc_feature (139)..(140): n is a, c, g, or t
  misc_feature (151)..(151): n is a, c, g, or t
  misc_feature (153)..(153): n is a, c, g, or t
  misc_feature (170)..(170): n is a, c, g, or t
  misc_feature (179)..(182): n is a, c, g, or t
  misc_feature (203)..(203): n is a, c, g, or t
  misc_feature (225)..(226): n is a, c, g, or t
  misc_feature (293)..(293): n is a, c, g, or t
  misc_feature (309)..(309): n is a, c, g, or t
cctttggtggcggcggcggcccgggaccgagacccggccccggcncccctctccgcnaccccgcgngnncccaaccccccggcgccgcggggaacatgcggctccggctcccggaggccggcgcnngagtnnnncccgnnccccgcctcancntgcccgcacgctggcgnggccgcaannnnacgcctcgcccaggcaatganagcggctccggcgtctccgcannaagatcagggaccggctgctgcaggccatcgacccccagagcaacatccggaaaatggtggcggtgntggaagtcatctccancctggagaaataccctattaccaaagaggcacttgaagaaaaaaaaattgggaaaactcataaaaaaaagtacgaaaaaaaaaaaaaa

SEQ ID NO: 632200 - DNA, 864 bp, Homo sapiens
gaaattcagaagcccactcaaatgtcccactttggctacaggcatcagaatttcagaaccagcaaaacccaaaggggcaagagtcccaagtagaggcaatgattcaaaaccaggcactgaccataattcatggaagcaaagggaatgttttttgatgttttttagtttcagggacaagcacgaaaattcaaaagcatacacttacagcagacaacctcgcggatcttctctgtggttcgtccttcaccttggctttatctcccttagcatccccttcagcctataagaaacaagaacaaaaaactgcagattttgaggtggttcttaattacttcccaaactttagagtgctaaaaatgaaaattaaagcagtcgtccacacaacttttctaggacataaatgagtgagcccgacgttcgtataagaacgaagcgcgcgcaggagctccggctcgccgaccccgagaagcgagggctggaccggagcgcagccggggagggcagcggagcccgaccaccgcgacaggcaggagcaacagctgcagatggcgcaaacaaaccccctccggaggcggagcccagcgccgttgctatggcagccggtcgagggcgggagagggaggcgcgcgcagcccggggaactcgtgggcggcgacagcgcgcgtctcgtgcgcggggaacgtgggccgagcgcggggccataccgcacatacgcccgcccatcacggcggcggttttttggcggcagcgctttcccccgcccgccaaccccgagcgccgccatgcaggcatccggggagtcaattgcccgcccgcagggaggggagggaaggggccctcgcgatgggggagggggcacggggc

SEQ ID NO: 632201 - DNA, 242 bp, Homo sapiens
aggaggtatgcaggaatgaatacttctggtcctttgggatataggtggcttcaaactcctggtaggtgtcaatagtgcacagctggtgcgcgcgatgggcttgtgagcatagcgtggtcaaataagcctggactgactggaacggattcggacaggcaccagacctcttgagtaccagtggcaggcagagcagggcaaaccgccacggagcaggagacgtcctgggagcctgcgagccattg

SEQ ID NO: 632202 - DNA, 121 bp, Homo sapiens
  misc_feature (106)..(106): n is a, c, g, or t
tatgagcggtcttaaacacactacatatacacatgtaacaacacagacacccaggaatagctgagaggtggtactaatggagaggaatgtggaaggtaacagttcntcataaactcctttt

SEQ ID NO: 632203 - DNA, 655 bp, Homo sapiens
ttacccatgtcgaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcgtatcactgggaacaaagtggacattctgccaaaacaagttgtttaaatgcgataaagttgaggactttgaatctgggacagaagctgcatcacctcactcccagagacacagttggtcagctctcccagctcactcagctggagctgagaggggaacgtgcgttggaggccggctgccagctccagctgggccaggtgtcaggagtgcgtcattgcaacaagcgggcgttgtcgtggaatgatcaccattattcgataccactgccatcgtcgaatgtcaagagcaggcatgtgaatcaagacataaatattcccttctgcaaatgggatttaaactaagataatatatgcacagtgatgtgcaggaacaacttcctagatggcaagtgctcacgtacaagttattacaagataatgcatcttaggagtagatacatcttcttaaatataacagagaggatgcgtcagaagtggtagaagacata

SEQ ID NO: 632204 - DNA, 217 bp, Homo sapiens
tgatcgcgtcggccaatcagtccttcaggcttggagtcacccgagtcttatcttctgtccccttccagcaatgtaccggcaataaacgggcagggctgggcaaaggtctggccgcggctggtcggcctctgctcttcaaacctcgagctcactgttggctgctctgggccccagtgtgggcaggagctgcgcttttttccctgcttgcctttctcca

SEQ ID NO: 632205 - DNA, 182 bp, Homo sapiens
tggcggtcccttcaacattcatggcaggggttttatattgataattgtgtgatgagatgttggaaggaatgagacgttggaaggggcaatgagatgttggaagggggaatgagatgttggagggagtgatgagatgttggaaggggcaatgagatgttggaaggagatgagatgttggaagg

SEQ ID NO: 632206 - DNA, 122 bp, Homo sapiens
tcctcgtacgaggccccgcagagttatcggtaagcgaatatagaggtcttggggcgacagatctctactatctcaaacttacatggggtagaagccggtcgctgcgtgcagcggggttgaat

SEQ ID NO: 632207 - DNA, 427 bp, Homo sapiens
  misc_feature (363)..(363): n is a, c, g, or t
  misc_feature (387)..(387): n is a, c, g, or t
gttacccctacatacgtgttaagcaaaagtagccatccacaaaaaggtatacaagctatatggttactgtattagtccactttcatgctgctgatgaagactgaacaatttacaaaagaaagaggtttaatggatttatagttccacatggctggagaaacctcacaatcatggtggaaggcaaggaggagcaagtcatgtcttacgtggatggcagcaggcaaagagagcttgttcagggaaattcctctttataaaaccatcagatctcgtgaggcttattcgctatcatgagaacagcacaggaaagacttgcccccatgatccagttacctcccactgggtcccttccacaacacgtgngaattcaagatgagatttgagtgngaacacaaccaaaccatatgagtatgtgtaactcttcaca

SEQ ID NO: 632208 - DNA, 412 bp, Homo sapiens
  misc_feature (349)..(349): n is a, c, g, or t
  misc_feature (383)..(383): n is a, c, g, or t
gtttcaccatgttggccaggtcaggctcaaacttctgacctcaagtgatccgccggctttggcctccccaagtgatagaattacaggcgtgagacaccgcaaagcaggagtacactctaaaataacaatgaaaaatataggatagtaaatacataagccaataacatacccctttattatcaagcctttcattatgtgctgtgcatgattgtatgtgctatacttttagatgaccggcagttctgtaggtttctttacaccaacatcttcacaaacacgtgagtagtgcattgcgttatgatggctatgatagcactaggtgataggagtttttcagctccattataantcttatggggaccaccatggtattacatggtccnttgttaccaaaacatcgtcctgccggcac

SEQ ID NO: 632209 - DNA, 420 bp, Homo sapiens
  misc_feature (25)..(25): n is a, c, g, or t
  misc_feature (50)..(50): n is a, c, g, or t
  misc_feature (334)..(334): n is a, c, g, or t
  misc_feature (343)..(343): n is a, c, g, or t
  misc_feature (376)..(376): n is a, c, g, or t
  misc_feature (402)..(402): n is a, c, g, or t
  misc_feature (409)..(409): n is a, c, g, or t
gtaacaatactggtatgcaataagnggtgtaatatgagttgttatggacngaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaanaatacaaanaattagccaggcacagtggcatgtgcctgtagncccagctactcgggaggctgaagganaagaatngcttgaaccca

SEQ ID NO: 632210 - DNA, 1312 bp, Homo sapiens
  misc_feature (328)..(328): n is a, c, g, or t
  misc_feature (769)..(769): n is a, c, g, or t
  misc_feature (925)..(925): n is a, c, g, or t
ttatgttggggggcggcccccaacaatacccccccgaagaggagatatgtctttgctctgcaaggatagtgtttgtgggccccctcttgttctctccacttcttcgtttgggaacacagaaacaccgcggcgccgcagagaatattgtgttgtcttcctcgtcggggggggattattctcttcggcgaaggagagtagttatagaacacctccccctcttcggctagagaggcatcataattaggggggaaattatgaaccccccctcggcggggtgtggttgtgttgcgtgccccgaaaataaataaccacagcctgctgttgtccnccccggcggagaatttagtgtaggagagcccctccccccttctccgacggagatgattggtggggtggttattctcctcaggtggtgttgtccccgcgcgtgctttttttgtggcggcgccgccttcacatacaacgaggccacgtagcgtcaatcgcccctctagtatcattattcggctgtgttctcctctcctgttgagtgagtctggggggaagacaaaacaatagtgcgtgggtgtcaaacaacagagtgtattatgtggagaaaccactcctggggcggttatgtaaaacgctggcacacaacgctttgatagagctctccacccctcacacattggtggggcgcacgacacacacagaggagttattctgtgtgaacaacacacggggtggaacactgtgtctctctctctctcacgagaatggggggatctcncccctctctgtgctgcactttctctgtggagaagcacacagaagggatagtgccccctgccgcgcccactaggtttttatagagggagtcttctctactcgagagagcgcaaaaccacaccgcttttacacacacgcgctagaaatgtggtgtggngacacaatctattctatacacgcccccctgtgtgtgtttctataactccctatacccgcgtatcactgtgcgctgttgtgtgcgctgcgccacacacggcgcccccacgaccactctaaaaaatattgggatatttagaaggggaagaatacattgttagaatagaactcgaagccagaaagatttatccagtgacccgccagtcaagagctcagagacaccacccccgtggcaccttccctggcctggtttgctggaaggcccagaacattctgtttgctgggttacacggacaacctggggggaatttggcaggggacccatggcacaccgcttaaagtttttggcagagcttttccaaattaaaaaaaaactggcttttttgga

SEQ ID NO: 632211 - DNA, 202 bp, Homo sapiens
gcccttatgtgtctgctatcttcattgccggcgcattctacgtattttggacatactggtgtaggttctcgcccattggacaggttgctggtcgctagcggtgaggtgtcgaagccctcagaccgcaggttgcgctgtaccaaagagacgtgtgacgagtccatgctctgaagtatacaccgctgtagctaatatcccagtc

SEQ ID NO: 632212 - DNA, 527 bp, Homo sapiens
tactaacgaagctcgacaaggttcttgacattaacgagattataatatccgaaaggcttcaaaagaagagataccagaaacccatctcaactagattgtgaatgcagacagctgtgagttacgtggtaacaatcacttcttcctcttcttaaaatgaggaatgagataatttaaattcagatcaagccagcaccataaaaactaaggattatctatattttcttatattctataatgaatacatattcttctataacagttaacaaaaaatacctgatagttgctaaattactcctcaaaattcatcctactatgtccatctcaaggatttactcaaacttagtaaaaactgtaacttagaattgaaattgaaagcacaaacataatactgttaaaatgcttttatttatttttttttgagatggagtatcactttgtcacccaggctgaagtgcagtggcacaatctctgcaacccccgcctcctgggtttaagcaattctctgtcctcggcctcctgagtacctg

SEQ ID NO: 632213 - DNA, 301 bp, Homo sapiens
ctgctcagatcaagatcagaattatcagagacaggacatcgaactcagtactggtacttcccgtatatagccatgttattacctggtacttcctgtatatcgccatgttattacctggtactccctgtatatagccatgttattacctggtactccctgtatatagccatgttattacctccctgtatatagtcatgttattacctggtactccctgtatatagtcatgttattacctggtactccctgtatataaccatgttattacctccctgtatatagccatgttattagtcgacgc

SEQ ID NO: 632214 - DNA, 204 bp, Homo sapiens
ctgggatacaggtgcgtgcgcatgcccagctaatttattgtatttttagtagagacaggctttcaccgtgttggccaggatggtctccatctcctgaccttgtgatccgcctgcctccgcctcccaaagtgctgggattacaggcatgagccaccgcgcctggcctcatttttttattgtagtataaggcctgccttagtctct

SEQ ID NO: 632215 - DNA, 723 bp, Homo sapiens
  misc_feature (26)..(26): n is a, c, g, or t
  misc_feature (133)..(133): n is a, c, g, or t
  misc_feature (147)..(148): n is a, c, g, or t
  misc_feature (242)..(242): n is a, c, g, or t
ggacctccttgaagaaaaagattgcnggggggcgcctgcggcaaagcgcccggccgcaagggcaagggtccgtcgcgcttgcaccgtcaagggcggcactgcgctggtcagcaacaccacggcgtggtaggcnccgggcagcagcgnnccgcggagctcggcgtgggcacgatgtgctcaggcccatggcgcccttggccggcgccgcacgatggtgctgaagcgcacgttgacagagccgncgatgtgggttgctcggcactgttgggtaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632216 - DNA, 720 bp, Homo sapiens
  misc_feature (384)..(384): n is a, c, g, or t
  misc_feature (442)..(442): n is a, c, g, or t
  misc_feature (455)..(455): n is a, c, g, or t
  misc_feature (464)..(464): n is a, c, g, or t
  misc_feature (476)..(476): n is a, c, g, or t
  misc_feature (491)..(491): n is a, c, g, or t
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggtaagaacanttttctttctcttaatgcaaagaatcatgataagtctttaaatgttgagatgaaagtnatagacaaatttnatataggantgtttcttagantggcttcagtcaggnatctaatgttattatatagggatgacaaggaaggccattttagtagtttgtcaagattaagctccaggccagtaaactattaggctatggtttattttcagtaatcgatcagcacaaaagtatgtctgatgattctggtatctaactttataagactattaattctgttagtaataaacaagattatccttttaaaattggcactaataactttgtctatatatatgtc

SEQ ID NO: 632217 - DNA, 2880 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632218 - DNA, 3111 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632219 - DNA, 684 bp, Homo sapiens
agcggttcgaggagctgctgctgctgaggcggcggcaactgcattgaggtggtggcggcgctgccggccccgggccgctcgagcctcgtcggcgtcgccttccagacgtcggccttgagcccgccaggggcccagcgccggacacgcgccagtgccactatgagatgtgtcacatggagtagtgtactccagaatggggagcatcgaaggaacaacatcgcccatgtcccccgaacggcttcggcctgccagcagccgcgggcacggggaaaatgtctgagtgaggagataaaacaagacgacacgtgagcctcacgcgtgtagccctgatgtccagaacggcaagtcaccaaggagagaaagtagcagaggctatccatcaggcatcctccggccgtcgagaacatgaccaagatgtgatccattgagaccatgaaggtgccaaaggcgcagaatggaaacctagcaaacgtaacaacggctgcgcaagacaccgggagcgttctgccagaaacggcgcttcccacgatcatgtgcggccaacacgtaacgttaaaggcattcagcacggtcaaaggacactgccctaagaccggcgtgcaccccgggaatatctccgatgccccaagaacaaggctcttcccgaaaccacgaattgccatatcgttgcacgggggggcaacc

SEQ ID NO: 632220 - DNA, 3228 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggatctcaatctgttgcccaggctggagtgtagtgtcacagtctcggcttactgcaacctctgcctcccaggttaagcgatcctcctacctcagcttcctgagtcactgggaccccaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632221 - DNA, 254 bp, Homo sapiens
caaattcctgccctcaagtgatccgcccgcctcggcctcccaaagtgatgggattacaggcgtcgccagcgcgccggccttctccagtatttttgcatgcatcttacggcacacctttgcacgccatcttattaactatatcatactgccgcacgtccttttcgccaaggcatccagatggtgcgggtcctgcctgcctcgagaggtggcagcaaaggagccagtgccctcactggtgctgggcggggcggccg

SEQ ID NO: 632222 - DNA, 169 bp, Homo sapiens
gcaccgcacccacgctaatttaaaaatattttatagagacaggtctcactatgttgcccaggctcgtcttgaacccctgggcccaggcgctcctcccaccttgacctcccagagttctggaattacacatgtgagccaacacaccaggcccagacctgagcaagccaga

SEQ ID NO: 632223 - DNA, 3015 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632224 - DNA, 2967 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaaaaaaagaaataaaga

SEQ ID NO: 632225 - DNA, 2553 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgaagaacagtaaaatcacagcggaaaataaaaagaaagtcgcgttgttatatttctaaaccaacctaacaagaattaagcagagttgggggaagtgggaggggtgacaagcattatagtgattcttgcacaaacagctttaatttttccctttttcatactttaacaattgaactgttaagggtggttttaatgtaaacatagtttctataatctgaacacaataattttcctttttgagaaatccttttgtattgtgagggttgatggctatttctgtagtttgaaaacatctaatagagatttgcactgacaagataaaaattcaaggtttttggtcctggaaatgagggccgattgtaacttttccaaagggaggtttacatgatttgtatcaacatcagatattttatatgtgaatatattaaacatctttaagagattcattttcatgtattaaagaaaaaagaaactattttgcagagtaaagttatatggtgttcctgcagcgtccacacagaggcagcagctctaatgaatgattagcttgtggagttgtggcaaatacctttttaaaaatgaatctgtaccactgtaattttatttagacttttttttaaagacacagaaatcacactgtcatttctgtgaggcttttaagcttatgaatttgcttcacccgaagtcattggacagttacatttgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtctgggccctcaatggattggaagatgccagcccacattggtgagggtcatcttctttactcagtctactgattccaatgctaatctcttctagaaacacccttgcagacacactctggaaa

SEQ ID NO: 632226 - DNA, 188 bp, Homo sapiens
gtctagaggatcccagtgtcatgtatacgggcttgatgtgttccagcagctaaaacctgtgaaactggtgaaaaagaaaaaaatgaagtggggtggggatcttagagtagatccaattcagcagtagcacagaagactaaagtgtaaataacggagactctcacaaactccagtcagcctcaaggttc

SEQ ID NO: 632227 - DNA, 1857 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggagtctaccatggctcaagaatctcccaaaaattcagcagcagaaattccagtgactagtaatggagaagttgatgactctcgtgaacatagctttaatagggatttgaagcattcattaccatctggacttggtctctcagaaacccaaattacatctcatggctttgacaataccaaagagggtgttattgaagcaggagcatttcaaggttccccagcaccgccactgccatctgttatgtctcctagcagggttgcagctagtcgactggctcagcaaggaagtgatttaattgttcctgcaggtggccagagaacacagacaaaaagtggaccagttattctagcagatgaaattaaaaatcctgcaatggaaaagttagaacttgttagaaaatggagtctaaacacctataagtgtactcgacagattatctctgagaagctaggccgtggctcaagaactgtggaccttgaacttgaagctcagattgatatattaagggataacaagaaaaaatatgaaaatattttaaaactggctcaaacattgtcgacccagcttttccagatggtacatacccaaaggcaacttggagatgcatttgctgacctgagtttgaagtcactagaacttcatgaagaatttggctataatgccgatacccagaaactgctggctaaaaatggagagactcttcttggggccattaattttttcattgctagtgtgaacactttggtgaataaaaccattgaagatacattaatgactgtgaaacagtatgaaagtgccaggattgaatatgatgcatatcgcactgatttggaagaactgaatcttggaccacgtgacgcaaacactctgccaaagattgagcagtcacagcatctcttccaagcacataaggaaaaatatgataaaatgcgcaatgatgtttctgtcaaattgaaatttctagaagaaaataaggttaaagtattgcacaatcagctggtccttttccacaatgccattgccgcttactttgctgggaatcagaagcagcttgaacagacacttaaacagttccatatcaaattgaaaacccctggagtggatgccccatcttggcttgccacagcacacagtcaaaatccaccagcggcacaacatcacacacacagcacaagtccgccgtagcttcatcatttcctcaaacccaacctcaaccaagcaattaagccagcagtctggggcgcacacgtgggcaggggtgcaccaaagccattcatcaggtgcattcattgcgacacaaccaggctttacattttctccgcgttttgtccagtacttgtaacacattgcaacctggttcaaagggtggatgtatctcaatggtaacacatcaggtgtcgtcatcaatcgtggcaaccacacatcaatttatccatatattgcagcaaatccatttaggtattagtgcagggttgataggctcattatctagtcagtttgcaaaaacatctcaatagcagatttgcgactggacgaagcatcaaaaaattccaaggtattttgggtcctggggaaaatggcaggt

SEQ ID NO: 632228 - DNA, 434 bp, Homo sapiens
  misc_feature (369)..(370): n is a, c, g, or t
agaacactgctaagaggttctgaatgtttgtccctcacatagcatttaagaacactgctacgagggtctgaatgttttccctcacataggatcgaagagcactgctgctgggatctgaatgtttttgggcacataggattccagaactctcctgatgtggtctttatgtttgtccctcacatagaattccagaacactgctgctgagttctgcttgtttgtccctcatttaggattcaagaacactcctgctgtgttctgaatgtgtgtctctcacataggattccagaacattgccacggagggtctaaaatgtttctctgtcacctaggattataagaacactcgctgctgcggttctgagtcgttnnctccctcactttgggattccaggaacaggagcttcggggggtctgaaatatcagtccctcacat

SEQ ID NO: 632229 - DNA, 764 bp, Homo sapiens
ctgtcgtggcaatccctgagcgcaccgccgtgatgcccaggaagacaggccgacctggaagtccaacctacttccttaagatcatccaactattggatgattatccgaaatgtttcacttgtgggatgcacgatcgaactggtggagcgtcccacagcaagttgcagcagtaatccagctagtgtccctgttcgtcgtggaaggctgatggctgctgactggtgcatagtaatcaccaatgtatgcgcaatggccatccgatgggtcacctggaaaacaacccagcttctggagaaactgctggcctcgacttagtacctgcgcgggtaattgtgggcgcctctctggtgcttcctacccataggggatgggtacctcccactcgtatggatcagtggaatcacttgctctagccttgcgccacaatagacgcgtgccagacttggctgcccgatggctggttgccacttgccccagtgtgcatggtcagcttggtcgccaacggcccaaggaaacgacgtggctctcgcgtgcccggaggcaaagaccatctcgtttttttcgcagtggctctatacgagtagttcagcccatcgtaaccctcgtccgatggggtctcctattgcaagagtccctgaagatgcactgtcgtcagcctgactcggagcattgggccgacaaccgtggcgggtccagccgatcgcctcggctgctgcaccattgctcaacactctgccccttctcctttgggctggcatcctgca

SEQ ID NO: 632230 - DNA, 685 bp, Homo sapiens
agcggacttccggcttcgctgcttttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagcggcggaaaggataagcctcgacttagaagctaccgagttaccctaagaaaggtttgggttcttataaggaaagctgctaggagtacatgtctacaagattcaagaagctagttcccagccttcacttttttggttgtacaatatactagctctctaggtttggtacatgacgatgcctttagatcatctccaaaaaagtaacatcataattggaatgtgacatccatatatattggatttttaaagattgtttccaaagattcagctgtacagagtgtgtgcctaatacttttctaacttggaaataattcagtggtggctaaagctggcttgtactgcctgcaaaagctgattggtaaattttcaagaatttgtaagccaactgttaaacacagccattattttaaaaattatgtaaagttattattaaatacatatattaaaaataaaagtaatacctcctc

SEQ ID NO: 632231 - DNA, 464 bp, Homo sapiens
  misc_feature (22)..(22): n is a, c, g, or t
ccttttcctggttttaatcttngcctgtcatataggttggtgttaattaatttccacattgaatcattattcacatgagaaaggggcatttatctgtttctttagtttaagtagtaccttctacttaggaagacatttttgctcttaatatacaaagcctttgcccaaggtggaaaccaccaaacttatgacctgtctgttaaaactgtctaggaactttgtatgttcacacaaagtgctaggaaatggattgtattattaacatctcattttagtctcttttgttatgggagaattttaggtgcttcaaaataataaatagagaattttgagaattgtaataattgttagtgctgcttatatccaggagcccatacaagtaatgtagttaacattgaaattttgtttcaatatggtgggaaacattttgataacccattagaagcacaagaattatctttctt

SEQ ID NO: 632232 - DNA, 345 bp, Homo sapiens
gtcgacttctgacttccgcatgtgttttgtggtacatattcaacttgcattcacatacattaaagtacagacacaaatttttatttatttacagtgttgctatgtggtcctggctattctggaactatgtggaccaggctggtctcaaattctaaagatcctcctgcatctcaagtgctgtcattaaaaggtatgtgccaccaatgcctagcctaacaattttcaaaataccattcctctaataagtaactagacaatacataagaaaaaaattagttctttcccaggatacatataatgtatagaataggaaggtactcaggaacaccgaacttacgtcgacgc

SEQ ID NO: 632233 - DNA, 140 bp, Homo sapiens
tcgatctagaggatcccggcgggtctcttcctggacctcattatccacccgctttggctcccaaagtgctgggattacaggtgtgagccaccgtgcctagccaacatcatctttaatgatgcagaaactagatgctttct

SEQ ID NO: 632234 - DNA, 343 bp, Homo sapiens
gcgagaactagcctcgagaatgtaaatttctgtattgctgtcagctctcagtcaagaagggctgaacaatgatgatacctatgaccactagaactcttctacatttgggtctgcagtagaactcatacctatcatataacccagctcaatgactatcacacaggttagataagaccaatggtaaacaggacagtgatagctatttcacgcagtactaagaccctacacttacagaatgtacaatacgcgaagatgcatctatactgctgctcatgtatcaatatatatacttgccactgagtagcttacctaggacacactgttactcatacatcatcagcct

SEQ ID NO: 632235 - DNA, 348 bp, Homo sapiens
aatcagtgtgttctttcttccttcatgaggcttcaggattccttttatcatttcctctgtttagaaaacttcttttagccattcttttagggtaaatctgctgatgacagattctcagtgttccttcatctaagaatgtcttcatttctcctttatttttgaaggtggcattttgctgagtctagggttctggggtggactgttcttttctttcagcgtttaaaaaatattgtgccacttccaggtagcctccatcgtttctaatgacaaatctcctgttattcagactgatttccccctatgggtaatgtgtcatttttttttttttcctggctgctttcaagattt

SEQ ID NO: 632236 - DNA, 395 bp, Homo sapiens
  misc_feature (64)..(64): n is a, c, g, or t
tcggccggtaccgcatgtgactgcatattccccaacagtgtgctttgatggcttctctccaggntggaagtggttggagcaaaggtcagactggccctttcatccctgtggctcatagcctggcactaggcatgctggcagaagaggaaacaggaaggctttgggctgcatgcagatccccaactcttaaaacctggagccaaacttgaccccaggttttaagagttggggtcaagtttggctctctcatacattctcatggtggagcaagcatgggtcaagtgtgggggtattggagcctcttaccagctgagtagattggggcaagttaattaaactcactgtgcctcagtatccccaactgtaaaataggagctcattagagcctgcctcac

SEQ ID NO: 632237 - DNA, 128 bp, Homo sapiens
ctcgtgagggtcgacgcggccgcgtcgacattggcgcgtgccaacaactccatgtcggttcaggtttctcaagggctcaatgctacggcggctaaggcttttgcatctgagatcgaacgcaacccgga

SEQ ID NO: 632238 - DNA, 524 bp, Homo sapiens
cgagctggtaccgcgatcgtgacttggctcactgcaacctccatctcccaggtcagccattcttgtgcctcagctccagagtagctgggatcacagggacgtgccaccatgcccagctaatttttgtgtttttagtagagacagagtttcacagcctgttacccaggctggtctcgaactccagatctcagaacccccacctcagcgtctcaaaatgctgggattacaggcgtgagccactactgccagcccactccctgctatttttagttctatttttatttttattttgagacggagtttcgctcttgttgcttaggctggatggagtgccaacgccccgtctcggctaactgcaacctccgcctcccagttcaagtgattctcctgcctcagcctcctgagtagctgtaattacaggcacctgccaccacgcccggctaatttttgtatttttagtagagacgaggtttcaccatgtcggtcaggctggcctcaaactccctacctcaggcaatccactc

SEQ ID NO: 632239 - DNA, 340 bp, Homo sapiens
gggtatctgctcctgtgttagtttgctaaggataacagcctcaagctccatccatgttcctgaaaaagacacgttctcattcttttttatagctgcatagtactccatggtgtatatgtaccacattttctttatccagtctatcactgatgggcatttaggttgattccatgcctttgctattgtgaatagtgctgcaggactggttgttgttgttgttgttttttaattacatttcttttttttttttttttttttttttttgaggaaaggaatccccggtgtggggccccgggggggacccccaaacggggacccccaataaagccaccctggaggc

SEQ ID NO: 632240 - DNA, 208 bp, Homo sapiens
gcgggagaccaaagcctgcaagaaagaccccagcctccattgactgtaagaagatgaaccacaggcaacaattaagatcaactttcaaatccctcccttgaacgggcttaggagagtctatgacaagaaacctctgcttctctgacacatggaaagaatgctggggaagagggtgagtttgtttttcattaaaagaagttgctgagcc

SEQ ID NO: 632241 - DNA, 288 bp, Homo sapiens
gtgaaaactacccctaaaaagccaaaaatgggaaaaggaaaaagaactcataatcaacattgtcgtcattggacaacgtagaattcgggcaagtccaccaactaactggccatctgatctaataaaatgcggtggcatcgacaaaaagaaccattgaaaaaatttgagaaggaggctgctgaaatgggaaagggctccttcaagtatgcctgggtcttggataaactaaaagctgagcgtgaacgtggttcacattgatatctccttgtgggaatttgagcccgcagt

SEQ ID NO: 632242 - DNA, 745 bp, Homo sapiens
gagcgggggcccgaggtggcggggcggtataaagccggcgactgggagcatgtaatgtcggaatgcggaggcgcggggcggagaagaagcagctgaggacgccgaggacgagcgagggcgcaggcggtgtgccccgcggggctcagacgtgcctcagcctcgagcccaggacccgtgtgccaacagcgtccctcgggtgggcccaggctccggccggccggggcttgcagttggccccttccttcatggcgcgcccagggcccgaaaacttggcatccatgaagagcgcccgagagcacccccccgcagctggacagcgcctggaccacctgcgcccctcaaagttccacacctggtcaaccacgacgaccaaacacgcgatggtgaatcaagtcaccaggcaaaaggccccacacctgggacaacagccgtaggacactaccccttaggacgcgctcgtccaaggtcccgttgaaacacatcttatcccacagggggcggccacgcccgtagacatcacgatggcccagcaagaatcaacgctccccgaacgcagacgcaaataccaacaacgcgcggcgcaacacgtggactgccggccactaccctaagcgccccccaccgtagggagaggggggaaacacagcccacaaaccgacggtgccaggcgcccccacaaaccgacgtgggccgccacaggacagccgccaacgcgtccggcgcgttgcagcaacatcccagacgg

SEQ ID NO: 632243 - DNA, 514 bp, Homo sapiens
ggtgtggcccaggctagagtgcaggggtgagatctgggtcacggcaacctccagggtgggtactttctggaccacctctctcatgggccgggggctcagctgggcaaatgacaggggcagcagggaacgcctgagcgggccagctccggcccccaggtcagagccattaacactggaggctggaggtgaaaatctggtggaccgtcacagggagagtcctttcacccagaaaaggggcgcaaagggatggcatcataccgggtacatagcaggcgcttaataaagtctggcatttatgatgtgaggagggcagaggggtcagcggctcagggggacagggcacccatgaagggtgccgtttaatgtcctactcatcttgggacacaaaggaccagggtcctagaagccgcaggcacgggtgatgtgcgagggcctcggcctgggtcagacagaattgcaggcatttaaaaaccacaaggcgggggacggcttccagagagtttgggactaagaa

SEQ ID NO: 632244 - DNA, 884 bp, Homo sapiens
  misc_feature (544)..(544): n is a, c, g, or t
gcctttctgtccgtggatggcgcggaaagaagcatcgtgaaagtctctgcttacactgctggccgtcaatgtcgaagtcagagtctccttaaagagcgccgaacagatgaggaagctctgcattggagggtagagcttggaaacaacggatgagagcctgaggagccatttggagctaatggggagatcgctcgacggtagcggtgtggtcaatgaggagatcgcaatagacctaagcgctccaggggctgtggcggttggtcacgatatgccacaggtgggaggatggtggcatgcagcctagtgacatgcatagggcgcaaaccacaggtgggatgcgaagagattgtggaacctaagagcaggagctggtgctgccaagaagtaacgatgctctaaacgacgcaaggtgacgcgacgtgtaagctggtagaagaagagtatattttgatagcgtggcgatgtgaagaggaagtgacgactggagaggaacatcaatccgtagacgaggattgtatctttggagacaaggtgagtggggaanagaaagtacgaatcgtagaattgggaaacatcatgaactgggacctgagtgcgaggtgggccaatgagagaaaggggggcgttatggcctttatggtagacctgtgtggactgacgcaatagacttccggtggcatagagaattggtcatttcaaagaaattaggcattaggtgttggaattggggcacaatactgttgcaaggtttaggaaataagccactggtcggatatgcaagagaatggttacgtggctttcattccaagccacaagagggttcgaaagtgggttcgtggaagagtttggtgggtgggtcgtgggaggttggttgtcggtgggga

SEQ ID NO: 632245 - DNA, 432 bp, Homo sapiens
agatggcggaggtgcacgtcatggtgcttgatggtcatggccatgtcatgggccgtctggcggccatcgatgctaaacaggtactgctggtccagacggtagtggtcgttcactgtgaaggcatcaacatttctggcaatttctacagaaacaagtagaagcacctgactttgctcagtaagcggatgagcaccaaccattcacgaggcccttacgactttcggacccgcacacacatcttatggcggactgtgcgacgtatgctgtatcactgaaccaaacgaggccaggccgatctggaccatctcaaagcgctggactgaatcgtaatgccctacgacaagaataagcagatggtggatcctgctaaccttgacgtgcgtctgaagactacgacagtctgtctatatggtgcacctgtgtcacgagttg

SEQ ID NO: 632246 - DNA, 510 bp, Homo sapiens
  misc_feature (136)..(136): n is a, c, g, or t
  misc_feature (153)..(153): n is a, c, g, or t
  misc_feature (157)..(157): n is a, c, g, or t
  misc_feature (160)..(160): n is a, c, g, or t
  misc_feature (172)..(172): n is a, c, g, or t
  misc_feature (188)..(188): n is a, c, g, or t
  misc_feature (190)..(190): n is a, c, g, or t
  misc_feature (222)..(222): n is a, c, g, or t
  misc_feature (237)..(237): n is a, c, g, or t
  misc_feature (260)..(260): n is a, c, g, or t
  misc_feature (286)..(287): n is a, c, g, or t
  misc_feature (302)..(302): n is a, c, g, or t
  misc_feature (345)..(345): n is a, c, g, or t
  misc_feature (376)..(376): n is a, c, g, or t
  misc_feature (432)..(432): n is a, c, g, or t
  misc_feature (442)..(442): n is a, c, g, or t
  misc_feature (456)..(456): n is a, c, g, or t
  misc_feature (458)..(458): n is a, c, g, or t
cttccttgctttggtgcctacccgagtcaaagaccccgttacccgcccccctctcaaaatccggaacacattcgggcccgaggtccacctgctcccccccccgtcggaggagctggcctttaacaagttggttacncttacgtgcctggcacncggnttnagccccaaggangtgttggtttgctggntncaggggtcacaggaattgccccccgaaaagtnccttatttgggcatnccggcaggagcccagccagggcncccccccctttgttgtgaccagcatnntgggggtggcaaccnaggattggaaaaagggggaccccttttcctgcatggtgggccncgaggcccttccgttggcctttacacaaaanaccattgaccgcttggggggtaaacccccccatgtcaatgtgtttgttgtcatggnggaggtgggnggcccctgtttttnanccgcccgcctgtccccccccctgaataaactccatgttcccccaagcagcca

SEQ ID NO: 632247 - DNA, 120 bp, Homo sapiens
gttgacatgatacgaatcgagcccggtaccagaagggtactaagctttgccatacatatcataaaattagacaaggtgattttggcacagtaatattgccaaacacaccaccactcagtg

SEQ ID NO: 632248 - DNA, 137 bp, Homo sapiens
  misc_feature (122)..(123): n is a, c, g, or t
  misc_feature (137)..(137): n is a, c, g, or t
gggcagagggtatccaaggccggacctggcgcgcaggcgctgacccgacctggcagtgagctggccgcggccttggctgatatttctcatccccgcggggcggccgcgccctgcatgcgagnngggcctttgtcggn

SEQ ID NO: 632249 - DNA, 348 bp, Homo sapiens
acgacgagaggatccccacgtcacagttagctagatgaacactagtcacgaataaaaacgtctacctctctagtactaatctccctacaaatctgccgttaagtgtattacattcacagccacataactaatcatattgttatatcttcttcgaaaccacacttatccccaccttgtgctatcatcacccggatggaggcaaccagtccatgaacgccgtgtaacgcaggcagcgatacgttccctattctacacccttagttaggcgtcccttcccgctactctatcgcacgtagctttacagctctactccagccgcctcactaggttatggtgctgggggtaccg

SEQ ID NO: 632250 - DNA, 251 bp, Homo sapiens
tgacgcgagaaactgtcgccactagccaggatgctccggggactgtacagcacgagcagcagctgaccctgcgtgcccagcccgaggtgaagaccccactaaccgccaacatcacaagaatccggaaacacattccggcccgaggtccacctgctgccgccgccgtcggaggagcgggccatgtacttggaaaaaggccgcatgatctttctggctccactcagtgtctaaggcaccctgcttcctttgct

SEQ ID NO: 632251 - DNA, 494 bp, Homo sapiens
gaataagctcggtacctgatatattgtaggctgagttgaacacctgttatggtgccaacatcgctagttcgtcatcatctttgaacgtatcgcctgtataaattgatttcccaaatgacttgggaagcagtattactagatctggaggcaaccacaggacactaaacttctcccagcctcttcatgaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggccttgccatatgcaa

SEQ ID NO: 632252 - DNA, 261 bp, Homo sapiens
acgacgtgccaaagctgtgaagacgctgttgcagtcctggtcaagccggtgtgagtcatggcactagggatagattctgcaaaagaaaagatggagagggaaaagccagtcgaacgtgagatgaagtcatctgtactcccaaaggcgtccactctttcaaagtcatcagctgtcattgagcaaggagattgtaagaacaacgctcttgtaccaggtcccctcttcacaagttttgatggctgtcctccatggccatttact

SEQ ID NO: 632253 - DNA, 169 bp, Homo sapiens
ctcacttctgtaccctttctgtcatattttcatctgaattaacttctgctacagtaattctcaaccttctttttttctccaatcttgccattacagcattgatgtgaaagtccaatgaggcaatatgtgttaaagcatttcataaactatgatgctataagaatgtaag

SEQ ID NO: 632254 - DNA, 103 bp, Homo sapiens
cctgttgtcattctcagtgcaggtgatccctcctccccagaacaagaactgacaggtagggtcttgtgaagtcatggcttccacaatggctcaggaaacccca

SEQ ID NO: 632255 - DNA, 389 bp, Homo sapiens
  misc_feature (70)..(70): n is a, c, g, or t
tatgaataccagatggcaaaattccctcagctaatacccagtaaactgagttccagtagcatattaaaanggcctacacaccctgacccaagtgggttttatccaactttcagtatatgaaaatcaacccaacaaatcacacattaataaaggaaaaaaatgatcatctcaactgattgagaaaaaaacgtgacaaaacccaatattctttaaactagaaatagacaggaacttcttcaacttgataaaggccatatacatgaaaaactcacagctaacatcatattcagtggtgagagatacaagcttttcccttaagattaggaacaaggtaaaaatgtacactattatcacctctaattatcacagtactagaagttttagccaga

SEQ ID NO: 632256 - DNA, 191 bp, Homo sapiens
ctcgcctgatcatcgagaaatccagttgcagatcgcgagcgctccggcattcgtatcaccgacgaagaactgaaccaggccatgggcaccatcgcccagcgcaacggcatgagcctggagcagttccgcgaagcgctggctcgtgatggcctgtcctatgccgatgcccgtgatcaggtgcgtcgcgagat

SEQ ID NO: 632257 - DNA, 1180 bp, Homo sapiens
ggtattgtgtttattggcaattctgaagaaactatggaggttaaaactcttggcaacactggacacggtacaaactgcttcatattctggcacatttgcattccagcatcgtaggcagaatgcagtgtaattgttcaggcacctatccaggtgcagcaagttattcatttgcgtaaaggcagctgcagtccatcacattctccctcaacatgtatcagggtggcagcacacatcagcaacacacaaccagacattccatgtcagcatgacatttagctttgaacagggctcaagcaactcctgtgtcatcagccatcatcagacaaatttcacattcaacacagcagtcatgcaggcacacatcagcatcaaacgacatcatattgcaagcccaggcactggccgttggcagcaagcagggcaagcagcacacattggcccagcatgttatatccgagattccatcagcagcaaagcacctgcatcattcactttggcagccaccagcagtcagcaagcaccagcactaccaagcatcaacagttcgcagcaaactcatctgcaccgccattgagacatggctaggtatccaaagtcatgggtacttactgcgggcatcaaaccatgacacacagctgttcagtgtgcagtttatcgatgtggccatttatcatagaacccatggaacatccttgaacttataaacagcaaatcagacagcgagtgtgctgaacaattgaggcagcttgcagcaagaataaaagaggatcatgtcaatcagcatggggcaggaagtggatgggaccaggcacacctatggccacccaggagacagaaaaacataaaggaagctagcgaaactgaaaagcgaatacggcgccgcaggacactgaaaagcacaacacaaagacccatagcagtactccgtagaaaccaacgcagggacgcggcaagcggaaggacgaagacagacaaagaagaagaaaaagaacgagacagggacacgagaaccggacgcaaaacgccatccaccccacaaagaacgcaaacgaggccagcaagaaccacacacgaacagcgacacaccgagcgtgcaccagacaaaaaaagccagcagacagcgcgaaaaggcagcaagtagacaccaccacaaggacgacaatatccgcgagctgaaaaa

SEQ ID NO: 632258 - DNA, 300 bp, Homo sapiens
  misc_feature (72)..(72): n is a, c, g, or t
  misc_feature (133)..(133): n is a, c, g, or t
  misc_feature (251)..(251): n is a, c, g, or t
  misc_feature (286)..(287): n is a, c, g, or t
accgggggaaacccccaaaaaaaaaaagaatttcccccaaaaaggggaattttaaaaaggtttccccggggnaaaaaaaaaaaaattttaaaaaccttcccttaaaccaagaaaccttccaaaatttaaatcnttttttttttttttttttgagacggagtctctatcactcaggctggagtgcagtggcgcaatctcagctcactgcaacctcccaggttcaagcagttctcccaggttcaagcaattcncctgcctcagcctctctagcttgggcgcggtttcnnattcgccctatag

SEQ ID NO: 632259 - DNA, 120 bp, Homo sapiens
atggtagcggagggtaaatatgctcgtgtgtctacgtctactcctactgtcaatatatggtgtgctcacacgagtaacccctaggaaggcaattgatatcatagctcagaccatacctat

SEQ ID NO: 632260 - DNA, 115 bp, Homo sapiens
ttagagaataaatgggattgcatgaactccactctgagctgaaatacagacggcgggttaatatccttttcttctgatggttattaacaggtccttatgtcgtcagaagatcgag

SEQ ID NO: 632261 - DNA, 908 bp, Homo sapiens
gagaccctcggggccatgcctgggtggggcctgatgtcgggcgtggggcctgcaggtgggcgccccgagcacgacttggcttccttgtgccttaaaaaacctgccttcctgcagccacacacccacccggggttgtcctggggacccaaggggtgggggggtcacaccatgaagagaggcaggtggcctgggcggctcctgcgggatcatgcagctgcgggcgcggcgggcgcggctgcgacaccccaatcccagccctctaatcgatgtcgcggtgattcttctcgcttcagcccgccgcccagtggccttcgccattctgcccccagtggcggtgcatccccggctgttgccagcttgcgcgacctggtctgtccatcctcgtctgtatcatctacttgcgcaggttgcatgcctgtctgtgcctagtcgccctagttgcgcagttgaccaatatgagttctgatctcttttgcccttcagtgtgcggaccgacattcgtttgcatgtcatcgttctgatagccggatgatacaggtggtttgagtgtcccctgtttgcccggggggctgggccctggggtgccgttcgcttgtcttggttccgttgctcattgtccctggcaaggacgtccgttctggagtgcctcccgctggtgcccggcgacccgggtctttgcaccagggtagtccgctgagccctttcttagtacgccccatgagcttccgggaccggcgcggggggggttctgcatccgtccgtccatggctcggatggcgggacactatgcttctgtgtagagccttgaaagtggccaactcgggtcttatgcctaatcgggcgagccccatcctggttcgcgactggggcggccggagggggcgctcggacggcctcacgcccgtcct

SEQ ID NO: 632262 - DNA, 992 bp, Homo sapiens
atgtagcgtggtgcggcctttggtctgattcatcataattcctatatctatagactgaacttaattactcgtcttcgagtaaagcatcgcatcagtcgtctactttatcttgcagtacttatatagctggttgcccgatagactgaatacggctgctttcgagagcctttctcatatgtatcgtcgtcaataaggcatcatgagaggtagaataagccgtagtagaaacttatgcgctggtgccggcagacactacttgtctggtccatcacatcagttctcttcccacttcccaacatccgctaatcaatcttaatgctcaataagaacagaagagtggaaggaatgttcatcacctgtcacaactataacgagcgatcatccttaatgagtgtgttggccctttcaagtgatacagttctcagggtgaacaaattgtgtcaaccttcacataaatacatattcatctaattgttttctctcccaaagaaagtgtcgttactccgtagatcgacactatgtacaataggctcgactcagagatacccgatgtccctgattagcaagggcgtttaaaactgagtaccaagattctcatacatatgctccggataacccaaggtggtggaacaaagggtcgtctctaaacatgtggaggccccagtttctcttatacaagatcgattcattggctagcgatccaggaagctggtgagctggggtaacgtaaccgggtgctctgagcatacggtggacgcgtacaggacggatataatacctagctcagaaggggaatgtggtggtacgccgtattccagcccttgggagtcaggacaggggatcaccaggcagggagtgagacaggcggcacagagggaaccggcctacaaagaagaggggccagatggggagggcaggaacaagaacgggcggagagaaacgtagccggaaaaagaagacaggaagcacgggcacgggaaggaccgcaagga

SEQ ID NO: 632263 - DNA, 1008 bp, Homo sapiens
aatagaagcagcacaatgagagcatctgcggcgagagtaacagcaagggttgcggtcccgtcactgcagagaactcctgtaagaaatggcagcagaaggaaaagggaaatgcctagtcctagtaatgagggcacttccagttaaatgacagggtgtgacttcatacctgctgaggcagagaagcagaattgaatgacgagactcagtcttggtgagcacgtgaggattcctggggccacgttagtggcacagttcttttggaagatacttagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaacagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 632264 - DNA, 249 bp, Homo sapiens
ctaataaaatataatattaaagagcaatgaaaaacaagcgaatggcaaccatatacaacagcatgaatgaatcttaataacattatgttgaattaaaaagtaaataccaaataacaacatatggcatattttctaatgaaattttaaagcaagtataaacaccatatgccttagacgtaatatgtgatataaaattttaagctttataagtgaataataattataaacattcaggacagcatttgcttt

SEQ ID NO: 632265 - DNA, 5181 bp, Homo sapiens
  misc_feature (5173)..(5173): n is a, c, g, or t
  misc_feature (5181)..(5181): n is a, c, g, or t
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtaatgataaccgctacacagctagctagtgacctgaaatatcatgctagctgtgatctaatgagatgatcacaagtgtgtacttctgctgtactgatagctagcgatgtataagncctattan

SEQ ID NO: 632266 - DNA, 804 bp, Homo sapiens
ggaaggaggtggagtgaggagggtgatgttgatatgtgatgaagaatgaggacggaagatgaggagagactcctcggagggcttggatggctgaggactgggcccagggatgtatgtggaggccggtggcagctatcggggcttatgagtgcccaggaaggtaaggccgagtgctctagtctgcatttcctgtgaaggtgtgggaggactctgattcagacgagtgaggaagaggacgatgaggaagaggatgatgaggatgaagtacgaccgatgatgatgtggaggatggtgacgaggtggctggtagaggggcgtcgatggaaggccgtgtactctgactgttggatgtgctcgaagagagtgtcttgagcatcagattcaagatgggatcgtcggggcttggttaaccaggatccgacgagtatggttggagtgatgtgagcatgctactgattggagccgggaatacgcgagaagcaatcggccatggtgacaaggtgtcagggagacacgaatgcgaaagcgggtcatcgagcatggactttgatacacccgcttaggatggtcccaaacctggacccctttacggcagttaggtgaggtccacggctatatccgcctataccgaactgtgggcgcgccgcataacgacccgtcaccattggcgcttcgagacggacggtctatccctcgcaggacagctccccagaactatgttggtctcgtggttcccactaggttagcaatgagagcccccaagtgaagccctcatttagcggcagagtagactttccccccatg

SEQ ID NO: 632267 - DNA, 5195 bp, Homo sapiens
  misc_feature (4964)..(4964): n is a, c, g, or t
  misc_feature (5030)..(5030): n is a, c, g, or t
  misc_feature (5187)..(5187): n is a, c, g, or t
  misc_feature (5195)..(5195): n is a, c, g, or t
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagggtcagactgagcatgctngctctgtacgactgattgtcattcagttcacgacatgttgtgcacttggatattatataggggatnttcaactcttacagatgactgtatacagtgtgctggatctcacgatgataaccgctacacagctagctagtgacctgaaatatcatgctagctgtgatctaatgagatgatcacaagtgtgtacttctgctgtactgatagctagcgatgtataagncctattan

SEQ ID NO: 632268 - DNA, 483 bp, Homo sapiens
ggagacggggtactcaacttcgaaacctggacagaagactaaggactcgggactctccctaggcaggggggtgccatcaaagtatctgaacacagtgacatagaagttttcataaggaagaatctccgggtgaagagaggaagagccggtggtccaaaaggcccaccagaggcatatggtaaataaagccaaatggggtaggagagagaacaagggggaagggagagaaacaagagccagggagaagggaagcaccatcaaaaggggcgggggaggtggggaacaaggaagagtggagggaggacctcggagactagtccaaggcttcagggcgtgggagtcgtggttcagcagagacagaaagggggaagtctgcacaggaagccggcttggtggatgcagagtggggctcgggatatggctcaagttgaaatagggcatcaagtgaaaataaccggcatgtactgggaggccgaagcaggt

SEQ ID NO: 632269 - DNA, 427 bp, Homo sapiens
tttcacgggacaacggatcccgcctaccctgctcctgtcagcaggaacacagctggggggacatgaggccacaacctatttatactgctgggcatttgcccaggtagcctcagggcagatgacaccttagcttcccccatgttgttaagattcctaccagatcatactgactgccacctgactccaagctcagagggacagagaagtccccccggggtaaaattctaaatgcctgggttcagttctcggctccttttgaagctacatttaagctcaaacacttaaggcaattgcctaaaggagttgtgaaggttatgagttattgggacctgtgcctggggcaaagcctccgtagcaaacacccatgcttcctcccaccgggccccacctcaggagttcaggagctggggagcactgaggaatcagc

SEQ ID NO: 632270 - DNA, 4383 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgccgatgaatagcgataggtgccgatgatagcgataggtgccgatgataggaggatctctag

SEQ ID NO: 632271 - DNA, 2251 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagagactctctgggtgtcagcaatgctacatgacagcttctgatacccactgcatatgactattacagattacgcgtgcatcgaaccggtgacagctggtgtgaagccaaccatatatactgcgtgacttttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 632272 - DNA, 4126 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaagaatcactaggagcagggtaagctgtgtggcatcagcgcttgcatcctgcagggagttacctaccagggctgggccgggactggccagaaccttgacagatgaagtttgaccagaccaacagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagcggacatggagcctttccaatggggagaatcgctccctggccagactgcaagctccc

SEQ ID NO: 632273 - DNA, 1703 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagtaagtgcgtggcggacacggggtgcatagagccactttactgtttgatgaactggcggacacggggcgcgtggaaccacttcactgtttgatgaactgagaagaccaagccagtcttcagagcattggagtttggtgtttgtgaattgtgattgtgtcaacagctactggagtgtaactaagaaaacctcaaccagctgcgttgttagcactttttatgttttatgtgttacttttaggagacaaatcacttggaagtaagattttttaaatttaaaataaaaccttcagggtgtgtgatggg

SEQ ID NO: 632274 - DNA, 174 bp, Homo sapiens
ttaatcacgcatgcagctgcccggtggcctagctgaggggctggagtcgtggccctgcatttctgggtagggctggcaatggttgccttaaccctggcgcccggcctgattctttaagctgtttttctttgttgtagagattatcttgtcagctactactaacttgattaatat

SEQ ID NO: 632275 - DNA, 195 bp, Homo sapiens
atatatgaaaagtcttctacacgctttcagagactgtccaacttatgaaacatgaaaccgtaagataattctaaaataaatcctctgtcatactccatgtctctatactggactatggtgctatctactctaccagcctatccaccttgcgctaagtgtcccagtttcaccgtgaacgttcagtgtcacaatcaa

SEQ ID NO: 632276 - DNA, 1994 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagccacagcgagaatgcgctcattactgcgaagatggcaccaagccattcgtgaggaatctgcccccatgacccagacgtctcccacaaggctcacttccaacactggaggttcagtgtcttttttttttttctgaaacggagtttcactctgtcacccatgctggagtgcaggggcacgatctgggcttacggcaatcaagagattctccggtctcagccccctgagtagctgggattacaggcgcccggtacatgcctgggctaattcgggcggttcaggggagatgggcgggtgacccatgtttggctggcggtgggcctttaaatcctgaactctaggggagtcccccactcgggctccccaaggggagaaacacaggggagacacacggtgcacccgaaggtccccgcacaatgggaacggcggggggcaccacatctcggcacgtgggttccccaaaccatatgcgtggtgtagtgccccagcgggagacacaaagcagggctgcacaaaagcaagaggccacccactgtagcgacgatcgccgcataacaacaatacatccaccacacccatactccacctaaaaaacagagcgaggagtgacacaacaacgtggaggggatgagccaaagactaaaataaccagactcgaatagacgaaacaatcgcaactaggagacaagaacgacaggtccacagctatagctactactcgtgtactcgcaccgctcctcgagat

SEQ ID NO: 632277 - DNA, 1421 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccaggtgagagcgtaggcccgtggccacaggccagactttctacggccgattggtcacctgccaagctcttctttttctaaattgagaccatttttcatattaagaatgggatagtatttgagatctgaagaattgggaaaatacactaaaaccagtgttttactggatactag

SEQ ID NO: 632278 - DNA, 1084 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcaccagaggaacaagcccccccgctgaggggggtgtgtgaaatcggacagctcccagcagaggtgtgggagctgcagtgaggg

SEQ ID NO: 632279 - DNA, 135 bp, Homo sapiens
gtaggtgtagctgagggtagaaggagagttagctgacgctcggaaggtgtcttgagattattatccgctgagggtagaagcggcccccgtagacgctcggcaggtgtcttgatagggtacctgcagctcgaattc

SEQ ID NO: 632280 - DNA, 285 bp, Homo sapiens
actcattcagttcatagcctgggtctacctttctattagctcttagtagattacacatgcaagcatcccgtgcattgagttcacccgctaaatcaccacgatcaaaagggacaacgcatcaagcacgcagcaatgctgcctcaaacacgcttagacctaggccacacccgccacgggaaaccagcagctgattaacccttttgcaactaaacgaaagtttcaactacagcatatactaatccccagggcttgggtcaactttccgtgtccagccaacccgccggt

SEQ ID NO: 632281 - DNA, 911 bp, Homo sapiens
  misc_feature (8)..(8): n is a, c, g, or t
  misc_feature (79)..(79): n is a, c, g, or t
  misc_feature (122)..(122): n is a, c, g, or t
  misc_feature (188)..(188): n is a, c, g, or t
  misc_feature (193)..(193): n is a, c, g, or t
  misc_feature (214)..(214): n is a, c, g, or t
  misc_feature (220)..(220): n is a, c, g, or t
  misc_feature (251)..(251): n is a, c, g, or t
  misc_feature (255)..(255): n is a, c, g, or t
  misc_feature (257)..(257): n is a, c, g, or t
  misc_feature (262)..(262): n is a, c, g, or t
  misc_feature (265)..(266): n is a, c, g, or t
  misc_feature (349)..(349): n is a, c, g, or t
  misc_feature (358)..(358): n is a, c, g, or t
  misc_feature (524)..(524): n is a, c, g, or t
  misc_feature (544)..(545): n is a, c, g, or t
  misc_feature (576)..(576): n is a, c, g, or t
  misc_feature (585)..(585): n is a, c, g, or t
  misc_feature (612)..(612): n is a, c, g, or t
  misc_feature (628)..(628): n is a, c, g, or t
  misc_feature (630)..(630): n is a, c, g, or t
  misc_feature (641)..(641): n is a, c, g, or t
  misc_feature (644)..(644): n is a, c, g, or t
  misc_feature (660)..(660): n is a, c, g, or t
  misc_feature (683)..(684): n is a, c, g, or t
  misc_feature (691)..(691): n is a, c, g, or t
  misc_feature (694)..(695): n is a, c, g, or t
  misc_feature (698)..(698): n is a, c, g, or t
  misc_feature (724)..(724): n is a, c, g, or t
  misc_feature (733)..(733): n is a, c, g, or t
  misc_feature (746)..(746): n is a, c, g, or t
  misc_feature (767)..(767): n is a, c, g, or t
  misc_feature (772)..(772): n is a, c, g, or t
  misc_feature (775)..(775): n is a, c, g, or t
  misc_feature (782)..(782): n is a, c, g, or t
  misc_feature (784)..(784): n is a, c, g, or t
  misc_feature (788)..(788): n is a, c, g, or t
  misc_feature (794)..(795): n is a, c, g, or t
  misc_feature (797)..(797): n is a, c, g, or t
  misc_feature (801)..(801): n is a, c, g, or t
  misc_feature (809)..(809): n is a, c, g, or t
  misc_feature (837)..(837): n is a, c, g, or t
  misc_feature (842)..(842): n is a, c, g, or t
  misc_feature (867)..(867): n is a, c, g, or t
cacccagntagcagataggactaagctctgtctttcagccttcacttactcagaaataactcatatctcaacactcagnaagccccaagcagtagaatgaggcttccctggaaagaggctgngactcacaggctggggatttaagaccctctcaccgtccgaccttccttccttctttggtcttgggngatgngaggctccatttttaaagggnggagancagcagatcccctgctactgtgagacaagcnaganangtganttnnggccagactcactatggggtcaccccaaacagcttcagatcaaaaagcctgccttgctgtgatgcccattgacagtggctgcnaaatataangggggggccacagggtctctggctttatttccacagggtagggagaagaccctgcagaaggctaggcagagggcgccagccgcggaatttcccagcttttctggttctcagcagaccaacgtggtctctaatcagaaagacgaagaggcaggagagcactggcctnagatatcccccaaaaaaaanncttgcactgtgggccagggctgctgtgagcnaggaggccngggttccagaggggctcactaggtccngcgggaggctttcccngncctccctcatncgncgccgggctcgacggnaggcctctagcacattgtgaatnnaactctnctnnctnaacccttccagacggtccaacacacnccgcatccntttctgaaggganctcgattccatgaaggccctngactnctncagacantncaanctgaanntnacantgcctgtngtctctgtgcggatccaaagcggctcangcgtncccctttgaaggatcctggtatccntacataggagaggtctccaattccagagaacgccaatgaaaacc

SEQ ID NO: 632282 - DNA, 174 bp, Homo sapiens
caggttactggaatggtacaaagtatccttaataaatggcctttggtttggaaatatatcagggactttcagtcattgggactatacacacacgaccccttttttctagaacatctacaacaaaagccaatccaatcaattgtttggtctctttcaaacacgcaccttcacttc

SEQ ID NO: 632283 - DNA, 1191 bp, Homo sapiens
ggaagcgcctcttcacggcactgggatccgcatctgcctgggatcatcaagccctagaagctgggtttcatttacaattagggctgccgtatttctgtttctccctgggctgcggaaagcccagaagattttatctcagcttcataccacaggctgctggtgttccctctttttttccacgagggtgtttatggctgcaattgcatgaacatcccaatggtgtcagaccagtggcgatggcatctaggagtttaccaactgagcaccatttttccaatttcttctcttgtccatccttgcctggggcactgcacaaacgcttctgtgcagacttgcatcacatagctcctctggtgccaagtgtggtagctcattgcaccaaccaacacatcgcagccaagctcatggcatctcagtgcacacaagcccatttgcatgtcatgcgggtccagccagcacagcaagtgggcaggtcctccaaagcagccaacatccaccagcaacctcaatcagcagcaacacaattcccccagcatgcgcagcagggcagcacacaatcttgctgcaagaccactgtgcccagtccgtgcagcccagcttggcccccagtttccaagtgccacgagctgccacgaactgggggcatcacacaccaccctggcagcaaccaacacagaaccaacacgggggcaacaacgatcagaccccccacagaccacagaccgaggcaatcagcaagaggcttcaagggaaccacaagcccgcaattagacactaggaccctcattggccccccacccggcgaaagaacaactggtgacatcggctggccgattagattgcacaacctggggaccaccaagacacgggaccgccaacccacctcgggttgacactacggcgagaacacgccaaaccctacaggcccaatctacaacacgaagacagaccaacccacccaacacaagcccaaaccgcggcacactcgcacgccacgaccgcaagaccgcgcacagcaccgtcgcacacaaccccatggcgcaaacacagaggcaccaagcaccacccgcacctcatgacccccggaatacctacacatcactcacccactgcacacacagatcacagaaaacaaacaggccgactgggacggaacacaaaccgacacaaacaaatgcagagacagacaac

SEQ ID NO: 632284 - DNA, 310 bp, Homo sapiens
  misc_feature (23)..(24): n is a, c, g, or t
  misc_feature (29)..(29): n is a, c, g, or t
gggggccgcctggctgaaagaanngaaanccccgagtttcgagatttaactagtacatctctggtcgttggacataccaagtgacaaacacctaaaagcgccgccggacctacgagctcaggtcggattaacccatacatgagctctccctgccacattgaggatgatccttacggaaaaggaacagattggtcctaaaccaaaaggaggaagttgcccaaaagaaaaagatttcccaaaagaaactgaagaaacaaaaacttatgggcacgggagtaaaatcagcattaaaaaaaatggtattaaaagg

SEQ ID NO: 632285 - DNA, 407 bp, Homo sapiens
tttgttgtttccttgagaatggagttgctctgttgcccaggctggagtgcaatggcaccatctcagctcactgtaacctccacctcccagtttcaaccaattctcctgcctcagcctcccaagtagtgggattacaggcttgcgccgccacgcccggctaatttttttttttttggtttttttattaaagatgggtttcctcattttgatcaggctgttcttgaactcccgaacctcaggtattctgcccgcctcggcctcccaaagtgctgggatttacagttgtgagccacatatgcccagctaaattttttaccctttttttcctatcggtttctaaatctcctcaacccaaacaatacaagagttttcgtgcactttcatttctttttgcgccccgctttacc

SEQ ID NO: 632286 - DNA, 187 bp, Homo sapiens
gtgcggtcgacttaagatcccctatgccgcgtgtctgcgatcctcgacgaacgaaactggctggcctggccaaagacgccctggcgaacgacattcacatcgtgccggctgatatcaaccacagctctcaccgctatgagaatggcttcgatgctgcccggggtcaaaagattctgtacgcaccgtt

SEQ ID NO: 632287 - DNA, 281 bp, Homo sapiens
  misc_feature (53)..(53): n is a, c, g, or t
cctcggtaccagcaatcgaggacatgagagatggtatgtcccccacccccttncctcaccatactcaagtcttgcacctaaggtcttaaatcatctgctttaccatgaactgattactgaaactatccatgtgtgtgtatcattgtacggctgagagagaaaaagagtcatcttaggtaagatgagtgaatcatgggacaacagtggagctggtggctgaatactctctggattgccaattagaacagttgaagaatacatctgtcctcgattgtgctggt

SEQ ID NO: 632288 - DNA, 522 bp, Homo sapiens
cgtatccctccctagggtgaccagagtaaacccactatggtattcccttcatttagcacataccttcgcacatagtctttctataaaactctactcacattatccagtcggcatgcacatctcattccttcacagaattgtattgagagttaactgcgaaaatactgtattattattattagaatgacctataatttctgtccaaactgagaaacttttgaggctgggaacagggggtttgtgctgatcgtaatgatgtcaggacaataggaaaaacaaggacttatggccaccccagctattattgccagtacactctgctttagacatattaagcaatcaagaagtggtcgtactatcacgcttctgtcactagactgtgaatgtctcaaggtaagagtgcttttttgtctattagcttctgtcacatggtctggtatattcaatacattttgagtaggagatgagggtaaagactaggaaatgactaatttttatagacatactaaggtaatgcagagt

SEQ ID NO: 632289 - DNA, 158 bp, Homo sapiens
gtcgctctagaggatctctgtggagacgggtctcacattgctagtgctaagcaagccctactgtgaaggcagagacaagaggatcactgtgctttgataaacctgtctgatgcagtgccctcgggaaaggacttgtaagtatatgcaccattcgctgg

SEQ ID NO: 632290 - DNA, 750 bp, Homo sapiens
gactccctgtgagtgttgtgactatgaaggcagtggctccactgctgggtccttgaggctcccttaattcctcaagtagtggtggtgagcaggactatgattacctgaacgactggggggcacgtgttcaagaaacgttgcgtgacatgtatggtggaggtgatgacttgaacttcagggtgaactggttggtggacgagtacgaacaatttcaacgtgatattcccaataagcatgcgagaagctaggctttagacttatgtagtctactagcgcagtgcttgttggaggtttggataggctgcaaatcaatttgggctcagagggagatatcagtgatccattactgtttggaaaagcactgagctcagttactacttgaattttactagtaggagaagcactgggatattagtgtgcctttttgtaccttttgcagattggaatgagtttgctgtttaaggctttaatggtactgatttctgagacgataagtacactacgacaagaatattggtggtgggagcagtaagttaaaggcattgatatgcttgcaacggcgcttttgtgacagtgcggtttgcttttatgagagtacacaatttaaaaactaaaaaagttctgcaggattgattaatctgggggatgagacgtgagatggcaatgtacatacttctagttagagttgatgcctggtttcgtactaaatttaaatctaccgggggggcaaagggggttcttttcccattg

SEQ ID NO: 632291 - DNA, 276 bp, Homo sapiens
ggctggagtatatagtggcacaatcttggctcactgcaacctctacctcccgggttcaagcaattctcctgcctcagcctcctgagtagctgggattacaggcatgagccactgtgcccggcctattaagcccattaggtccattttacagacgggagagcagagacctgatgcctgaggtgggaggattgcttgatctcaggaagttgaagctgcagtaagctctgatcatgccactgcattccaacctggacaacagagctatactctgtctca

SEQ ID NO: 632292 - DNA, 271 bp, Homo sapiens
atgcacatcttactatatatcatgctcagagtgcaacatcattcttcttaaaggtaagcattactcgttataatgggcatgttatccactgagagacagtcctctgaactatttgcattaatgactctgcttcatttgatcatcggtagtatctatggagtcaaataatattgtgtcaacaggttagtttatcctctggttactgcatatgtcatcaaatactgcaaggccatctttctatgcaatatagttgtactggtgtgtagtttct

SEQ ID NO: 632293 - DNA, 337 bp, Homo sapiens
accgttgcctcagcccaccacctccagaccggaagcctcccctcgctgctgccttaggtgaggctgagccgccgggccctgtggatgccactgacctccccaaagtccagattccccctccggccacccggccctgtgcacagccacgcgtgcaaccggccgcacccctccagctaatgacgggatgtcaacagtcctacatgtctggagagggctaccagagcctgcagtccatgatgaagaccgagggaccctccctacggtgccctgccccccgcctacggccacctgcacacctgcctaccacccccatgtctacccggcccaacccgccccc

SEQ ID NO: 632294 - DNA, 413 bp, Homo sapiens
catcgtacacccctcttaccgaagacataacttgttacgtatgtactcgtgagtcctagtatataatgtctggcctgagaaccacagaaaggactagatattcatacatgcgagagaacactgagactgcctgttaatttgggaataatgttagaaaaaaagtccgcaaagaactgccagaaccaggcctgtaaccaagtttacggtcatctagtttctctcacaatttcaaaatgtcacatcagaaaaatctttggcgattaatccaatctccatttaatgcgtaaaaaaaccaaggccctaagtggatgtccctggtccaagtccagtgcctttcacaatagggctttgggacgtctaacccctctaaattggggcagatggctaactgtggggaaaggggggaaccctcc

SEQ ID NO: 632295 - DNA, 617 bp, Homo sapiens
taggcccaccgccgccgcggcctagttaccatcacaccccggtgaggagccgcagtctgcctgtagccggccccagtcaccatcacctgcaaccatgagcagcgaggccgagacccagcagcgcgccgagacccccgaccggccgagggcgcgccttcatgcgaccgagcgagcgaccaattctcctgtcaagctatcgcgccgatgcgagcagacgcgtggacgctgcgtggtgctcgtgcgggctctcggcattgtggcgcgtggtactgggcgttgctgagtccatcacggagtcagctcgcgaccaagggtgctggtgatcaagcctctcagagggtatcaacgccggggcgcactcgtcgagtatgcgtcttcggtcttcggggcacgcgtgatatgccaatagccgcaaaacgaggcaaaagtactgcattctatggcaacacgagggagctactcgtaccttataggaaatgaacttcagcgcaggccgcgcaaagaagattacgactggagtgacggcttattaaaggaaggacatcccctagcagcagcgaggaacagcgcgaagcccgccagaaaaggaacccatcaaggaagtttgagctgccgcg

SEQ ID NO: 632296 - DNA, 445 bp, Homo sapiens
  misc_feature (99)..(99): n is a, c, g, or t
  misc_feature (104)..(105): n is a, c, g, or t
gatttcatttctagatatgaaacagtttctacatcagctggtgatcgatatgattccttgctgagtcgctctggattatgggccgcagacgccgcctcntggtnnaacagtaatctacctctgccgataacctgtttaaaatgactcagcagaacaccgcgtttcattctattggtcaattccatgtggctgactaggtcaattttttttttgaacaaaagcaggtttttatatgtaaacagtgagaaaagaaaggctaaacactatgtaaatgtaaatggaaacttgtctatactggtttttataatctacaaaaacttttctttgtttatcgggaaatccatatttaatttgtaatatactctcaagcctgttgacctcctcatctattgtcctaattgtatgttttatgatttgatttatgtctttagacagtaacttttga

SEQ ID NO: 632297 - DNA, 447 bp, Homo sapiens
acctctttgctcccagattcgcaaagcagttcttagtgacccacagagactcccacacaataatagtgggagactttaacacccaactgacaaatattagatcatcaagacagaaaattaataaagacattcatgacctgaactcagctctggatcacttggacctgatagatagccacagaattctccacccaaattcaacataatatacattcttctcattgctgctcggcacttactctaaaatggatcacataatcggaagtaaaacacatctcagcaaatgcagaagagctgaaatcataacaaacagtctcttagaccacagagcagtcatatttgaactcaagattaagaaattcactcaaaaccacacaactacatggaaattgaacaacctgcccctgaatgactcttggttaactaatgacattaatgagaacaaag

SEQ ID NO: 632298 - DNA, 837 bp, Homo sapiens
catcataattgtggtttccaatcccagatgggacattcttacgtatgttacctggaaactaagctggattacccaaagcaccgtgtgattggaagtggatgtatctggattctgctatatttcgctagcttatggctgaaacatacttgtgctttcatcccacgtcacctgccattggatggtatttcgggggaacatggcgactcaaatgtggctgctgctggagtggatgctgaatgtggcaagggtgatttctcgtccaggaattgaatccaggaaatggagacaaccgtgacaactgatatgtgaataccattggtagaacggaatgtgcactagatgagtggcttggtttgcacaagctcgccttattttaatgtctatgctaagtctacagagatggcatattaccagctaggagctgattggcattacgttgtggctggatctttatttggaactccagtgtttggaaaaaactctgatccgaggcatttctatcccgatgtcgaagcgaactcgtgtaatacggggtatgtattgtgccatgttgatgcacatgtacatgatctgtccttgtaagccctatgcgcatagtatccttcgaaactgccctggggcatttaaccatgcgtttatctaaccaagacacgcttaacggcatgatgaaggttgctcagttccacgaaaagtgcagataccctgtgggacattcagagggcaccctttgagacctgtgaatagtgagctctaggctgtgcaagagtttaccttcatgtcttgatccagctttagtttcctcctgtcttgctcaggcgtgaccctccactgtccttg

SEQ ID NO: 632299 - DNA, 241 bp, Homo sapiens
ggtttagggttatagatgtgaactggagttggttgaggagagattgcaagataagatcaggagagtcttaccatgatgggaagcagcccacctgcacccactcttgaagtcatgtcatcttgctccttctcttccaatgtcctccatactttgatgactcctcaatttgtatcttcaagcctgacttctctgctggactacagactcctatttccggcttgctgaatcttttccaactctt

SEQ ID NO: 632300 - DNA, 819 bp, Homo sapiens
tggaataaaagatttattttttttcctcaggaaaaacagaaagttagggaaacacactacattggacaaccaacattaattggtagtgggtcctaacccttccgggcacagctatcaaaagtacagctggtttaaccagaaccaagggtgttcaccccccacagaaggtacatgaaacactagaggactggcatgtttttccctgagagaagcgtaagacaaacagaatgtcaaaaagtagtcacggggagcgccatccttctaagcaaatcctccctttccctttggggaggattggcccgaactacgtagccagtcagcacttagaccacgcgggcctcctcctccccctataaacccaccattcccctcctcctttcccaaaccactgggggtgtcctaaagccctcattggccccaagcccaaaattatcaactaagatcctggtctggtattcccacagtcatacctaatgaatggggaagtgggggcccctaaaaaccaattcacatctatgcactggtttccactgggattgggcagacagggctttttaagttaccgtaaccagatcttaaggattatttaaaaactacataaagggctttaaggtccttagagatacttgatataaataaggggcttatgatcaagaaggataaatacttaggtaaaaatagctctagcaaagatgaccttagggctctgagaatgggcaggcagggcagttcttccccattacattctaagtcatcttatgcatacctattttaaatgggagtccacagacctaagggtcatgtcccggagaagaacta

SEQ ID NO: 632301 - DNA, 351 bp, Homo sapiens
gccattatgtgccaggtatacactgcctcaaatattacatattagacagagtttacagggcacattaccgttccatcattacaagtgatgaagaacaaatgaattgcaaggagtatgcaaatcataaatatacagatcttaccacttacactaaccaagtacctacttttcagtgttacttacaaatttatgcacgaaacctcctgctaagctgaatctgagtagaatatgctatatattttaaaatagctatttctcatttttagacaagccaaatacccaaccatcaaaattatggaatagatagaattgtcacagtccattacagttatgtgttgctacccacagggt

SEQ ID NO: 632302 - DNA, 394 bp, Homo sapiens
attcgcggccgcgtcgacctgtttcatgaacaagtgtgtggttcaaatttgtactagcttcaaaatcttcaatgttcaggaatatccaaaataagaaattaacataaatatgctcctgtaccagtgataattctggacacccatgaatgggaacatgcagtgtttggttttttgtccttgtgatagtttgctgagaatgatggtttccagcttcatccatgtcccatgatgggaagcagcccacctgcacccactcttgaagtcatgtcatcttgctccttctcttccaatgtcctccatactttgatgactcctcaatttgtatcttcaagcctgacttctctgctggactacagactcctatttccggcttgctgaatcttttccaactctt

SEQ ID NO: 632303 - DNA, 309 bp, Homo sapiens
  misc_feature (163)..(163): n is a, c, g, or t
tcggcaccgactttattcaaagaccacggggtgtacgggtacagtgaaggggaggagtgggctggtgtggtgagtgcccaaggggcaagaagcattgccaccgagtgctccagcttaacggtattttggaggtcagcacggtgctcacagaagccaggaactngtccagggaggcgtgcaccgcaggggtgaactcggcggggaggtgaggcgaccagggatcaccagcaggcagtgaggttaggagcgtgaagcttgaccgggtccacccgaggcatgtgcgcgtgcaggtcgactcagggcggacag

SEQ ID NO: 632304 - DNA, 303 bp, Homo sapiens
ttgcaaaaaagtggcgcaccaaagatacaagatagcgattttaaatatttaaatactcatcgtgaaggttatccaaataaacaagttgatgtgttaaatatctttggtaatttacaagatggtagtaattcagatggcgatgtcacagtagtctctgccaaatctctcaagtatttactacgagacaggtacaagcattatcaagaactagagatatcaggcaaaaaaggacagcatagccagttgcatgaaaatgcgagagttgatcgtgctattggtgagttcttgtggccaatagtagag

SEQ ID NO: 632305 - DNA, 381 bp, Homo sapiens
aacggatagctgggcaccaaacggtggggacacaggcatgagccaccatgcctggccagctagggtctttggtctaagtgatatagctcccttgaaggaactgacatttggtagttcctggaagtccatccatagtagttcgcgttcagctttagaacaaaaatctgtcttttttttggagacagggcttggctctggtggcccaggctggagtgcaagggtacaatctcggctctctgcaacctccacctccggggttcgggtgattctcctgcctcagcctcccaagcagctgagataacaggcatacgccaccatgcccggctaatctttggtatttagtagagatagggttccaccacgtcggccgaagctggatca

SEQ ID NO: 632306 - DNA, 125 bp, Homo sapiens
  misc_feature (90)..(90): n is a, c, g, or t
atccttagatgtgcggacgatcaccaggtacatacactgatcatcttctcatacctttgtttccagcatttagggaattattcgtccacncagtctgtcgtagtgtgtcctgatatcatccagac

SEQ ID NO: 632307 - DNA, 280 bp, Homo sapiens
gacgttttgaggcaatgggagcggcccttgcccaagttgctcagctcttggagtactgcctctggagcgattcccggtagaaacggaagacgtgttgcgaagcggactgggccgaagacaggcactgctggagctcagtgtctgagtagagccccttggtgctggacatcagcagcttccgttccacgctgtccagggcaaaggtcaggactgcccgggcctccttttcttgcttggctgtaggatccagcacgagtgtcccatcagagtccagggcgca

SEQ ID NO: 632308 - DNA, 759 bp, Homo sapiens
atgcgggtgctccgacggacccagcccggcggctgcagcccgccctgcccgcgcggtcctcgtgtccaccatgcagcagggaggaagacaggcaatccatccggtctgtcctgacgcaatgagatggccgagccagagccactgagggcatatgggacattcattgcatttacttggtactgtgacgtgtgactctgcgagcgtgtcttagcagacggcaggccgcctgatccttgtggacggaacgagcgcagtcctacagtgccgtgtcggtgcggtgcttcgcttggcgctgggcataacgagtgcacgtgcctgtgactggacagctcacaccatcgggtgggcacaagacaagacccgggagctggaggttgccagtggtagactcctggcgtttgcgcttggtacgtgcactcaaaggatgccttagagattgggtgtcaccccagggacccaattcaagcgcacctgtaccacatgccctggcgaaacccaccaggaattattacaaccagtccaaaacagatcattacacaagttcgttatcatacccatttggacgcaggaaacagccgggaaagaatttccgcacactgaacactgacctgtggacgcccttcaaaatgtggcctccaaccacgtaacggcgaacgctccatatacacagcacaacatacgcccagacagaacaaccatgacagaagtataggcaatcaagcaagacaagcacgaaagaaccagtagagagacgaatag

SEQ ID NO: 632309 - DNA, 261 bp, Homo sapiens
cgccggcgcgtgctgtgggtgcctgctctcgcacgtcagctgacgcgggagctaccctctgtagctgagaacggcgcgtttattgctacacgagactctattgacagtggcaggttcagcggtagcggcttcatgcggtctatagctgttgcttcctgatgaggctactcgcatgcgtgcctaggactggtgtaagcactgagcctctagcaggaggcatggctcgaagacggagtctgcgccgggcgtgctagagccgtg

SEQ ID NO: 632310 - DNA, 421 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagaactttgaactatcaccattggcagcaccctcagatgcagttatctaaagttctttcataaattattcattcaacaactattaccaggatctgcctcagcc

SEQ ID NO: 632311 - DNA, 1121 bp, Homo sapiens
agcggaccacagttgcaacctgcagaggcccggagaacacaacctcccgagaagcccaggtccagagccaaacccgtcactgaccccccagacccagtgtcgcccagccactccccagcgactaccatggccgaagcacgcagacatgcgcatgcgctggaggagatgcatgcgacagggctgaccagttggctgatgagtcgctggaaagcacccgtcgtatgctgcaactggttgaagagagtaaagatgctggtatcaggacttcggctcatgttggctgacacaaggagaacaactcgcatcgtgtcgcaatcaaggcatgcaacccatcatccaaacgaagaacgatgaaggcaggctcgcagcaagcacttctacacaagcatttcagggcaaatgctgatggccttttcatcatgtccttgtcaacacagcttaaatcaagttgatgcttaacaaacaaatgccctggtgggcacatacatcacggaccggcagtggctgcggccaggcccaacggcgcttgctaacgttgtaaagtgcgacagcacacaggggagccagatgcgccatcaagcttggcgcgcgcatttcatcccgcagcggtaaccagagatagatgccccggaagaacacatggacacactgggcatcgaaaacaccgcctacaaaggcaagggcgacgacggcggcactccatccggcgaacaccacaaccacggcacacacctaggcacccctgcgacatatggggcaacagagaacgacatcgaacgagcacaacgacacgtccggcccacgcactccgacacagggacatccatcggacgcaaacggctcagacaacgcggaagcgacaccgaagcgcaaggacacgaccgaaaggaacgggcgaccacacccaccaacaggtgcaaccccaagagggaatggactggggacgaacgcgggcggaacagatggatgaccccgccccacgggagtgccacgcccacgagcaaagtcacggccagcggacaagaaaacgcgcaggagcaagcacagaccagcaggacaagcacataagaacgcaaagcacacaccccaagcccacgcaggcccgacgaacccacccaggg

SEQ ID NO: 632312 - DNA, 326 bp, Homo sapiens
aaatccaactgggaaccaaaaagggggggttttgggcaaagggccctgggcccccccccctccaccctggggtggggccccggtggctaaagcccctttccctggggcccccccccacaaaatggggggccgcccccccgcccggctggggttttcccccaaccccctttaatggggggggaaaaagaggaaaggggggggggcccccccccccccccggggtttggggggggcccgccccccaggggttttcccctccccggggggcctttcccccgcccctttggttaaatccaacccggattaaaccccccggtttttttgga

SEQ ID NO: 632313 - DNA, 196 bp, Homo sapiens
  misc_feature (122)..(123): n is a, c, g, or t
  misc_feature (127)..(127): n is a, c, g, or t
  misc_feature (133)..(133): n is a, c, g, or t
tatttcgcccagtaagccaatccctttattgactcctagccgcagacctcctcattttaacttgaatggaaggacaaccagtaagctacccttttaccatcattggacaagaagcatccgtnntatncttccncaccaatccaatcctaataccaactatctccctaattgaaaacaaaatactcaaatgggccta

SEQ ID NO: 632314 - DNA, 149 bp, Homo sapiens
gaggtgagtctagaggatcccgtcttggtttcctgcacttccacaactcattacagatttaagaaaattacccctccaccgctgcggttgctcatgcctgtaatccgacactttgggaggccaaggtgggtggatcatgaagtgcaggt

SEQ ID NO: 632315 - DNA, 157 bp, Homo sapiens
gtatattatcatggaccagtttctttatacaatgctaaaacatgaaaaccagatagagcgttaccatcaaggtatgatctagtaatacaataaactacaaggatcaagactgtagctatggaatatgtgtaatgcgatttactggccatgtaatcaa

SEQ ID NO: 632316 - DNA, 852 bp, Homo sapiens
ctgtggggaatcatcgtctgacatgtgattggggtgccacccagtgtgtgcccaatttgagaggtgtgggtgattgttaaggagcacgtgccgcacgttcccggcatcccgttatcccgggacctggacccatgtttgtgtggccggcgtccctaggggcatacacccgcccaggcgtgttgtgctcccacgcagctggttgacactccgatgatctttccgggcacgtacgtctcttgcaaacttcactgccgccgtctccccccatctattgagccccatgtgttcctgggcggtggttcctggaaccactggatggttcccccagcctccccccgggttggcacaagtttgaggcccggttcttccctttggcccttgaagaagagtttggaagagtccagggtcacctttggacctttcaacccgtgttgccttccctcctgatggccaagatgcttcactcactcggcggcgaagatggttacgtccgtaatcccttacttcgagccccccgtacttcgaatttgagtgttgaggcttatagaagctggatctcctgccggggcgtggtggctcatgcctgtaatccccccacctttttttttaaggcacggcggagtcaccctgaggtcacaggagtttaagacccgcctgacccacactggagaaacctcgtctctatcttaaaataccaaaattagccaggcatggtggcacacgcctatagtcccagctactcaggaggctgaggcaggagaatcacttgaaccccggaggcagaggttgcagtgagctgagatcacgtcattgcactccatcctgagccacaagagccaaactccgtttcca

SEQ ID NO: 632317 - DNA, 1020 bp, Homo sapiens
  misc_feature (327)..(327): n is a, c, g, or t
  misc_feature (602)..(602): n is a, c, g, or t
  misc_feature (607)..(607): n is a, c, g, or t
  misc_feature (628)..(628): n is a, c, g, or t
  misc_feature (669)..(669): n is a, c, g, or t
  misc_feature (766)..(766): n is a, c, g, or t
  misc_feature (768)..(768): n is a, c, g, or t
gtgaaactacgatatacccattagctagctgatgccaggtaactgaacagactgattccaatgtctatcagacacgtcgatggcggaactcaaaggtaggcatgccaaggttcaagcctcgagagactgagcgtatccgacatgtacacatcagagtcatagctcgctggctagctgtagctggattgatgccgtcatgagaaaggagacatgatgataggaaaaaaaatccactttgttaactgtatctgtggtgttctcttcaatgcaacttagagctcatgccccttttctggctttgctgttgattctggatggtcagagaantattcactgatggagacctttaccttttgtgccgccgcgagtctctatagcacatcacctatctcatcattactacttgagttgaattctctgaaaggacaaacggttcatgtgctatgtgtcctgtttagatcaaagtagtcttcatatataatatgtgttacatatattgctgtagactctcagaaatcagggtagagcttttcctttgagcagtttaatgagtgaattcagcagcaaagtcgcaagaaatggttctccagccaggagaggtnatgtntatcctctgattgcccgtttnctctgcacacagtgatatcgtattcagtgagaggtgctgtnggcaccagcagcaccctgggcacacagcatttcatgtcatgtcacagtgtacaagctaccctctaattcagaaagaagagcattttgcacagagaanantagataagatccactgaagtgtcatctctctatctctaattcttcagtcggttgatgttggaatgtgagtccttgtcatgaacttgtaaaccaatcttggcaagatacaagtgtttagagaaaggcaactacaatgaacctcttgttcgtcctgttttggaatgctgaagttcctcaatggatcctatggctaatactaggggaagcaagcttcccataggtttctttttacacactgcagggtatcttata

SEQ ID NO: 632318 - DNA, 196 bp, Homo sapiens
  misc_feature (177)..(177): n is a, c, g, or t
tgctgggattacaagcatgagccaccacgcctggcctgttatgtttttaaatgagctgaacttacttgtttgtataatcacacaattaaaagctattggtatttggtgaaaaagaaaaaatctatttgttttccaaatcatgtgtcctgatattcaattcagcatatggtggacatntattaggagtgcaacagac

SEQ ID NO: 632319 - DNA, 1244 bp, Homo sapiens
gtctgcgctcctgctgctggcggggcctggaggctgctggcgtgctgtccgatgccccccgtggaccctccaggtcaggccatgccgataaggggctcctggtgaaacggcccggaagacgaaggcaattcaggcccagtaaactgcgagaactcggccaaggtgaaaggtgcccaagtcggcactgggtaagttcgaggcaaggggctgaacagtgctgtcctccgagtgctgggacctgtcgccccagaggaggtggcgcttgaggcagggcttgaagcgttcgcccggtattgctagacctactgtgtgccaggcgcggagcggggcccttggacatacgaaggtgacagaacaacgccaacgtacctggtcctacgtggactacggccctagttgggcgagagaagcatcaaaaggaatatcaaagccagatgtgtacatagctaacgtgcatttgaaagcctatgagttacaagacctacggttactctgatggggacttaggccaagtcacgcctactctgaggaagcgacatttcagccgagagctgaaggatgtataagagtgagctaggtgaacagtacggagaatattctaggaaagactagtaatgtgcaacaggtccttgagttcgcaacaggacgtagatgcctttgagcactttgacaaaataaaggcaggtaaaagagtgactagtgaatgaggatccaagcattgacattaaacacttcaagtaaaaactatcatgtaacgagagaactgaatactacagagactgacaaccacttacggcgacgatagaaacgataaagtagacccaaagacggcagaaaaataacaaatcacacacgaatgacaacaatacaaagacagagggacctctaccacggtgaaacaggacagtgagatatccacagacaataagaaataacgcaacaaggcacatcatatcacacaaagcaagatagaaagcgaagctcatagaagcacgggaggaaggaaatataagcaaggacgaacacacgaagacatggctgagcgactagaacaacaagagaggaagaagaaaaggaggagacgaaagaactccatcaacacaataagaaaagtaacagatatatgatacatataaatagacaatgagctagactgaaagaaagagataagtagataggaagaaaacgaacgcaatcctatatcaaagacacgatcatgaaatcgcactatcagttaacgatag

SEQ ID NO: 632320 - DNA, 271 bp, Homo sapiens
ttccccgcgcgcgttgcgcgctgtaggcgccaacccctcgtatcacccgaggcctgtgggaggtgctctagcgtgacgtctccattccagtcctccttccctgttcccatggtccttacgtagagagaccagctgtccttactcaccaaggctccagggtcccagttagcgtactcatgcctgccccaagtatgcatgaggcggtacaccgcgacgggcaaggtctggggcctatgggcgcctaccgtgagcccgggatttctgagcttag

SEQ ID NO: 632321 - DNA, 254 bp, Homo sapiens
ggttgggaagacacacattccttgtgaatcaatctgagaagaggaaatatatgccctctaacttcagattccaaaaacttcaatgtcctattgggcggtcctttctgacttagacatttccccctgctttttagaggggttgatggctgaatacagacagcagattgtttttgctattgctgaaaacttgtttaaatgaaggagatttatgaggagaaacattagacactacacgagtgagacaacattatgta

SEQ ID NO: 632322 - DNA, 567 bp, Homo sapiens
  misc_feature (513)..(513): n is a, c, g, or t
  misc_feature (523)..(523): n is a, c, g, or t
  misc_feature (552)..(552): n is a, c, g, or t
tccatgaagctgttgattctgtttttctgttcctccagatgtctacacttttacctctgcttgcctgatacaaccaccaccagtcacctcacagaataactcactccttaagaatctgatcaggaatcagccttccctgatcacaaacactgagtttagaagtccctccacagtgtcccccgtaaccctgtgctacctcactgcctcatagtttagtgccgtttgtgtacatgcctatcttcgtccatggatccagaacaacttgtaaaaatgactgtacttatcaccttcagtattcaatgactaaactataattttaacatatctggcagaatgaatcacttggggatttctgccaacactaccaatatattactcctaatttgtaattattacttagcatggattatagtaccggctgttggagagccaatgtggcagaccctaagtggaataaaatgtcagtagcagtctaggagcatatatttattggaatagatcattcattcattngttcattaantaatttgttcattaaataaacatttattnagcaaaaaaaaaaaa

SEQ ID NO: 632323 - DNA, 95 bp, Homo sapiens
cactctgcccagttcctggcctggttgatgcagcttccaaggggagggctgcgtgatcttggcccttcaagaagccttggctaatcccctagagg

SEQ ID NO: 632324 - DNA, 465 bp, Homo sapiens
actttatttaagggccaacgatctatggccgcttgtctcaggagggaaacatgggataggagagccaagggtggtttgctcgccagagcatatcatcacccagggatgaagcccaggatccacatgctattcttcctgatgctatctatgtggagctgcctgtcatcaacaggccctagcgtgagtggatcccgaccatgagcccatgggttctcatcatacagctcccagaaggtctccatcatacacgaaatgggggagatatgtacaatggcactccatgtattcattaccccatctagtagaattataagcagatggccaatctggttcaattgattatctcttgattccccactttcagattaccagatctaattgtgaacgagtgcatatagatgacatgattctattcagaaacactagtgatcattatgagttcacatagggaatcttcatacatag

SEQ ID NO: 632325 - DNA, 1115 bp, Homo sapiens
tggctgggttttgggatagcccggcttagaaaaccccacaaatgggagaaacaggctaccgacatgatcttgtgaaggagggaaatattttcccttgggtgggaaagcaagcgcaacatgttgaaaggagacagcgtttatatgacaagcccgccttgggaattggccaatggcggcctcctttcacgccggttcttcgagactaaggtcctcaacagtgggcagcctcttacggagttttcagacaaagggccgcacgagtgcgttcgcctagggctgcccctcctaattccgaccgcgattttccacaaaggggggaaaaaccgtcttggttcgttcgtggctggactaacgatggagtccacccagggtatgatctagaccccgaacgaggactcggttcatgcaattggggtaacacgttccgcctggagaagaatgtggggggtggcataccccctgccacatgtggtgctaggcgagcacctacaaaaaggtgtggcccgcgcctagactttcacttctgcagcagggtacgcttctctcgggctagtgctaaccatatgcggggaaccgcttgccatttgatagccccgaagagtctatctacacttgtttatcccaacaacttcgtggtaaggtgtccattcgacagggcagacatgttctgttcgatctgagcctttgccaaattggggcaaatacctgaggtgaatacgggggtaccacagggcaacggtatgtatccctgtggcctggaacaatggcacagatgaaatacaggcagttcgcaacggcaggcaaagcgtgaccgcagctgctacgtctaggccttgactgtttcaggccagtagaatcatcggggttcatcggcttgaacagctctagcttgtgcccactatggtgagctgcagatctgggaaccaaggtcaagccaacggccaggggggtgtcaaccagcccttttttttgttttttttgtttttttttttttcctccttaagctgctgtcaatccaaaccatttggcatcatcgtttcgttattgaattaaaaccaacatatcagcaatagtctgctctccccgggatctcataaatgcctagggtacatcga

SEQ ID NO: 632326 - DNA, 963 bp, Homo sapiens
agaagcctgcagacactcaatgccagactgtgaaatcagccaggagggagactgtccctgcaaagcccagggcagagctgcccaagaccatgggaacccaccatttgcatcagcgtgacctgaatatgagacctagagtcaaaggagatcatttcggagctttaaaatttgactgccctgctggatttcgggcttgcatggaccctataacccatttgttttggccaatttctcccatttggaatagctagatttacccaatacctgtatgcccattgcatctaggaagtaactagcttgctttcgattttacaggcttatatgtggaagggacttgacttttctcaggtgagacttcggactgtagacgttgggttaatgctgaaaagagttaagactttgtgggacttttggaaaggcatgattggttttgaaatgtgaggacatgagatttgcgggggcgggcaggggcagaatgatatggtttggctgtgtcaccacccaaatgtcatcttgaaattgtatctcccagaattcccacatgttgtgagagggtctctaggggaggttgtctaatcatgagggccagtctttctcatgctattctcatgttagtggataagtctcacaagatctgatggattatcaggagtcccacttgtgcttcttcattccttcttgctattgtggcaagaagtgcagttttcacatcctaatgattcatctctttgtccaacaattcagtgacccatttcagcctcacctcatatccctaaaactaggctgaggattcgtcctagggctatattaaccttttctcgaaaaacaaaagggggcttagatccaaggcagtactccctctggcaaggccaaagagtaaaagaggcggaacaggggaagccggtgtgggcctgggtagaacaaacagggaattgcgtgctggatacagagggcgacgacaga

SEQ ID NO: 632327 - DNA, 314 bp, Homo sapiens
  misc_feature (15)..(15): n is a, c, g, or t
ttcggcacgaggccnatgggcttgggcgtcgacgatgatttgtgctttctcgtccaccgcagccacgccggtatagccttgaacaacgcctttgcccgtggccatcttggccgattcgttatcggtgcgattggataagcgcacggcgcctttggcacccttgcggtcttctgtgttcttgtccagccactcgcgcagttgtttggcttctttctgcagccgcgcaagctttttggcctcacgcgccgccgtggcttcatcggtgggtgcggtatcggcctgacggtgtttgtccagcatcttctgggcggccg

SEQ ID NO: 632328 - DNA, 161 bp, Homo sapiens
  misc_feature (85)..(85): n is a, c, g, or t
  misc_feature (160)..(160): n is a, c, g, or t
aatgtaactgaaactgctggctgggcgcagtggctcccacctgtaatttcagcccttcccgaggctgaggtggaaggattgctcnaggccaggtgttcgagaccagcctgggcaacaaagcaagaccctgtttctatttatattgaaaaataaaaattcna

SEQ ID NO: 632329 - DNA, 522 bp, Homo sapiens
tgcaggattcggcacgagcttaacatttaagagagagggtgtggcagaaaacgttggggacttcgctcataaaggccgcccacgccccacttgccacccgagtgatgcccaaactgtcccactgtgctgttggcacgaacaccttaagggactgtggctgtcctgattcctagaagacttatcgcctatgcatgtggatcgtcctgacccacaccctgccgctaaagactgcttgcaggatgcctaccacagtaggccattgcggtatgccccatcctcaggtctacaccctacacctgctgcgtcgtgaattaactggaaataactttgcagggagagcccaagctaagacccccgaaacccatggcaaacaaaaaaacaaaaactcgggggccgcccggtacccaactctccttaacgcggtcgtactacacttcactcgtccgctcttcacaccgctgaactggcccttcaatacccacctaaccgctagcagcccctttccgccagctgcttcccccc

SEQ ID NO: 632330 - DNA, 296 bp, Homo sapiens
gagacagcctccttggctcaatcagcccacaggattctatgcttgttcctctgtgcaagactttagtcgcccaccacctcatctggtgtccacatcaaaccgtgcctacatgcggaacccctactccagcgtgcccccagctatagatgactacaccaagacctacaccacaggtgtggtcgccacacagtgcctataccactgatgccatcactctacagcttcacatgaaggctctcatctgcgtaccaggtcagacagtgggaagcgcatatcctcctactgctgtcacattc

SEQ ID NO: 632331 - DNA, 562 bp, Homo sapiens
ggtcaggttgggaaggtgggatcaggtgtgggaggcacagtccatgggggaggtgggatccagggaggagaggtaaaggccaggttggggagagaaggggtgagggaggcagtctcctgagtagcttggaggattcttgggaaagccaggaggtgggtttttaatacatggtcatccttgtgcttgtgggacaatcctatccccagtgttgcctgtgtggtgtggttgggcttggggttgggggttttgccagtgtgagtggtgccctgctcactgggccatgtggttacatgcttgccccgtatgaagccatggctcgaggtgtctccctgtcatggccacgagggtggttttgccaatggccaaagaccgtttgggtaaaagccctttccagccacccgtgcccctcctcgtcgctttccagccaatgtgccttgtgaccattgggagtaaggtacgtcaaagcatgacttgttgtgcacccttgtgaggcagggggaggcacggtgggacctggtgtgacgccattgggcggaggtgaacacggctggcgcaggttgac

SEQ ID NO: 632332 - DNA, 460 bp, Homo sapiens
gcctatcttggcgcggccggcaaggccagatgatccgagagccaacgataggagtatggaatctggctatgtttagtctcatacagtcatactcagggtacgtgggcgcgtactccgtactacgaggtactaacaggattgcctacaatcttgagatattgcacaacggcgaatctcctgtggattgtgacggtcttgcgggcaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtgggcagaagcaggggggatct

SEQ ID NO: 632333 - DNA, 364 bp, Homo sapiens
ctgttcttgaggttccccgtctgtcgctgctgtggacagactgggtgtctgacggtggcatggtggttcgtgcattccagtgtgatctgcggcgactctaccgaggtgttgggcgacatgctaggacgactgacgcagctcattctggaactgttgagtgctactggaggtgtccgtgaaccagaatgatttcttgttgctggaggagtatcattatctgtgaacgatcagaactacttccagatgcataacgcctgcggatggctggaggagatcttgttaaggaccgtttaccccgagctgttcgtggagtacgggatctggagcggcggcggatagcaagtggtgagcgacttcgagaacg

SEQ ID NO: 632334 - DNA, 1003 bp, Homo sapiens
  misc_feature (338)..(339): n is a, c, g, or t
  misc_feature (341)..(341): n is a, c, g, or t
  misc_feature (347)..(347): n is a, c, g, or t
  misc_feature (353)..(353): n is a, c, g, or t
  misc_feature (356)..(357): n is a, c, g, or t
  misc_feature (374)..(374): n is a, c, g, or t
  misc_feature (396)..(396): n is a, c, g, or t
  misc_feature (414)..(414): n is a, c, g, or t
  misc_feature (436)..(436): n is a, c, g, or t
  misc_feature (451)..(452): n is a, c, g, or t
  misc_feature (457)..(457): n is a, c, g, or t
  misc_feature (459)..(459): n is a, c, g, or t
  misc_feature (461)..(461): n is a, c, g, or t
  misc_feature (465)..(465): n is a, c, g, or t
  misc_feature (479)..(479): n is a, c, g, or t
  misc_feature (483)..(483): n is a, c, g, or t
  misc_feature (494)..(494): n is a, c, g, or t
  misc_feature (506)..(506): n is a, c, g, or t
  misc_feature (514)..(514): n is a, c, g, or t
  misc_feature (520)..(520): n is a, c, g, or t
  misc_feature (535)..(535): n is a, c, g, or t
gctgagaccctgcagcaccatctgtcatggctggctgggctgttatggtttagagctgctctgcctgtcattttgtgctgtgcatgctgtgactgactgcgatgtggctccctgtgcctgccctgctgtcctgctgtggaatctagcttctccagtgactgtgtgtcgccccgtccgctgtggctggggaaagctgtgcccacagaacctgaccacacctgtggcaatgaggacccagaaccctgatggacgaaaacttgtatgagaagaacccagactcccatggttatgacaaggaccccgttttggacgtctggaacatgcgacttgtcttcttnntnggcgtntccatnatnntggtccttggcagcacntttgtggcctatctgcctgacnacaggtgcacagggtgtncaagagcgtgggatgggatganagagtggtcccgccnngaagntnanaggnttgtgaataccganaggncaatggccttnccatcatggaanccaactgnttcgancccagcaagatccanctgccagaggatgagtgagcaggtgttaagtgggggtcaagaaggcccgccttccccaccccctgcgtgccattatgaccttttctcagagcacctaattaaaggggctgaaagtctgaagaacaaaaaaaaaaatcgcagccacactcttcacaggcgtcagcagcaacaagcgaccagacagtggcgccatggacaaacaagcaccaaggccccgcactctaggcacacgtgggcaaccgcgtgcgcaccccatagcggacgcaaataccaaacgcagggtacctgcatggcaaacagcgccagagaagcggaagagagtgaataggggagtataacatgcaagaaggagggacgatcgactggatgaaaggagtaggaacgtattagcgataataaagagaacctggagagacaggataaataatatggatagggcgggataataaagaaggagaaagcctaaga

SEQ ID NO: 632335 - DNA, 382 bp, Homo sapiens
tctgtgccagtttccaatatagcttactccattcccaccttacaaacaagttctttgtaaagttctgtaggcagagtaaaggtttttaccccaactggctttttaaaaccttttacctaaaggattattttccggtcaggttccaaccaggccaacttattgctgtcccctggaggcagcccatccattaggtcctgggcatgccccagatttggcagcccatcaactggatagcagccccagggtggtggccacccctctcatgttccatcatggggtccatacccaaggcatcctggccatatccaccagagtgaaaagaacgatagctaggatatcctggcgatatccaaggagctcaagggatctctagaatcgccga

SEQ ID NO: 632336 - DNA, 144 bp, Homo sapiens
atatttaccgcctcctggtactgctcgggtgatgcgattgtgtcatccccgttcaccagaaccaaagcttccagataagcactttcgacctttctacggcgggcctggtcaataagcaatcgtttggcaatggtggaaagataa

SEQ ID NO: 632337 - DNA, 445 bp, Homo sapiens
  misc_feature (12)..(12): n is a, c, g, or t
  misc_feature (228)..(228): n is a, c, g, or t
  misc_feature (233)..(233): n is a, c, g, or t
  misc_feature (273)..(273): n is a, c, g, or t
  misc_feature (325)..(325): n is a, c, g, or t
  misc_feature (350)..(350): n is a, c, g, or t
  misc_feature (366)..(366): n is a, c, g, or t
  misc_feature (378)..(378): n is a, c, g, or t
  misc_feature (425)..(425): n is a, c, g, or t
  misc_feature (440)..(440): n is a, c, g, or t
taatgtgtgacngccgctttcttggttcaaggacatgaacatttctacaaaataattaaatttccttgggatgttcaataatttttctgagatgcatgattaaataatttgccattaaaaaaataatgtaaataaaatattgaggttgtaggccctgtacattgcaaataggcttgtggcattttcttagcatgttatagtgactaaactaagttttacattagtagnaaagnagtccctgtaatgttttttaaaaatatatacttaatttcnaatcctttgggattgattccactgtcagttttactccagtttttccaatacnaatccataaggagagggttaaaganggaatatgacttttcnttattgcaaccntgtagattgtccatttgatgccttcatgaaacttctgtgtacttccngggccttacatactnttccc

SEQ ID NO: 632338 - DNA, 294 bp, Homo sapiens
tttataaaaacagctgtagtcttgttgccagttctcatgttatttctcatatacacactctttgagagctgatatgcatatcttgcattttcagtgcagaaaataatattattaaatctgttcttggatttatttctaaacagaattaacatcagaatcatctgactcatcagaatcatctgttttggaaaattcagtattcatcaaattagtcttcggccaatctgagaacattgtttacattacctttaggaatgttatacaggttagtttattattgcaaaaagtgtgtca

SEQ ID NO: 632339 - DNA, 196 bp, Homo sapiens
gatgttgacactcgagtagtactcccgattgaatgcccccattcgtataactaagttacatcaccagagacgtctgggcactcgtgagctgtgcccacattaggcttaaaaacagatgcaattcccggtacgtctaaaccaataccactttcaccgactacacgtaccggggcgtatacgtactggtcgaatgctc

SEQ ID NO: 632340 - DNA, 659 bp, Homo sapiens
agcgggggttggagatggggcctggtgggaggtgatcggatcaggcgggtggatttctcacagatgctttaggaccatcctcttggtgctgttctcatgatagttcagtgaattctcactcgatctggtcgtttgaaagtgtgtggcatctcccccctcgctctctctcttgctcctgctccagccatgtgacctgcgtgctccctgccttcacctgccgccatgattggaagctttctgaggccgccttagaagccaagtagatgccaacatcaagcctctaatacagcctgcagaaccgcttgccctctctcacctgctgccatgtaagatgtgcctgcttcaccttccgccatgattgtcagtttcctgaggcctccccagccatgtggaactctctgtcttttccagaatatcatataaatggaatcacacgataggcagccttttgagtctggcttctttgactgaacagaatgcattcaaggatgtgagaagaacgaaaggaggggggagaggaggagaaaaggacgtgcatcatctgaaaatgaagggtgttctttaaagcagcaaagttagctcaacaaaacttattgtgctttatcatggggaactgacatagcagaaagtggaaccaacggtaaggggggactactgta

SEQ ID NO: 632341 - DNA, 730 bp, Homo sapiens
  misc_feature (476)..(476): n is a, c, g, or t
gttaaatcacgttggaagccatcagactaatcctgaatgtgggataattttatgaaacaagtgtcttggatgcttcaaaatatttcagtatcatgcaaacacaatctagaggacgattgtctaaattaaaaggcactaaagacacatagaccacagtagcacttgaaccttaattggatcctgggctggagttggtggtgatcagtggtaggtggtcttcgcatgagaatcactatattgataactttaacttgctagggtacatgttgcggacaagcctgcagagattcgtccaccatatagtaataacaatgtgaacattctggaagtgcttgtgattccattaactccgctcattctcatgcaatagaggtatatacatacctaatgcttatacccacacagtcactatccattaaattattgtcctctagtatcatgtcattgcatattgttacactgttaacctgatttgnacaataacagatgctttcacgaaacccataagtcgaaccacagcgtactgaacggacgaggataccaaaagaatgatggtcggtgacccctttggacttggtagtcggagttagggtcattagcgtgcaagtacataacggactgacatatgcatgtaaaactaaatggggtcttctactcccccatggcgactcgattgcattttgtaggtgtgggtggccctcactaccagccgcattggtgggagccaaaa

SEQ ID NO: 632342 - DNA, 111 bp, Homo sapiens
aatgctctgcttacaaccattacattaatgagtgctgaatttcatggttgacatgctatatggctagagatacccaatgttatccctaacataaaaaacaacaagtttaaa

SEQ ID NO: 632343 - DNA, 912 bp, Homo sapiens
ccattcatgctgaggctccagaggttcatggaaatgagtgttgagcaggaaattctggtgactggtatcaaggtcgtcgatctgctagctccctatgccaagggtggtgaaaattgggcttatcggtggtgcgtggagttggctaagactgtactgatcatggtagttaatcaacaatgtctgccaaagcccatgggtggttactctgtgtttgcgtggtgtcggtgagaggacccgtgaaggcaatgatttataccatgaatagtgattgaatctggtgttatcaacgttaaaagatgccacctctaaggtagcgctggtatatggtccaatgaatgaacctacctggtgctcgtgcccgggtagctctgactgggctgactgtggctgaatacttcagcagaccaagaaggtccacgatagtactgcctagtattatctgatacacatcttatcgcgttcacccaggctggattcagaggtgtctggattattgggccgaactcccttactgctgtgggctatcagacctacacgctggccagtgacatgggtactatgcaggaaagaatttacaccactaacaaagcaagggatctgatacagctctgtacaggctaatcatatgtgcctggctgattgactttgatctgaacgctggccccatggctacgtaacggataggcccactgaggattgcgagccagctgtactgtcgggtggccatggctgaacgcgggcaacgaatccaggctgggggaccgctagaaaccgagctcttcgtataaggagtcccaagaatgtcggagggacctataaagatagcccggggggaaaagacccgccggagacacaccccacaggaatctggcaccgggaaaaaaacacacaaagaccacggaccgaaacgaa

SEQ ID NO: 632344 - DNA, 179 bp, Homo sapiens
gtgcagagagaatggccagcaggaaggcggggacccgggcaaggtggcagcaccacgcaggcccaacgtggttcttccaacgtctttttccatgttttgaacaagcccagatacaaggagttcaaagaagcttcagctgtatcgccagatcgtattgcatcatctgcaggcagcctagg

SEQ ID NO: 632345 - DNA, 159 bp, Homo sapiens
tcgatacgactttctttattttctttctttctttctttctttccttctttctttctttctttctttctttctttctttctttctttctttctttctttctttttctttttccttccttccttccttcctttcttttcctttcccttctgtcgtcttctc

SEQ ID NO: 632346 - DNA, 287 bp, Homo sapiens
cactatctccagtacaccggaagagccccttaaatgaaacactgaatatagcccttacaggtcaccattcaggaggttgttttagcatctgctaaaaactccagcgcaatttgatgctgatgaacttcgtgctgccaatgaagggccttggaacctgatgaagatactctaacttgacgatttgtggcatcaacaaacataacaagagaaatcagaagacattacacagggatctacaggagaggaactgcaagagagatctggccaatagacataacctcatgaca

SEQ ID NO: 632347 - DNA, 215 bp, Homo sapiens
  misc_feature (105)..(105): n is a, c, g, or t
  misc_feature (122)..(122): n is a, c, g, or t
  misc_feature (172)..(172): n is a, c, g, or t
  misc_feature (185)..(185): n is a, c, g, or t
  misc_feature (212)..(212): n is a, c, g, or t
ggggggctttttaaattaatttattaggggggtagagatagggtcttactatgttgtccaggctggccttgaactcctggcctcaagcaatcctcctgcgtcggnctcccacagtggacggnttaacaacagaaatttatttctcactattctggagattagaagtcaaagntcaaggtgctggngattttgtttcttctgaagcctctctnttt

SEQ ID NO: 632348 - DNA, 1001 bp, Homo sapiens
  misc_feature (471)..(471): n is a, c, g, or t
gcctttaatggagcaatcaataagaaggaagggatagtgcagatcggtggtacttcatagcagtctagcgctggcgacccgaacactcctattcagaggaagaaagagtatgccttgtcaaatggataaactaaagccctggaaagatgatcctgatgtcggcatgtcatcccaatgaatccgcagaacgaatgatcgtcgtttgaatgctgtgggagattggcattgtccttgtgtaaaagtgatcgaaaccatgtcgagttgacaagacacatggtttggattgaagagaaccaaatccaagcaataaggaaaaggttaaccgctttttcaaccaaattgcaagggaaaatctttggaagtttggttcttggaaggttggcttaagcatttgggttggcatgtgtggttctaaccttgggggcgtgggggggcttgatggggggggaaggcttttatgttggtcccttnggggcattctcggtgtgggcagtgtctttcaagagatgggtgtgaggaggggtggattggagacttcttcgggacggagattggtgagagggctcgagtatgcgctcttgggaagaaagtgtgagagccggggggagattgaaaggagaatctctcctggagagatgctttgaggaaagggggggcaaaattccaccctgggggaaaagctgggggtgttgcaaaaatggcgaaattggaatggtgacatgggaggtactaaaggggttttcacctgctgttgacaggggtggcccaagagggtgatgaagagggtcggtgttggtgtagatagaaaagtggaggaccggggaaaagaatacactcagggggaaatagtgttgtgagagggaaaatgggtgtgcagatttgtacccaaagttggtttgagagacccatgttgggttgtttgccgcatttaaaaagaaggggggaaaaaaggtgtgtgggtgttgagggaaaagagagaaagaaagaagtgggacaaaatg

SEQ ID NO: 632349 - DNA, 722 bp, Homo sapiens
atcgtagcactttaggaggccaaggcggggatctcttgaggtcaggagttcaaaaccagcctggccaacaaggtgaaccccatctttactaaaaatacaaaaaaattagccaggcatggtggcagacacctgtaatcccagctactcaggaggctgagggaggagaatcacttgaacacgggaggtggaggctgcagtgagccgagatcacgcaccattacactccagcctgggcgacagagcaagactctgtctcaaaaaaaaaataaataataggaacataaaaagttgatctcatagaagtagagagtaagccagtgcttaccagagactgggacggggaaggtaggaagagatgggttaacagacacaaaattacagctagataggaagacttaagtactagtggtctaaggccctgtagggtgaaaacaaatactactgtatggtgtatttcccaaatggctggacagacgaaaatgctttaatggtgcccaatcacaaaggacacgtgcacacacctgttgacagtgactgatatactacttacccctaaattgaccattacacatcattaacatatcacacggtagccataaatatgtatatctcggccacatataaccatcaggtttcaggccaccacatggctactggtaacccgaattggtccaaagacacgacaggatatttccactcaaggcagcccagacgaggagggg

SEQ ID NO: 632350 - DNA, 111 bp, Homo sapiens
cggccccgctgtcctcatctattgcaattctccgcggccctcgggggtcgctgcccgcattctcttgctccaagtctgggacctacggctcccttgccatcagtgggctcc

SEQ ID NO: 632351 - DNA, 249 bp, Homo sapiens
  misc_feature (32)..(32): n is a, c, g, or t
ggcagccggcggagaacaagacaccagggagncatgaggacaccaccgcactccagccggggcgacagcgagaccgtcggcgggaaaacaaaaacaaagcaaaaaaaccacccccccctacagcgggcatccctacagatacagaagctaccagaaatcctcgaaaggcagaataagagagaagaatgggccgcgcagggagactcacgcgtgtaatcccagcacgttgcgaggccaaggagcgcggat

SEQ ID NO: 632352 - DNA, 424 bp, Homo sapiens
acgatcgctatcacttaggctgaatgttgcagctcactgcagaattctctctcctgggcctgacagtttcagaatgctaaggcaagcagggttgaatccagtgtcaagaggattacagagttctcatacattgctggtgggaatgtaaaatggtgccgctgttttggaaagcagtccagcagtttctcaaaatgctaaacatagaattacacagtaactctgagtaacatcccacttcaaggattgaaagagaattgaaagcatatgtctacacaaaaacgtgtacataaatgcccataggagcattattcataatagccaaaaagtggaaacaacctaaatgcccatcgatggacaaatggataaacaaaatgtggtatatgcatatgatggaatattattcagccaaacattcaagccgtca

SEQ ID NO: 632353 - DNA, 332 bp, Homo sapiens
  misc_feature (320)..(320): n is a, c, g, or t
ttcctcagggttcccttgaaagctttatttatttattttgttcatttatttattggagaggcagcattgcacagtgaaagaattttggatatttcagaagccccgaaatttaagtttggctttgctggttccaatgggaaggccttggaaaagttccttatccttttggaacctcaggtttcttatttgcaaaataaaggctgacttgtttaattcatagggatgtgaggttctgctgaggaaatgggtatgaatgtgccttgaacacaaagctctgtcaataagtgatacatgttttttattccaataaattgtcaagnccccagaaaaaa

SEQ ID NO: 632354 - DNA, 512 bp, Homo sapiens
gcaaagacattaatagccaagttttctataacttgcagctgaacacatgctttaccaatagaccagctatggtccttcttggtcatcattcttctcttcctcttccccaaatcccaccatctccttatatgttgagggattgattcagaaaactgccgtcaactgttccttcactctttgtttgcgtaagaatttcctgagtcttgctaccatgagaaacgtagtattttcctgctttcttgtcagtgtctgaagttaggctttctagttcttatgatataccctattgttcttaaggacttagtgggtcacagtcacatcttattctgtagtgttgaaacacacacacaaacaacaataaagtctccccagagcactcaattttattcaaactgactgaacagttaatttgttcctcacaaagttcttaatgctcttcagtgatagaggttttatttttagaaaacatgtgagaaggcagggcatggtggctcacacttgtaatcctagca

SEQ ID NO: 632355 - DNA, 374 bp, Homo sapiens
atctcatcaacaaccgattagtcattgttgggtggtgatgagtcggtgtgatgagataggaggaggtggggatcaatacgatgaatacaaccagatgactgacgctagctgcgaaatgataaacaataggagaagtacttaatagtatccgttaatcatttgtattggcaacgaacttaacactccctcggactcctgcctcactcatttacacacagaccagaccaacgtatcgtataaagcctagccatggcgatgaccacttatgagcgggcgcaggacatataggctatcgcatcgtaagattaaaaaatgcccataaaccaattacttaccaaaaggcacaagcatgcaccccactgtatccccataga

SEQ ID NO: 632356 - DNA, 153 bp, Homo sapiens
tgccctatcgagacatccagtacatctatggtgtctctttactgatcttcaacattagaaactaaaaaggaaaaacacataatattctatagagtattaaactgagatactatgccctatggcagcgtcccagttttctatatcaatcttcta

SEQ ID NO: 632357 - DNA, 1164 bp, Homo sapiens
agcgggcatggcggtccaggcggcggaaggggtgagccaacgacgcccgccatgcactcgtccgcgctcgatctccggcgtgttctcccggttccggtgcccgcccgtggcactcgacgacggaaacaggccaatcatcctatcgccaacgacttcatgggacggaggacaatcgccagtggcgacatcgccacgacggcacgatggtcgccagatcgagactgggatcaaccgtctgcgtgatgcaggctccaggcacgccgagacaatgcgagcattcgacccggccgagcaaagccatggagcgaaggtggcagtcgagggtgacgggcagtcggtacggcagtccacacacaggaagcagcgggccgtgccatggtcacatacatgcggaggcggcacaccatagtcccaacgatcagtgtcgacaaacgttccaccacatcaagacccctcaacgtattgactacacacagggatcaacaggacccgaggcacgatctatcctgaggaggtggcagtaggacgaaggcaacacggcacgcatcatggagaagggtagctagtgccggcgcaaccccgagagccctcgcagcgcgagacgcagggcacgggcggcaggtaaccgtcgcccatccggacactaccgagtgggtagccgcagacagtgcgcaacgttgatggtcccacggaaacgccactggcactgtgggggcacgcccgggcacaacgagtgggtggcacaaacgatcaaggggccaatggaaagcaagctgccgaagaataaccccagaggggcacattggggggaaagaaaccctgtccccggggaggacaggacaaaggacagttcgaaccccaaaaaagaatgcgcggaaacgcgggtcacatagcacggagggggagacacccatgtctaaccgccaagggggcaccagcaccacggtagggactccagatcacccggagggcacaaggaggggacacacaattaccaagttacgagaatgcattacaccccgtgggagagccggggcccccctgaaacactatagcacggggcgcgattggcataaccgataaataacacagaggtgaccaaaaggggaggacacacgatgaggcgataccccccaccagagagacccacgccaaaaaggcaag

SEQ ID NO: 632358 - DNA, 739 bp, Homo sapiens
gagaccaggaatcggatcccgtgtactgacggtcacgccgcggaagggcgaattctcattctgtcctccaggctatgagtgcagtcctgtgatctgtggtcactgcgtcctgtatctcctgggttcaagtgattctgggtgcctcagtgctcccagagatagctaaggattacagtgatggacgttctaacagaatcttggtacgtgagtgatacgaagaccccagaagaggaacgaggacgcagcaaaggatgtcatggggatgggctcattcctcagggagagacgggtgtttcacccattttgggccatgctggatcttttgagctccggtgacctcagtttgatcccgcctgctctcagcctcacagacgtgctgggatgaccaggaacaggagggcccatccatgccccagtcccgcaccaaggatagttaataacattactatagttggtactctttgaacacaagcaggaccgaagcatcgacctccatcaaaccccatggtggggcgacgcctgggatctcgcgagaagagcgatccggaaccaaatctgctgtgtgcgcgcgggaccccgatagagtaaggcccactgaggcaaaagaggctgccccagaaacccggtgcacacgaacagcggcggacaccgcaaaaaagaccccgggcagacggaagttggacacccgaagggactgcgagctaggctacacggccagcgtgccaacatcccccgggag

SEQ ID NO: 632359 - DNA, 180 bp, Homo sapiens
agaagggtgacggaggctggactggacagcagcctttagtgtggtttgagcgcatagctgcgctggtgctacagcatgcacttcatcatcagcttttttaacaacagttgtcagtacataagaagagtacaattacaacatatttcgccccagactataatgggtcatatgactctactc

SEQ ID NO: 632360 - DNA, 667 bp, Homo sapiens
caatggctcatgcctgtatatcccagcactttgggaggctgaagtgggtagatcatgagatcagcagttcaagaccagcctggccaacatggtgacaccccaccactactaaaatacaaaaattaactaggcatggtggcatgtgcctataattccaggtactcaggaggctgaggcacaagaatcacttgaacctgggaggcagaggttgcagtcagctgagattatgccactgcactccagcctgggagacacaacaagactccgtctcaaaaaaataaaaataaaaataaaaattaattaattaataataatagggccgggcacggtcgctcacacctgtaatcccagcactttgggaggccaaggcaggcagatcacgaggtcaagagttcaagaccagcctggccaacatggtgaaacccagtctctactaagaatacacaaattaggctgcccgaggtggctcacgcctgtaatctcagcactttgggaggccgaggtggccagatcacgaggtcaggagatcgagaccatccccgctaaaacggtgaaaccccgtctctactaataccatagccgcccgtagtgccggccgcctgtagttccaggtaacttgggaggcttgagcaagacaatgggcgtgaatcccggaggcaagctttgc

SEQ ID NO: 632361 - DNA, 175 bp, Homo sapiens
tcgcaccacgacgtccggtttctggtttcctgattctcacgggggtgtgaccattcatagagcttcggagttttaatttcttgtcatttaggttctccgtgcatgctgtattattctcattagtagaccatggcgtcctgtcttttgtcatgtttatgagcgagatgatcacact

SEQ ID NO: 632362 - DNA, 981 bp, Homo sapiens
ggaaatttggtaatccgcgagagcggtttcacggccagaataacattgccggcttacaggcgtatttaggcaatccgattctccaagggccgtgaaccgggggccactttcaaaggacttccggttttccggggacatgggagtataataaaaggcgaaagggaaaaggggagccccacatgggccccaacaccccaaaccccggcccaacaccggaggccacaaaggggccacgttgcgttaaccacggggtccaaaaaggtccacccccgtttcagaccgcggcacattaattcaacggttttaagaagcgcgcaaaaaggcccttggggggacacatggcacattctcttgaattgggcgcgtctcacacaggtctcccttgtctccacattccttggaggcccttgaaatgggttgtataaagagagtggagagattataactgtcgccctatatctccacaaatggacccaagaacctctaatatgcgtatccctgagaataaaaacgatccaacaggggtaaaacgccgagaatatttccccctcttaatagaaaactttgggtgggtggagagtggcacaacttttcacgggagatgcccacacataaaccacaaaagatcttctgttttgcgctgggggatatactcccaggtaccagagtctcggtttcttcacatattctttaagatgcgcctctcatgtgtagattctggggcgcatacttggcgccaaaggagatcttgcctggagaacatctttggacacagcgcaacctctccagacatctgcgtgcgttctcaaccaaccagtgacattgcgtttcccaaagggatacccaagatatcgttgaagagagaggtgctctgttagccaggaactgagctcccggtggcgtggtgtttccaaggggtgtctcaaagtttctttttttgttttagggggtttcattaaaagcccgcacttggggtagcca

SEQ ID NO: 632363 - DNA, 547 bp, Homo sapiens
gaattcggcttaccaacattggcccgaagttggtgttgaccactgtgttagagtaggtggttgctacggagcactggttgtagatagcggcttgcggcaggaagatcgcgctcctccatggtgcggatgttgacgtccatggacggtaacgattatgaccaatgtaggtaactacggcgggtatctgcctagtggaacactcgcctcgagcggacaccggtgtaacctgctcactgtagggacgatgtctgatacccactggttattggattaaccggattcccagaaccgtatcaggaccagtggggtcagccccttgaccagccgctgccttggacccggcttctgacctcaaggggcctcatccgagcagctgctttccttcgaaaatgcggtggatttctgcaagttgggtgcgccatttttcactccacataacccccaatctggggaaacgttgcaccccggtgtcgtggacgaggacgtttggccgtaaagtcaccatcatgatcatcggaatcccacgggagtcactcccaggtgagaa

SEQ ID NO: 632364 - DNA, 131 bp, Homo sapiens
agtgtgtaaaattcgaatagatttctgcatcaaacactgctagaagctttccccagctaggtggtctgcaagggcctgcattcccaacatcccattacatgtatcccactccagaaagtctctggatttat

SEQ ID NO: 632365 - DNA, 665 bp, Homo sapiens
gtggggggtagggggagatactgataaactggctctccaagttggatggcgagctaagggctgacccgcgtgcctcacgtgacccagaggtagatagcggcgcagacttatgtgcaggccatactcgcgattagataccaggtctctgctgaccagacattgtctgactgggaaacgcgcctgataaaagcggtatagacctgtgaagctaagcctgttccctgtacacatcgaggggcgaattcggacgggaaggaaactgcaaggattgcttcagtaaaataaccaggacgaaagaatcttatgattgtaaatattcaccagtgacaacgagagtatgggcaggcctatgcagaatgtgaaaggtgacccgaattcgggaggcggtgaaggccaccagcctggtggaaactcgcggggacaggctttccgtcttgccccaaatttcgaggggcactacccaaattgcacgactcattgtgtaagggttggagaatggagatgatattgaaggatttatatgcgaacaagcgtactttgttttttacgccggacaacgccacgtgtaggcattgccttactttacagaattgtctactacccccattgaacgaggattcatgataatttttggtttaagtcgtgctggcctctaataacgctcg

SEQ ID NO: 632366 - DNA, 900 bp, Homo sapiens
gaacatcagagagcaaagggttcttttggtcacccaccactggccccatggctgcctgtgcagatggatcctgagctagccaatgcgcctcttctttgaatgtggtgccactgtggtcatcctgaacatgcccaagggaacagagtaatggtgatttgactataactcctggtgagtgtctggtgcccaagttcctgtgtggcgtgaagatgatccctccatggcatccacttcctccactacatgctctgtggacaaaggctaatcctgaatgtgaatgtatgtgccctctgtatgtggtttcttccttagcctgcaccaggcgtgattgctgaacatgatgctgctgctgtgatgcacacatcagtggaaagatggtagacctgttcccccaagccccagagtctgaggtggaggccatgaggtgccaacctccaaggatgctggaacatgctaccatgtgtggccttaacaccatatgccaccctgaaagacgtggcatctcactcaacaaacttcatcaaagcggaagaccacaggtggaagaaagctaacgtgccctgagaaatcagagaagaatcctggagaccattttaacagaatgttgcttaactgtggctcttcccatgaagacagcaacacaagggaccagaagtggaggcacggaatacaaccccggatggtggcaattggaagagcgaaaaagcaacacaaaagagtggcatagtgacaggctaccagaagaattgaggccaagaggcggaccaagaactccggtcagcaaagcgtgcaaggagaaattaaccaagagggtgcgaggaagtaggagaacagaagaagaaaggactgagaaagccagggaatggaaaaaagtccaggagacagggagcgagaaacgga

SEQ ID NO: 632367 - DNA, 226 bp, Homo sapiens
gtactgaagggggtggcagggctgtcactgtgccggaatcatgataaagggactgatctgactcctcaggtggaggagacggaaaggtcagcagcggactcacgccacaaccccagccacggaacccttccaaaacacagaggagccatatgagaatatcaggaatgaaggacaaaatacagatcccaagctaaatcccaaggatgacggcatcgtctatgcttcc

SEQ ID NO: 632368 - DNA, 453 bp, Homo sapiens
ggtagcattgagctttctcaggcaggcattttcatgggggagctggggttctcctagggacatgatctgacactgctagaaggcatgctaaagtttgtctcttagtaactcagaggtttggatggagtcatgtgccaagagttctacagttctcagtccatttcttctatcccttcatcccatgaataacgatttttttaaattgagcagagcaaaatatattcctttaaaagaggtgattgaaaacagatttttccattaaattggaggttttgtttttaaaattacaaaagtgatttttctaatttcaataagtcagcaggaccttgagtaacattgtctaagtggacagctttgatggataataatgcctcagtcttctaccacagtcctttttattattaaggtgccatacaaaaaccataaaaattaaatataaggtgataaacatga

SEQ ID NO: 632369 - DNA, 222 bp, Homo sapiens
cgtctgtgatattggggagggccggcagtgacacggtgtggtgatggcgtggggctgctggcttctgctgggcaggatggcttaaccctgactttgggatctgcctgcatcggtgttggccactgtccccatttacattttccccacactgatctgcccgcatctcctctgtcgcgggtacggccttgatatcacctctgggtggtccgagcggaccgggta

SEQ ID NO: 632370 - DNA, 774 bp, Homo sapiens
agcttccttattccaggtattaggaataaggaagctggtaacagcatgtattcacaaattaattgttaatatttttcagtaagttacaataaactgttttgcatgcttgaaaaactgtaaagaaaaagaatatttataggaggattttaatagtttggttttagtttttttctttttgctttaaaaacaacccctaatatttatctctgacaacacagtggtgtgtataaagttcatttccatgcttatgacacaaaaataacgatcagaaatatcaatctatcagtgtcagctgatatatatccaattaattcactgcaggagggaaaataaaacaaatctaaagtaatcattaaagcttacagttcaagtttttttccttttccttttgttttctttttttctctgtgttcggacaacattttttgggggctttttgggtgcctctgtgtgcaaagctgatctccttagatttaatgggccctcccagcgaggatttgaaaggaacaccttgaagacgttctatatatgggcgtgtgctacgtgctcccgtggctctggtgtgttaagttcccaatttcactcctcgaatttgactccagctcgtgacgtggctcaagttagttctcaaaagttaattccacctttcttcccaggtgttcttgtgtccctccttcggggaatgggggcagccgttagaaaaattgcttgctgcacacccttttaacgggctctttgaatagctgcagtcactgcacttgtgataacttcccg

SEQ ID NO: 632371 - DNA, 614 bp, Homo sapiens
attaatgattttgatttggaggcctaatttgtcgattgtgaaagcagcttttagtttaacttattcacagaccccttataattaccatgtattttttttcttcctaaatatcttgattcatcttgtgaatcttacgtgcccgtaaagttgcgatgttgaatcggttctctattgttctggcagtgactcacgggtccagcattttttcataagtgatctttaaaatagttctccaggattttatggctcctcactcccatgtcctcagacccagcgtcatacacggtgtgaatatgtgcacagtccagaaattgagacatcctaccctcagttgaataatgtcccattcatgccaaccttgccaacacggagaggtcacagatgcactcgaagacctttatcctcccattcctcttgcccaagtcactacagttgcttctattgaagtcagtctttaagcaacctgtgttaaagacaccagcacttctgctagatgtactggctgtacctcgtaagtcatgtgcaagcagtgccctctagagagtcatcttattcggtcaactttagctgagactgtccatagacacatgctaggataggtctcactcggaggc

SEQ ID NO: 632372 - DNA, 165 bp, Homo sapiens
cattgggaaggggacccccgccccctgccctcccctctttgccccgtactgtggaaaaaaaacccgcccttagtctctaaagagtttattttaagacgtgtttgtgtttgtgtgtgtttgttctttttattgaatccctcccagtaaaaaaaaaattggttcttt

SEQ ID NO: 632373 - DNA, 233 bp, Homo sapiens
gacatttgatggctgctgacctgcttagggtggtggttgctgaaggtggggtgacagtggtaatttcagtgattttggtttggtttggtttctttaagagacagggtctcattctgtcactcaggttggagtgcagtggtacgatcatagttcactgcagccttgacttcccgggctcaagcaatccttctgcctcagtctttccagtagctaggaatatcaagaatcggcac

SEQ ID NO: 632374 - DNA, 308 bp, Homo sapiens
  misc_feature (83)..(83): n is a, c, g, or t
  misc_feature (103)..(103): n is a, c, g, or t
  misc_feature (161)..(161): n is a, c, g, or t
gcacgaggttctgcctgtacacctggttcctcttttaagttcctagaagatagcagtagcagaattagtgaaagtattaaagnctttgatctctctgataagngcatagaaaaaatgctgacatatgtggtcctctctctgcttctgctaccacaaagaanacccccatgtgatttgcttgaccttatcaatcacttgggatgactcactctccttaccctgcccccttgccttgtatacaataaatagcagcaccttcaggcattcggggccactactggactccgtgcattgatggtagtggcccc

SEQ ID NO: 632375 - DNA, 454 bp, Homo sapiens
tgggagaccacagaactcaagggtgtgtttctcctctttggggtcccctttaagtagtggggatatttggggacctgggagataacaccgagttacccaatcctttaccagggcaatggtggccatcaattccagttggaaaataatagaacaagactggaattttaatatgcttcacttaggctttcatttggcagtaagaatctaagaaaattcttggcctgtggttaaagtctctaaacccacgtggcgctcttcaagaaatttcaaggtttggggcactattggccacaaattaaagaacctttttaaaacggcataattggcgttggcggtaaacttcgggaaagaacactataagtcttggggagcaagagaaatattccttaatttatttgggagagaaatatggagaagaaaaatattttaatggcttggctatcaaagggtggga

SEQ ID NO: 632376 - DNA, 1357 bp, Homo sapiens
agcggagcacagaagccccgcctctgctggagaagccctgacacggaggcgtcgagctgcacctcgtgtgcataacgtctgggcagctgcgggcaggagcatgcgtttggtgaggcgctggcgagactagtccaccgctgggcatgagtgagcagcctggcgggccagcgcggagcgccaatgtagggtgacgctacgcgcggcgcgtgttcagtgcccagtacggctgctgtcggctacttgatggtgaggcgtttgcccttgcttgatcgttccgtctcgttctttggatgaacagactaggttgaaagagtgagagaatgggactttaagggttcctaatagccgtcgtaggggtgggcctgagttcgcaggacggaagaaggggtatggaagaaagtggggatgcaaagaccgaagaaggagagaaggtaagatcggatggaggcaacttagagacgaggggcttggattccctctgggcgtaaggaaaccaggagagagaagcaaggttaagaggcattgccctgcgagtttcacgcctgaaaacgttttataacaagggttatgcttccataggtttcccaaggtaactgcaccctattttttaaaaagttgggaaggttctcgcgtgggaatgtatgctggacccggggttccacccgggggtcgttggcaccggctaggattggttttatctcgggtggaatgtggaggctttccaagtgggttgtaggggggtttgcccctgttccccacgggattgaatagacacaggatttattatcggttttaaaggcgaggggaaaactagtgtggcgttttggtcacatttttcgaaaaaagaggaccgagtttttttgggtttccttttggggggcaagggcacagaaaagaagcgcgttaaaaaagggaaacaagggttccgctcctgtgggcgggcctaccccacataaaagaaggttcttgttggtatatatttgtgacaacgcgccattattaggaacaccacaggcttgtggcacacctttttggggcaccccttaagaagtgaggaacgcggcccgctgagggtgaactgtgtagtttgagggttttcacactttacagggggtaacgacaagacaagggctgggataccccaaaaatctgtggggaaagcatgttcgttgagaaagaggtttttgtgtggtgtatgcaattttcccaaagaaagaggcgtgatttttatcagggaggaaaataacggcctattaaaatgtttccgctaaaaattgctttgtggggagaacagaaaattattgttggcgtatagtgtggagaggcccctgtgtgcgctgtgaaaaagagaaatacc

SEQ ID NO: 632377 - DNA, 580 bp, Homo sapiens
ctgagccgtacgattgacaatgtctgtctgtcctcaggcgttagtcatcagtatggtctctcacagggctcttgtcttctctgcatggactcttgctgcgggaacgtcgtctgcttaatttgatgctatgaggcaacccaatctttcctcggatggcactgtaaaatatcggtccggaataaggacatctgtagcggactctaaatctacgatctcgacttcttgaacggatccgtcacctctcttagcttctacttcgctttctttcacggatttcgctcttttgcctttctctgtctctacttcgcttccgttccttacttttgcttctcttacgttcatgactacgatttctgctcttgattgtatgcctcttatagctacgttcttcatggccgttggcactgctcaacttgtactcatccttcttgtaaggagcctcaagcattgcttcaatatcaatatcgtctgccatttactctaaacgcctgttccctcgctcggtgctcgacagggagctgatctgactgcggagctcttgttccacttgtctgctggcttgcaggtcagcctttaactt

SEQ ID NO: 632378 - DNA, 302 bp, Homo sapiens
  misc_feature (107)..(107): n is a, c, g, or t
gactttaatcataaggaaatatacaaaatgcccagaagtggaattcagaataataaggaaagtcagtgagatccaagagaggacagctttctagctttaatctcccntggagagaattcatgatatgaatgaggaatttaacagagagatggatataacccataaccaatcagaaatcttagagctgaagaatttaattaatgaaataaaaaatactatcaggagctgcaacaacagatttagaccatgcagaaaattctagtttcttttttttccctacatcttttgaaatagcacagaca

SEQ ID NO: 632379 - DNA, 396 bp, Homo sapiens
tagaggatcccgcgtgtgtagagtggatccaaagaatcttccccgtgtgtgtaccctggtgctgagtgtgtctagtgatgcaggcctagggcagacctttgagcagagccagtgtgcccactgtgcttgcctatggtgcctctgaaggcctctgctcgggcccgtgtgttgagagaggagctggccctgtactggtaagctggtggaggagtcaacattaaccaaccagatgcgactagtgctggtgaagcgggaatcaggccggccgctctacctgcgcttggtcaccgatcacctgaggctcttcacgctgtatgagcaggtgtctgagagactccggaccctgccttgcactgtccccctgttgctgatccattcgttagcacaagcacacgc

SEQ ID NO: 632380 - DNA, 615 bp, Homo sapiens
ctctctcccggcgcccacaccctggtctgagcggcgcagcgagccgcggccgggcgggctgctcggcgcggaacagtgctcggcatggcatgggattccatgggctcctcttccctttctctttcctttctggctcttgtgctgttgggcgcaatgtgatgcgccttacatgtgccgccctgtgataaccccacgttgggccctgcattaccctgccattccccgttgtagtcctgttccatttggcgcgcccctatgggttccgttagcccgcattaccaagaagtattataccggcgcccatagtgacgccacggaaccgcattttgtgcggagggcccccggacacgggcccacaaatacgaggttcttcacgcgcacaaccgcgcttaacgattcccgcttgatacctgattggttcccacacctggacttggtgggtacacgccacccccggcctccaggtgctgggcattccaaccggctttcatacaccgcggggggcggcacacataccactatccgcccgaacgcccgatgtgacatgacgcccgataatagctcgcattctcttaacgcccggtccaacacacggcggcaaagcggtgggacccc

SEQ ID NO: 632381 - DNA, 424 bp, Homo sapiens
gcagttttgctcttgttgcccagcctggagtgcaatggtgcgatctcggctcacagaaacctccgcctcctgggttctagcgattctcctgcctcagcctcccaagtagctgggattataggcatgcagcaccatgcctggctagttttgtatttttagtaaagacagagtttgtccatcttggtcatgctggtctcaaactcccaacctcagatgatccgcccacagctgcctccgacattgttggaattacaggcatgatccaccgtgcctggccaaacaaaggcatttctatgctaggtcgttcttgttcctccacctgagtgagctggaggtttctacaagtttttatccaaatgggccagaggtttttctatctgtgcagccacgggcatgtccccaagcacaacaacatatgctagtt

SEQ ID NO: 632382 - DNA, 303 bp, Homo sapiens
gtaaattcacatccttcatttaaaacactcacaatagatttgaagacatactcaattaataaagcattattataaaccacaccaacatcatactgaataggtaaaagctggacagcttcctctatgaaacttaaacaagacaaggattgccactctcacccctcctaaatcacacagttgacttccagtaaactggaaatcctagccagagccatcacggcagagaaggacataaaaggtctcacaatgtgcagatagacagtaacactatctgtttgcagaccatatgattttatgtctata

SEQ ID NO: 632383 - DNA, 179 bp, Homo sapiens
cagtatactgtactgctgcgcgttcctgacacgtcagtacaccactatagcgacagatcgacgctttgtgaagggagggtgccagtagacaagacaccctagacaccctgagctgcttctaacctgggtacctgtgctcccctcagacccgagggagcttgagctccgtgccccgcaag

SEQ ID NO: 632384 - DNA, 663 bp, Homo sapiens
aatttcacctgaaggaacttgcatgaacaatacttcagtcatgatgtttaagaaaggggagctttgaaatcggaggagccatacatccagtggcaattaagtataaccctcagattcggtgcatgcacttttggaacagtagtaaattacaacatggtgaagctacctgctgtcgaagtgatgagccagctgggcgcatcagtctgtgactgtgtggtgacatgtcccccccaatgaccacgagaggaaggacgaatgatgcagttccagctttgctggaacagggctctaagtctgctatttgctactagcaaggagggcctgacgtgaagcttccctgggatggaggactaaagagagcaaaggcgagggacactctttaaggaagagacagcagtagaccaattacagcaacgatgattcgtggtgcaaagtggactctctcagtcgtaagaggtacggactgtacagtcgtttagaatctagaactagacccttagaaagtggaatggtctgtatgagttacgtacgtatatatcgtaacgcaggaattcatggttaatcttttctacagaatgatgtgtctctacctctttatgccagaggcagaacctacggtgcccttttggctttgctgtcgtcgtaacattagccccatggatg

SEQ ID NO: 632385 - DNA, 166 bp, Homo sapiens
tgaaggcgtggatatatggttgtcaccgtagagtgattctcagattcccctggctagcccaggcagagctgatggcccaaatagtgttcagatctccacataaggccttcccctaggacctagcccctccagttgttgactggtaagatctgcaaggaacccacgc

SEQ ID NO: 632386 - DNA, 295 bp, Homo sapiens
taaaattttttttttgttgagagggattttttttgttgccccggctggttccagggtcatggggtcaaatgggccccccccccccgcttcccaaggcccaggcccagttgtaggtttttcccctgcccccctggccacccagagggtttttacccctttaaagaattggctttcataaattgggtttgttggggggcaagtttttttaactggaaattgtaaattcccccccaaatgttttttttaaccgtttccataaacttaaactcccaaaaaggatggtttttgggggcca

SEQ ID NO: 632387 - DNA, 391 bp, Homo sapiens
  misc_feature (291)..(291): n is a, c, g, or t
ggaacctctcagacgatgccccccagtatgggaaccagaacctctcaccaaccagacacacccggtgggggcacagcacagaccccagaggcaggaacctctcagccgatgccccccggtatgggaaccagaaccttccaccaaccaaacacacccggtgggggcacaggacagaccccagagccaggaacctctcaagcgatgcccctcagaaagagcaccccatattcaagtggcgggccctcggaggacaagcgcttctcggtggtggatatggcggcccttggcggngtgctgggtgcgctgttgctgttggctcttcttgggctcgccgtgcttgtgcacaagcactatgggccccggctcgtgctgctctgtggattcggagccc

SEQ ID NO: 632388 - DNA, 123 bp, Homo sapiens
cctataccaggtcagcgtgttgccgatcagccgcgtatctgcgtttgccacaggtgcgacagatctgctggtcgacctcatgccagctcagcagcaataccgacaacggcgtcagcaccagga

SEQ ID NO: 632389 - DNA, 389 bp, Homo sapiens
gcaattagatgctatgtcatagacatgggaggaaatgaaattaacatatatcaaaccttaaactaaaccgaactaagttatgccatgagaatgcgtatgtctagaaacgatatcggcacttcccaataatatgcatcccctaccctatatgcctataaaatagtggtaaaaaaaagaaaaaaaggctcataaagctgagcaccttaaccatttaataagcgtatggtagtgtagactatatttgcatagttgcgcagctccaccattcttaaatatatgtaagatgatgttgctgtactcttttccaccagtaatataaatgtagcccagtaatcagtaaaactatcctttcttagttactctaactgatatgcccaagtgtctaccag

SEQ ID NO: 632390 - DNA, 541 bp, Homo sapiens
gaggagacgtgaatggtgggtagtacggaatgagcgcatctgatccgcctgccctgtcaggatgagagcgagagaggagcacccatggcatcgtaggctcgaaggtgacgcgtggattcctggatcagtaccagtcctctattggacgctggaactttgagctgagaaggtgtggtccttctctatcctgagtacttctgcaggaagaggagagattggtgggctgtgcctctgtggagggaggttagcaggtcatgggccaggcccgggcagtccctcccccgttgttgtccctccccactccatctgttgttgtctggtagtcctggacgtgtcctaacttcttgcagaggctgtgaggattccggagtttccccacacctccgggccttggtccttgtacctcacctccttggactgctggctggaggcctggggaggtggggcatcacgctctgggttcaaagggcagagcagggaaacctcagagctgggttacctgggtgacaggtggggatgtgcttgaggtagggggcaggct

SEQ ID NO: 632391 - DNA, 243 bp, Homo sapiens
cagcccatggtgcagccggcgacctcttcattcccatgcggttggggactcatccagaagcatctgaagaccagggatcacaaccggaaccgcaggctcatgatggagcagtccaagaagtcctccctcaggggggcccgcagtattctcaacaacaagctcatcagcaagaagcgggagcgctacctgaggggcgagaaccctttcaccgacagccctgaagggagcccaaggggtaccgag

SEQ ID NO: 632392 - DNA, 134 bp, Homo sapiens
tagacagaaatatttttgtaaggttttggggcagggagggagcattaaggacgaggaaaacttgaattccagatttttaatgcaaaggatttatcatttctaccagaaataaacgttttaagttttttcttgga

SEQ ID NO: 632393 - DNA, 377 bp, Homo sapiens
  misc_feature (28)..(28): n is a, c, g, or t
  misc_feature (52)..(52): n is a, c, g, or t
  misc_feature (79)..(79): n is a, c, g, or t
  misc_feature (88)..(88): n is a, c, g, or t
  misc_feature (125)..(125): n is a, c, g, or t
  misc_feature (353)..(353): n is a, c, g, or t
  misc_feature (355)..(355): n is a, c, g, or t
tcaaattgaaaaacatcaacattgcctnaaggctcctgaaatgcgcgtgctnaagtctgccctattccttcctcggtgncccccaggnctctccgcttattttaagatagagctcatcggttgtnaaaatgctactgtgggccgggcgtgggtgtcacgcctgtaatcccagcactttgggaggctgaggtgggcggatcacgaggtcagatcgagaccacagtgaaaccccgtctctactaaaaatacaaaaaattagccgggtgtggtggcgggcacctgtagtcccagctactggggaggctgaggcaggagaatggtgtgaacccaggaggcagaacttgcattgagancngccactgcactccagcctgggt

SEQ ID NO: 632394 - DNA, 591 bp, Homo sapiens
tttttttaaaaaggcaaatgctaaggtttattgattacattttgacgctaagtgaacttaactagtataagaactaaagcataccgtcatgtttaaaaaatgaagctatttttccattggagagattttggaaaaatataggtctgaactctggggcatgcatggctgacttttcaaagcttcacaagtgagtttccacacagtcgtttgcatcacaatgatatagattgataccttcaatcttatgcatcaacagaaacacggctggaaggacatcaattgtttatgaaagataatcaaagaagcctattgtggcgaatgttttttaagggatcctagggagatgaataacgcctgcttcttcatgggttgacaatgtatggctgattagggaaggtgaaaccacacttatctgatgatcttaccgaagggacacactcgagttgagggacacggtcctggtcactgctgtggtatgttaatgcggcactctggatgtgagcgtagcgacttcttccttaatagatgcacgctacacaggggtaagtgtgcatgacatgaacgagcacatcacatgtctcatgtagcgga

SEQ ID NO: 632395 - DNA, 1370 bp, Homo sapiens
gcagctccgagcccccgatgctgggtcacggagtatgctgcttgagaagcgaggctgtggagggcagaccggcgaggaggactgcgttcggcctggggggactgggttggactcacacaccaatgccggtcatcctccagtgactgcggtgtggagcggcttctccgagcctgcgagaagtctggtagcgcgcccgttgagctgatgaagctgcaatgcaacgggcctgcgggtcgccaacacgagccggtttcacaccgtcctagtccccgggtagccgggcgccgccagtgcctgcgggttctgcgggcatcggcggtggctgcgggagatgccggccggacgctcgggggcgccgctctgtgtcctgccgtatgcatccgcgcagaccggctcggtctgatgtgtggtggaatcccgtgcagtgagtacttacccctattcccgtgtgatcatagcgctgacgcgcagcgcgccgtgcctctgtaggtcaccgagacccggtgggttcgcccacatgcgttgcccagtgcgggcccgccaggagcatgcgttgggaagacctgcaaggcacatcagtacctccggcagaggaagacctcgtgaagcgagttcatgactggcagtgaagagtgatgaagaggggaaccgagtgggtcagggcatggggtacggaaaccgtttcacccagagttcgtgatccaaggggtgtttcagaacccttcttggtcaccaaacacgtttgcatcaggccccaacacgggggttcaccacttggtacgtttgctagagggctgagagacagcaatggggccattacggtgacagggaacacatggcagagggaaccaggcatccccttttcacgaaagtgcgttgacaggcacctggcgaggggagccactggcacccgaccacaaggggacaacgcgccccccggacctccacgttacacacgaagacgaacgagttcgacaggaaaagacgacacagcacacaacgagggatgcacatggagacaaaacggaacgtcaagatgttcgagtaatcaacagaggggggaaacgccgcaaaaacctatcactttggtggcatatgacgagagtacacttaacaaaggcggaacatggacaataatagtcttgcgccaccatttgagagggagaaagttatcaacagagcagcttaaggcaattacgaagataacatgggaggaaatacaataatgacggaggagtaccaatacaagataacgacttgaaatgggacccgagtaaacccaaaacaattggggagcaacacttataggaaaccaacgttagaactcattgtctagggatcacatagaaaagcagacagaaacaagagaa

SEQ ID NO: 632396 - DNA, 215 bp, Homo sapiens
  misc_feature (7)..(7): n is a, c, g, or t
  misc_feature (178)..(178): n is a, c, g, or t
tggctgnagatcgcgagagagcggccggaggcggcgcggagtgcagtggtctgagaggcacttaggaggctgctctgctccgcattgccagctgtcctcccggctgatctcccactcccagcaacaagctccttggctcagctcctgctgcgtatgtagaccccgaagtttctgcaancaagctcttcagacccacatcgcttcttccagtgact

SEQ ID NO: 632397 - DNA, 214 bp, Homo sapiens
agcagctacgcgggcggtccggtgctgtatgtgaggtcaggccttccagtctctgactcttacctgaaacacgtgtccacttgtctgtattaaggttgggtatatttgaatttctggcttctcttttgtttggactctgtttgtcttgcttgttctgttttttctttcctcccttccttgccttcttttgggccacctgggctttttttttttt

SEQ ID NO: 632398 - DNA, 159 bp, Homo sapiens
cgatgttgtgcgcagcgcgcagcgactgcgcgccgtcgagctcgaggtgcacctggatgaaggtgcgcgacccggcggtgcgggtcttgaggtcatggaaccccagcacgccgggctgggcggcgatgatcgcctcgagctcggcgaggagtgccgggt

SEQ ID NO: 632399 - DNA, 522 bp, Homo sapiens
ggggacagagtcttgctgtgtcacccaggctggagtgtgatagtgtgaccacagctcactgcaacctccacctccagggctcaagcaattctcacgcctcagcctccagagtaactgggattacaggtgtgcatcaccatgcctggctaatttttgtatttttaggagagatggggtttcgctatgttggccaggctggtcttaaactcctggcctcaagtgatctgcctgactcagcctcccaaagtctgggatcacaggtgtgagttaccactcgtatgtacttcagttaattcccaaagagcccgtattctcttgcccttttctgccatctcacccacctcctttatcctttgctgtcatccatctctggtgtccgtaagaagctcactggtcccagtggtgggttggttttagatgttgaccaatgacgggtacagaggcttttagagaatgcagaccgacctcctattccattcttctccccttctgtcgtcatatcgcacccgtatagtagtagta

SEQ ID NO: 632400 - DNA, 105 bp, Homo sapiens
attcgcggccgcgtcgacaactggtgcaacacgcggtactggcgagccaagcagtcgccggctgtacccgacaccccgcccgaggcaactccggcggggtgtttt

SEQ ID NO: 632401 - DNA, 416 bp, Homo sapiens
  misc_feature (14)..(14): n is a, c, g, or t
  misc_feature (24)..(24): n is a, c, g, or t
  misc_feature (52)..(52): n is a, c, g, or t
  misc_feature (55)..(55): n is a, c, g, or t
  misc_feature (62)..(62): n is a, c, g, or t
  misc_feature (68)..(68): n is a, c, g, or t
  misc_feature (70)..(70): n is a, c, g, or t
  misc_feature (105)..(105): n is a, c, g, or t
  misc_feature (113)..(113): n is a, c, g, or t
  misc_feature (127)..(129): n is a, c, g, or t
  misc_feature (164)..(164): n is a, c, g, or t
  misc_feature (168)..(168): n is a, c, g, or t
  misc_feature (272)..(272): n is a, c, g, or t
  misc_feature (274)..(274): n is a, c, g, or t
  misc_feature (292)..(292): n is a, c, g, or t
  misc_feature (381)..(381): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (399)..(399): n is a, c, g, or t
  misc_feature (411)..(411): n is a, c, g, or t
  misc_feature (415)..(415): n is a, c, g, or t
agcagcggctgctngtccaaggtnccgcggagtcggacgcaggcagaccatngtnggacccncggttnanctcgggtggccttaacagcagggctggttggcttngaaccgcngtgcccagatggtnnnttcctgccctgtggcctgctgcctggaccccgganggangccagctacagctgctgccgtccccttctggacaaatggcccacaacactgagcaggcatctgggtggcccctgccaggttgatgcccactgctctgccgggcnantcctgcatctttaccggnctcagggacttccagtagctgccccttcccagaggccgtggcatgcggggatggccatcactgctgcccacggggcttccactgcagtncagacgggcgntncntgnttccaaagatcngggna

SEQ ID NO: 632402 - DNA, 105 bp, Homo sapiens
cgggccatcatctgtgaaccttgtcttgaggtggctggggcaggaagctgaagtcgaaaccagcgctgggaggaccagtgcggaccagtgaggtccacggagggc

SEQ ID NO: 632403 - DNA, 731 bp, Homo sapiens
gcctcttataaaatctcattcatttccagagagttcaggacaacaaaatccaaaacttatatgagaaacatttaagacacctttaagtgatggctgaagaacacatatagacaacaaacagaagacctgaacaaacagaaacaggagagttcttactacaacatgttaaaactcaaagccaaaatcaacacataacagaggtggcacaccggccatgccattacaaaaaaacacatgaggaggtttccctatctggaatcgattcagaatgcacgtgtggttcaacccagcccaggctctcaaagtaatgctcggatactaggagtgtgttctgataaccaatctccacaacatcgcagaaacagtcgctgccaagaaggctccaccatgtttagcagttcagacaggacaaagataaggcatgacaacacggacgttttacaaagctcaagggaccattatgcaatccaaaatcagggtggcgcacatgcaaccaaagtcaccgcaggaattgtagtaccaaaagagaaaaagaaggaagtatgtggagacagttggattgccccagagcaaagcaatttccccgatttcaaagtagaacatcaaattacaatttagatagtacatgaatggaatgaccacgtttgagtcataaaaggatctggtttgggtcaacagttaccagaaaatttgaaagaggaatggagacatatggtgatagattgtaagat

SEQ ID NO: 632404 - DNA, 318 bp, Homo sapiens
agaggatccccgcatttcgtagatcccacttattttttattttttttattttctgagacagagtctcgctctgtcgccggggctggggtgcagtgatgcaatctcagctcactgcaacctccacctcctgggctcaagcgattccccgcctcagcctcccgagtagctgggactacagttgcaagccaccatgcccagccaatttccgtattcttagcagagacgggtcctcaccatgttggccaggctgcagtccaggctggtcttgaacgcctggcctcgctggtcttgaacgactggcctcaagtgatccactca

SEQ ID NO: 632405 - DNA, 274 bp, Homo sapiens
aatagaggtggatggagggaagcaacagacacatctggtggttaccttcgggtgctgacagcgggaacccaggagattcggggtgtggacgggcccccatctatgcacagcaggagagtaccatggctgacactagaggttgcagtgagctgagattgcaccactgcactccggcctgcgtgacagagcactctctgtcccaaaagacaaatcatcaagaaattgcataattagcctgttgaaagccgcttttagtaacaaactttaccccctg

SEQ ID NO: 632406 - DNA, 781 bp, Homo sapiens
ccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagacaaacctggcaaggtagggccggagtggcttggggacacccttaggctcagtgactgcccagtgaccactggccacacctcaccgccctgctgcctcagttcttgtatttgcataggaaatgcaggccattcgtaggtatctaagaaggtgacattttgagtgtaatgaaaccaggtctacattttagaaataccaaatctcactttatgtaatagttgaaccttttcacatatcacagtcacatcagaggggtgatctctgcaggtgtccactgattctggtctccactccttcgggtaatcctctgtccacgggaggctccttggtgggttttggggttataggggccccttttcccatgtggttgttcctcccataatgtggaccccggttgtgtggcccttatttaatgttcccagtatgatacaaaccaacgggggggggcagcggcacagtaagtattatcgaagtccgtcgaggggacgt

SEQ ID NO: 632407 - DNA, 989 bp, Homo sapiens
  misc_feature (156)..(156): n is a, c, g, or t
  misc_feature (173)..(173): n is a, c, g, or t
  misc_feature (228)..(228): n is a, c, g, or t
  misc_feature (319)..(319): n is a, c, g, or t
  misc_feature (989)..(989): n is a, c, g, or t
aaaaacaataccgaaccggaaaagggcctattctcgggctctcggtctgtgcgccgcacaccagcccgcgcccctctcgccttgcatccctcgtccgctttaccacgcattaagtgattagtacaaaacacacccccccccccacgccccccactncccgaaaaccgccaacnacagcaagaaacaatataaagaacaacaacctaccaaacaacacccaccaaaccnccaaccactcaacaccacacgaagagctccacaaacgccccagccgcttaaatcaacgcatgcatttctaccaccctgcccctcccacgtntcattaattctaggtgtgcgtcttctgttattcttctgcttttttttctttctgctctgattaattatagaatttgtaacatgtcgtttctctggcgtcgaacggtcgggcactgcagagcttcattttctttctgcctccttctcgtatgctgttactcgatggcgtctctcgtgtatgaaaagagagtacacaacagttcacgtagtgcagtgcgaagtgctatctcactcggcgtgagtttgctacttcacattccatagttgtcttaactatagatttgtgatttagttaagatcgcgtgtgtgagattgttaatatcagatggaatgagacgtgtctggttagatgtagcgaggtcagtctgtctttgcgttctgttctcggtagtatgtttacgcatattcactagaattagatattcgtatcactatggagttacactattcgtataatagtatagaagtgtatcagtcacgtagatgcctgattgaaatcgtgcaacattttatgccactgactatttctgtctttaatctattttctctctttcttactttatcatctacgtcactgtaggcatctgatacgtcatattattaatactagtttccgtacagcgtacaagcgttcgtacgctacagaagggagtgttgtctatacgtgcggn

SEQ ID NO: 632408 - DNA, 1143 bp, Homo sapiens
  misc_feature (1114)..(1114): n is a, c, g, or t
cctcccttcaccaagccgaagagaagccccatgcacctcgaccaaatcaagtgctataccaggggattcgctttgcacccttgacactgactcatgagcctagattaagacgacaggaaagtctagcgaatggggctggacgatcgtggattaccggaacctgccccacaggccatctcccgccaaaaccaataaagagagagccagaggggaccaccgtggatggagaaacttttgatgaattgaactacatagcttttctaagcaggttaaaaaaaaaaaaaaaaaaaaaaaaaggtagggttttcggaataatatggatcccttcagattggaattaaacgaaaacgacaacactccccagttttggggatggggggaataccttctaatggagcactataagccaaaccagggccaaaattatgcgatatggggtcacccagtggatcataacgtaggcgctggaaattcactacacatattttctgccctggaggtggaacatttttacgagggaacgggttatcgccatcttttaaccctaaacccacctggatttttctgggtaacgacaggggccagggaaccaaggggaacgggacaaatggagggtcaacccagaaacaaaccaaatttttccaggagcacacgataacagctgactggtgagctggatatttcccttctggggtggagggctggaaatatgggccggacagggctctgggtaactggatcttggctcttcaacacattcggagatcgtggcccaccataacttcggcattaaattagcaaatattgggctcaacaaatatcattgcaggtggatataccgaagctgcggggggaggtaaggtggcatcataacagagaagcttacgttattttcccccttgttttttggatgtccccttaattttgggccaggaggtacctaatcatttatcctggtcagccgggggtacgatttaagatcaatcacagacaaactgggtctgatcatggcacaagctaaagactggtgtcatctcagaacaaagatggatacggaacaagatcctgtgcgtataaccaatagcaacatgggctcacagccagggtacattanatccgcaagcacctccggggaacttaaca

SEQ ID NO: 632409 - DNA, 97 bp, Homo sapiens
ctgcacagtttccagctagtcacccacaccagagaagaaataagacagcattagaagaaaacaggagagaaagaacatttgtgaactgcagctgtca

SEQ ID NO: 632410 - DNA, 168 bp, Homo sapiens
  misc_feature (44)..(44): n is a, c, g, or t
  misc_feature (56)..(57): n is a, c, g, or t
ctgaagcatcctgagccgggggctgagcataacgggctggaggngcctaatgatanngggcgagagacccctcagcctggtccagcccagtgaatgcatgccccagcccagccagctacccaacccctctctgtgtccagccggagggacctaagaatgactcccgaa

SEQ ID NO: 632411 - DNA, 367 bp, Homo sapiens
tgaggatccgtgtagtctgctctggggggcagtggccctgaccgagacctgggcggctccactccatgaggtatttccacacctccgtgttccggcccggccgggtgagccccgtttcatcaccgtgtgctacgtggacggcacgctgttcgtgaggttcgacagcgacgccgcgagtccgagagaggagccgcgtggcgcggtggatagagcaggaggggccggagtattgggaccgggagacacagatctgcaagcgcaaaggcacagactgaccgagaggacctgcggaccctgctccgttattacaaaccagagcgagggccgggtctcacaccctccaggaatatgtttggttgcggaggtg

SEQ ID NO: 632412 - DNA, 192 bp, Homo sapiens
  misc_feature (40)..(40): n is a, c, g, or t
gtgagtgtatgtgttgcacaccctttgaaggaggcttaangaggccacctccatgtgatggagctcagaatgggtcagggagaattggtaggagaggtgtaggaggctgagcagagtcacctccgagttgtgtccgagggctgcgagtcttcagtacttgtccctcacaggagctgttctcagggctgggtc

SEQ ID NO: 632413 - DNA, 805 bp, Homo sapiens
  misc_feature (105)..(106): n is a, c, g, or t
  misc_feature (109)..(109): n is a, c, g, or t
  misc_feature (115)..(115): n is a, c, g, or t
  misc_feature (306)..(306): n is a, c, g, or t
  misc_feature (635)..(635): n is a, c, g, or t
  misc_feature (747)..(747): n is a, c, g, or t
cggacgcatcatggggttattctataagttcctgggcttttacttggatatttacagaggaagttaacttaatttctggactggggggggggggtgacattaaannacntgatangacagttaaaaaaaaattgatagtcattctctgatggagtgaagcaagctttgtcaaccatcaacaaatatgacttcattggtcacaagccctgcagagatccaacaagatttgagttgggggggcagaacatatttcagacaaaaccaacaaagtgctgatgtatgaatggaattgattgctgaaggcanagagtataaagaatctcaagaaacttttagtgccattttcatttaataagccattggtatagcaacctaaaaaccttggctgggatgacaccaggatgtgtttatggaattgctgcaggaaaacacaattggcaggtggcatcctctgggtcacaggaccagcttctccaagagacttaaggctggggtgtggtacgggagtatttcttgccagatgggagctctttggtgaagactcctttcgggaaaagttttttggcttcttcttcagggatggcggggaaggaccatcacactatccccatccttccaatcaactgggggggggnacctttttcttggtggcaggtagagagagaggactaccctgagaatctcatcaaagtcctggccgtggtagcttggtaaaggaaaaacaacttcagtgcttatcaggaccanaaacaacgccccacgagcttgcgcaggggtgccctttgtatgcttctttggtgggagc

SEQ ID NO: 632414 - DNA, 343 bp, Homo sapiens
tgcatgccctgaacccctgggtgggtggcacagcatttcccccgtgtaaccttcctctgtacacaggacatgcacacacaagtaacattgacctgcatggacaggagccttgacctggcgtgtgggaattgaccgccatatctggctgttgtgggtatccccctggcaaggccatctaggcctgtggttccctgctccgactattagggctgcctccctgagctccagggccagattgcctgtatgcctgggtagccagtctggggattgggctgtatggcgcatccaaccagtttccattgtggtctaactgcatccattgccaccttctgtttgtgacctt

SEQ ID NO: 632415 - DNA, 1311 bp, Homo sapiens
tacgctttgctcaagaaaaaaacaaaacaaaaaaacaaaagaaaaaaaacaacggtggatgccttcgcactcaaggccaacttttggttacagattaattatttccagtaagaaaccatatttggaaccaagtcgagtaagttttaaggtttggcttcgcttctaagatgtaagagttcagactcacgattctattaaaatttagcccgtaaaatgacaagccttctttaaagccttatttttcaaaagcgccccccccattctggtcagattaagagttggccaaaataccttctgaactacactggcattggttgtggccgagaacaccgagcactggaactttggcaaagaccttcgtctattgagaagacggtagctactggcagttaggaggtgcagacactggctctcctaatgtagttctcagaatgcgtaaagcagaacagcctcccgaatgaagcgtggccattgacctcaccagtgagttagcagcacgtgttcccgacataacatggtacggtaatggagtgagcgtagcagctcagctcttggggatcagtctatggggattcatagcgagtatctgacagattatgggagcattttgacacagaactgcttattacctctaatgaagaaatctgtgaaacctgtggtttcccggcgtggtgggttggatcacggacacgcacggatttggacaatacgacggggcacataccctactcgtccgaatgtacgtccggtaaactcaaggtcattcgccactgtcatataagaccggaacagaaaatacaacttacgacgcccaaggatatataagtaggcacaaaaaaatataccctgtcttttctgttcttccttctgttcttgtatttgtcgtttatgcaaagagcagaaataaaagcaactataaaaaaaaacactagcagaagaaagcaagacagacaaaaaacaaaacaaaactgaaaacgaaagaagaaaaggagaagacgagaagagacaaaaacaaacagaacaaacagacagaaacaacaggcaaaaacacgaagagcagaaaaggaagagagaaaggaagcaggaggaagacaagaaggaggaccgaacagggagaagagagaagccgaaaaagcaaaagaaacaagaagaagaacagagaacaagaggcaaagcaaagggaagaggagaaagaagcacgagcaggcaagcgagaaaggaaagaggaggagaaagaagcaaagagaaacagaaaggaaaacaggaagaaaaaaagaaacgagaaagagagggagcggacaaagagcaaga

SEQ ID NO: 632416 - DNA, 598 bp, Homo sapiens
tcgaggaaaaacggcccggaagatgggctatgagattaacaccatttgatggaagccgagatattttggggacacctgaggggggacagaggggaggaggaaacagcaagagggaaaagagggagacgaaaggatgcaagagggggtccgcggggaatgaagacataagcgcagagagcaagacgactgtggagcaaaacgtaagagagatcacacaggggaaacaggatataaaaggtagaacagggcccaaaagggaacaaagacagaggagactagggccagcgcataggggtaaagattggaattgactccgaggatggaacaggaaacatggagaaagagtatgacaggtgcaataggacacgaagagcaagatgccaaaaccttatggaacaggggggggagactactaaaagaatgacaacaggaacaagaacaacgctggaccgaaggaaagggagccaatgaatgagtgaagcaatggagaactctggagggagcatagagcagaacgctatgagaagggggagaggagaagccagcaggatggggcataagaggagagaaacagatggagaaccaatggagaaaaaaa

SEQ ID NO: 632417 - DNA, 294 bp, Homo sapiens
gtttggcaagtcaggtaaatgccaggaacatatcccaactcaacaaatctatgtaactttatggaggtggaagctgcgttagttcatgctaggtggctgtagcaccgacctcatgtataaaacgcaaaacactttaatattaggatctaggtcttaattgcaagctatactgaggattttcatttattatgtattggatatactttcattccaaaagaagaggtgaatggatgatagagttacagcaccagtctataatcagtgaacgaagtatatccttggcagatacatacc

SEQ ID NO: 632418 - DNA, 765 bp, Homo sapiens
gagcgggcgagctccagccggagttacgtgacctacgtccacccgcacctacagcctgggcagcgcgctgcgccccagaaccagcgcagccttctacgcttcgtccccggggcggcggtgtattgccacggcggctcatcatgcgggtgcgccttgcgggaagcagggtttgccggggggtgaccgggctccatgcaagggaccctccgggtggaacttttcttcggctgggaccgaagggccatttcaaaccaccgcggagttttcaaagagaaaccaaccggggaaccaaagggacgcacggggtgggcagctgcgcacgggacggtgtggatgtgggacccgggtttaccggcccaaagcagaaacatttgcggcacaaggtggtggacggcatccccgtggcaacggcacaggaacagaatttcagaggcatccccttgtgttggggcccggaaggcctgcacggaagccaagtctggcaacgagggcgcccaaggggggcaacaggctacggagcgccagtggggggggcacaccctgtcgataaccggaggggacaacggaaacgcaattgccagagtgaacgcctgtggccgccccggggacagtggggtgggaaccccagggtgtaacacgccataagcggcaaagaaaagcgccacaggaggatcagaagggtggggtacacacggcgacgcacctctgggcacccgagggcaaccattcaggtggccgccatccggggggaagaacactgtgcag

SEQ ID NO: 632419 - DNA, 416 bp, Homo sapiens
aaactcccttgctttgaattggcaccgaaaagtgggaataccggggagttgagatctgtaattcatagtcacacaagggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatcacactattccatacacaccaccatatatactagctgttaatcctatggaatggggtattgggagtgcttttttaatttttcatagtttttttttaataaaatggcatattttgcatctacaacttctataatttgaaaaaataaataaacattatcttttttttttcacaaaaacc

SEQ ID NO: 632420 - DNA, 482 bp, Homo sapiens
  misc_feature (66)..(66): n is a, c, g, or t
atgaaaatacatgacatgatgctcgtcctgcaagggcagtggaagcgcctgtgcccagtcccacgnagatgtgaggtggcccggggcaaaaacatcctcagaaatgccctggtatttcatttagatggaactactcctgtgtgtgaggacattggacgcagcctcctgacctatggccgccgcatccccctgggtgaatgggaaagccggattgcggaggtggatgccagtgtggtacgtgagatttgctccaagtacatttatgaccagtgcccagcagtgggtggatatggccccatttagcaggtcccagactacaaccggatccgtaacggcatgttttgggtgcgcttttaggcgggaagcctatgtaagcaaaagggcagggccggggtttgtggtccccccccccccacaaacaaagcaatttgggtcctttaacctgtgccacaggtgacccccaataaaatcctttggtgaga

SEQ ID NO: 632421 - DNA, 399 bp, Homo sapiens
cactgctgaccccatttctccacatcttcatcaacaagttattttttgtttatattataatatctgtcctagcaggtatgaggtgacagctcattgcggttttttgggtttttgttttgttttgctgagacagggtctcaactctgttgctcaggctggagtgcagtattgcaatcacagctcactgcagcttcgacctcctgggtccaaatgatcctcccacctcagcctcctgtgtagctaggactataggcccaagccaccatgcccggctaattttttgttttttctgtagagatgggggtctcactttgttgcccaggcaacacattgaggttttgatttgcatttttctaatgactagtgatattgagcatcttttcatatacttatagtcat

SEQ ID NO: 632422 - DNA, 833 bp, Homo sapiens
  misc_feature (354)..(354): n is a, c, g, or t
tcttgtcgtgcaggcggttcgccttgcaacccatgtaaatctgcctgaagtatacgccggatcatgctgcgataaagcgcgataaccctagctggttggggattaatactcgtgaataaacgaaggtgttgcctgcgtggacaaattaaacggcactttgtcagcgggtttaaatttcagctcaattttaggcgtggggggtgaattgtaaaggtgcctttgtcaatcttcgggcaaagtcaaggcaaggcaaatcggaattcctgaattgagtgtgtgaggttttgtctgggttttcccaagaaatctcgagttataccgcctttttatacaaactggcgccacaggttttgncgccctcaaaattaaaacctcgtttgtgggcttggtagacggccttcacgcagtcaacattgttggtgtctcaccacttgaagcatcggacggattggtttgtcacgagggttaaaagcccttggtgggggacacaattttataaaagagccacaaattaaaacccgggttaaataacaccggaagcctttgtggaaccaggtttttggcgacggagacttttggtgccgggtgtggggcattttatattttcacatcttttaaatattcctcctctttcccttgtgggaagagttttaaaagaaggttccattaaaattccttagaaatttcaattgccgcagaatttgtggagaggggaagtgcgcggaaagaaggccgggagaattgtgagatttcccccacagagggagaggctttttaacgatataaagagtgaaaggtgggaaaagttgggggggttttgaagacgggaaacg

SEQ ID NO: 632423 - DNA, 794 bp, Homo sapiens
tgtgctattattatttgaacaaactacatcttaggtcatttaagaataagaaaaataaaagtttttatttaccttcacttactccttcttgatgcttctcctttgttgtgttgatccaaattctgacctatattcttttccttccctccagagaacttcttttaatgcttctttcacaggcatgtctactggcaactaattctcttaatttggtttgtcagagagtctttatacttctacttatatttctatttgcagggataatgttatgtactttataattctagttgatgacactttttttctctctgtactttatttaatttattattatatatttatttgagacagagtcttgctctgtaagcctagggtggaacgcagtggtgtgatctcagttcactgcaacctctgcctcctaaagttcaaacgattcttgtacctcagcctgtctgagtagctggtatacaggcacatcgcgacacacccagctcattttcgtattagtggagacagggcttcaccatgttgcccaggcttggtctacgaattctcgatcctctaagttgatctactcgccctcagcattctcaaaatgctgagattacttccccgtgctccggcactctcttgtactttaaacatttcagactatactcctctttcttgggttcgttgtagtatctgagaaataggatatacattccttttggatcctcagtacataaggctgactcccccaattctggattcattccaacaccttatacatagtccgctatactgaaggttga

SEQ ID NO: 632424 - DNA, 410 bp, Homo sapiens
  misc_feature (346)..(346): n is a, c, g, or t
  misc_feature (380)..(380): n is a, c, g, or t
  misc_feature (406)..(406): n is a, c, g, or t
tcgcttcgcggggccttgcggcagcatggcgaaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtncaagaagtttgaacagggcttcatcacggacccncgtggtgctgagcccctcacacactntggg

SEQ ID NO: 632425 - DNA, 1527 bp, Homo sapiens
cccacgcgtccgaggcggtggtggtggtagcggtgtgacaggaggcctatggcagctgcccagtcctacctcagcccatcttgaaaacaatcttaggcaacatggaaccaccacgaggccctcctgttagtggggctgagccatctcgggcagttggcactgtcaaagtgtacctgcctaacaagcaacgcacagtggtgactgtccgggaaggcatgagtgtctatgactctttggacaaggccctgaaggtgcggggtctcaaccaggactgctgtgtggtctacaggctcatcaaaggaagaaagacagtcactgcctgggacacagccattgcgcctctggatggtgaggagctcattgtggaggtcctagaagatgtgccactgaccatgcacaattttgtacggaagacattcttcagcctggccttctgtgacttctgccttaagtttctgttccatggattccgctgccagacctgtggctacaagttccaccagcattgttcctccaaggtccccaccgtctgcgttgacatgagtaccaaccgccgacagttctaccacagcatccaggatctgtctggaggctccaggcagcaggaggctccctcaaatctctctgtgaatgagctgctaaccccccagggtcccaggtagggatgtcgtagatgaaaggccagggggccagtgaaagaaggattggaggaccctgagagattatactttcgtttatttgtttacgtgataaatactattgagtacctacaagtgttgaatatgggcatgggattgtgggatcattggtaaggcacccagtcactccaggtttcatttttttcatctgggaagaggggatgagattttccctagtgggttctgaagaggattaagggttgagatatttgcaatgcttaaagcaagatctgatacagagtaaataacaagtgttattcattacaagtgtatatataaaatcatctagtttgttcatttcttccagtataaccacaccccagtcttttctctttgaaataaatgttactgtatcagaaagtacttttatttcacttatgttggatatgatagcatatagttttgcataatatataaaaagtaaggttaatgtattattatttgtagttatgagtgcatgtgtgttgatttacctgtgaatttaatctcaggatggtgaaagtaacagaagaatgtttttctgtaaggtataattcatgggaggtggaggcaagacgatcaatagttcaaggctaccctccactaagtagcaagttcaaggccagcctgggctacatgagactgtcttaaaacagtaaaaaaggtgttttgtaacgtgatatatgtataatcgttatatgatgtgtgtaatgtgtattacataatataatatgtgtattgaaaacgttgccattttaatataggtaatgctcattattataaaataaataatatatttgaaaaatacatgtcattatgatatgtaataaaaagtcatatcttacccttt

SEQ ID NO: 632426 - DNA, 904 bp, Homo sapiens
ggaaagtctgcagagagagcggtggcagagccggaaaatggttgacacatattcgcgagcgagcgcccacctgtcccgtggagcgcccccccgaggatcccctcgggagagcccctgctgcaccccgcatgtggaacgcccccgcccgtgggggaaacaaaaaacaggagggcctcccgggggctacacaacaagggcgggggaccacacaaaaagggacacgaggcactcgccctccggggacaagagaagacccagcaaccagcgcaccaccgtcgcgaagcgagggcgaaacacccggggcggtatccctcatttacacagaaaagaacgagagtctctgttacaggactccctccctatcccgcacgaccaccacttggttcatcgcccacggaaagcaatacgggggtatcgctcggtagtagaaccacgcacacatctatcttctctggcgtgggagaaaaaaacaatatacgcccccaggtgtcgcaggcatggcggacggacccccgcggtttgctggtagcattcaacttatgtctccataagccccccacaacagttagatgcatgtttcctctctgcaagtggaacaatcacctcttttgttcttttctccgcaaacactccgcgggttttcgaaattccacgcacgccccgacacctcttcattagacaatggaattgtcatcgtcacaatttcttcagggggggactactaagggcccttcaacaaaagagctgttgcgtccccggcgggagtgaaaaaacgaacattattagcttggtaacctgcgtccagcatactagaaaaggactggacccatagtccccttgagcccagttggggcaagcctaagaaaggaccataaaaaagaaccctttgacagccacaaaacga

SEQ ID NO: 632427 - DNA, 426 bp, Homo sapiens
aaagggaggagcagtcagggcgctgtgtgaacagtgagcaatgaggccacaaaggcatcaagaggccataccatgtgggacttcccaagtaattactcttcctttatatgaaatggaagccagtggaaggttttgagtagagaagtgacataatgcaggacctgggacactcaaatggagaaaatgtacagaagtgagtgtgcaactgtaatgaaaaaatctaccagaaagcaaacaacctagtagacaaaaagtcaaaaaagtgtgaaaggccataaagagggtagttgctagccaaagagactgtaattcttcaaatatattagaagtttcttgtcacaggatgaaacttgtcagttttatctgcctttacaaacagatgagttgtgggagtctttctacctttctctggtgtatcaggcatac

SEQ ID NO: 632428 - DNA, 211 bp, Homo sapiens
gtcatatccgacatctgtgttttctttataggtcacagttagcctagtatgtgttttatgtgtattgtctggacgtataaactagattgcttcttatatgtatgcggtccaactatctctgatgtatggaagtaaatatctcaaaagcttcagaggctgagacattaatatttttttgcggcttactagtgttttttatatataatgaaga

SEQ ID NO: 632429 - DNA, 253 bp, Homo sapiens
cgtacatcgaaccacaaagcttctaataagaggaacccgctaggctacttcctgcttgtggaatgttatcaaagttagcctactacagaaaacagtcgacttcttgtgaaggtttgggacaaatatgtatcagtacgtttcatctgggtattcaatactatccttggtgttgatgctgactccatggcttctggaccccagcatttgaccctgcgtgcccagctggttgtagccctggagattgattgaggtt

SEQ ID NO: 632430 - DNA, 390 bp, Homo sapiens
tcttctcctgacatagggaactgcttctcagagagggtaatgacttacccatgattgtcccaatattcagcagtacgatgtggtactagaactaagttctgttgccatattgtcaatatttgcctgaatttgtttgttgtatgaaataaccaggtttttcagttttggacattggtttagactcaatctaaaaaccattaaattagttcaggctgtaccttcctgtccgccaaaaacattatcccagttgtgtgtaatactgtatatatatctaaaacatcttatacaaatgtttttatgtaatcaaaatgagttttcttaaatttaaatacattggatttaccactgataaattagattttaatcagattcaccttgagtgttatatta

SEQ ID NO: 632431 - DNA, 885 bp, Homo sapiens
gctgagtggagccagtggtggcccgtgtcctccccgtgcagtgccccctcccaccaaggttgtggccccgtccctcatccagcgacagcagcagcgatagacctcctcgtgacagtgacagttcgactgatgactctgaggaggagcgagcccagactggctgtgctgagctccaggagcagctcaaatgccgtgcacgagcagcttgcagccctctctcagaccccagacagaacagaaccacagaaaaaggagaaagacaagaaggaaaatgaacaaaagaaagagcacaagaaggaaagaggaagtggaagagaatgagaaaaaagcagagccaatggaacctcctcctaaagagacgaagaaaactacatagcagcagacagcgatgtgagcagagaaggagccagtgcccatgaaggagcaagccccctcccattgtatgagtcggaggaagaggacaagtgcaagcctatgtcctatgaggagaatgcggtcaggctcaagcttggacatcaacaagctccccgggctgagaagctgggccgcgtggtgcacatcatccagtcacggggagccctccctgaagaatttcaagccctgacgagatgtgaaatcgatttgaggaccctgaatcctgtcccacacttgcgttgaggctggagcgctatgtccacctccttgtttgcgggagaccaaggcaacctcaagcttgagaaagttgatgtgattgccgggtcctccaacaatgaacgctgtctcaccctcaagagcgcgaccactccagtgagtcagttcctctgcaacgaagctcgaacggtcctgctaatcttggaccggtctaaaacacggctcatccgatctccaccaggtactaatccactc

SEQ ID NO: 632432 - DNA, 293 bp, Homo sapiens
gcgagtgactggtgagacagctttgggctcggctgtcggggacgcatattggaggaggggctcctagatgtctggtcagagatggcacggggcaaggacatatgagaggcagctgagggttgccgggcgagctgcctcacgcctgtaatcccagcaatttgggaggctgaggcgggcggatcacctgaggtcgggagttcgagaccagcctggccacacatggtgaaaccccgtctctaccgaaatacaaacaatcacgccggtgcatggtggctgggtgcctgtaatcccag

SEQ ID NO: 632433 - DNA, 331 bp, Homo sapiens
ctgaatggtagatgaacggagtgtagtgtggtttggtagaacaactgcattgcacagttgttccacttgcacgggagcactgaacgttaagatgcataccaagagatgcatgctgcctaatgagacatataatgctggctaccagctgtgacacatctctgtgcatctgctcaagcaagtgtgggtaacaacacatgtcgaatgctttttaacagctgatactgtgtaagacgccaagatgcttaggctgagatcggcgctatgtgagtgatatactgagatacctttttgaacacttaacggttgatctgagacattgactaatgtggtt

SEQ ID NO: 632434 - DNA, 170 bp, Homo sapiens
ctacacagccgctatcctggactctgtatgcaatgagtccacccatatgtatggcccaccgatccaccccagcagacaccctcattgacacacgtggtacaccaactgtggcaaatcacagccccgtatctggatttcttactaagcattctttcaagtctactattccc

SEQ ID NO: 632435 - DNA, 260 bp, Homo sapiens
  misc_feature (195)..(195): n is a, c, g, or t
cacgaggctcgaataggggccgaacctagccagaccgcgcaacggatgcatgtcgcgatcgctcggccggtccggatggaacaggagctgcggctcggccagccggacatgatgctgcagctgaccggtcatggcttcgctgcccaggaatgcgccgaccgcgaatcgatgtcgaagatcgcgtcgattccgtcnccgatcgcgaatgtgcgcaggtcctttccggcgacgacgcccgaccaacaatggatgagcttgtc

SEQ ID NO: 632436 - DNA, 227 bp, Homo sapiens
  misc_feature (114)..(114): n is a, c, g, or t
cgggaggatcgcttaaacccaggaattcacaactaacctggacagcatattgagacctcatctctaaaaaaagaaagaaagaacaaaagaaggaaggaacacccagattcatanagcaagttcttagagatctatgaagagacttagataaccacacaataatagttggaaactccaacaccccactgacagtattagttcagtggggaagaaaactaacaaagata

SEQ ID NO: 632437 - DNA, 389 bp, Homo sapiens
  misc_feature (322)..(322): n is a, c, g, or t
cgggaggatcgcttaaacccaggaattcacaactaacctggacagcatattgagacctcatctctaaaaaaagaaagaaagaacaaaagaaggaaggaaggaaaagaaagaaagaagaagaaaagaaaaggacgggaaggaaggaaagaaaagaaaggaaagaaagaaaataaatcactcaaaaaaaaaaaattatatgattaccttggaatttaaacaatgtgctcctgaatgattggggtgaacaatgaatttacggcagaaatcaggaaattctttgacatgattgagagagaagatacaacataccagaatgtcaggnatgcagctaaagcagtgtaaagtgggaagtttataatgctaaatgcccacatcaaagttagagagat

SEQ ID NO: 632438 - DNA, 202 bp, Homo sapiens
tgggcaacataatgagatctcatctctattaaaaaaaaaaaaaaatgctgggtgcagtggctcatacctataatcccagctactcaggaggctgaggcaggagaaatgcttgaacctgggagacggaggttgcagtgagccaagatcacgccattgtacttttgtacttcagcccaggcaacaagagcgaaattctgtctcc

SEQ ID NO: 632439 - DNA, 857 bp, Homo sapiens
gcaaagtgtacaaaatgtttgcctcacggaggaagcagcgctactggccattctccatggactgcaccggcacagaggcccacatctccagctgcaagctgggcccccaggtgtcactggaccccatggaagaatgtcacctgcattaatgaatcggcagtcgtggtcgacgcttgtgtcgcctgggcatttcttcagccctgacggaccctacgagattcctggtaaagcgtacgaagcgagagcagcccctgtgtgcgactgagaggcggctgcctacatacgtgggagtggccgcggtggaggtcgctccaagcaatggcagagctggagtgctgactgtctagcgcacgcatcaagctgtgcgaccctgctgctctgggccagtgggtgcgccaccgtggccagcaccgaggcctgcgggctcgagggggacgctgacgcgcaaacgcacggacaccaatacgacactggccgaatcccgacgaagcaatggacgggcgaaagcgaggaatacgggcaaccacgagatccgcaccgttcgaaccgaacgaatgccccgaggggatgagcacctatgtcggcccgacaacttgcaccgtaacacatttgttcggcatacgtagtcctatagagaaccttgagggaacaacgaggagtgtagaggataagtagacacacaggaggtatatcagtcacgaggaaggcgcgcttaggggaaaccccactaggcaagaaaacaggaagggggcattgtccctagggacgcggttcggaaacgaacgttgcacacagccactgccgcgcattaggaccccatactaggggcgccatcatcgcacaccaaaaacagacag

SEQ ID NO: 632440 - DNA, 1506 bp, Homo sapiens
gttgcgtcttgggagatctggacgtgacgcaatggtgtagttggacgaagatttgagaccctgaggtgggctcccttcttagtatgtggtggaggtgtccgatgggtgaggtggctttcctacgtatgatcgatggaggagtgtgactaccacaagatataccacgagtgattggatcgccttgattgctggtcttgtcgaacgtgaggggtccgggcgatgtcctgcttgcttctccgtgttcttggttcacggcccgtacgaaccttctggacagcattagtgaaggaacagattaggtcatctgtgtgacaaaggatgatggtctttcacgtggaaggatgattcctatgcgtgctcgtgaagccaagagatgccaatctcatgtcacctactgtaaaggtgaatttcgcaagcagaggcttcgacttccttgaccctacgtgcaggaggaatctccaggttcgtgtatcgattcttgtaataagcggggagaattataaacaatttcactttgtaactccttgtccttgaacacccgctctcggaaatcattgctacctcttgttgacgactgacgggagaggggagaataactggggacaaaggagattaatgggactatatccttcactgggatcgtgaataggattgcggctgagtagaagtagcaattaagtggtaggtgaggatacgaattcggggttaccatggtattggtctctttctcatataaatttgagactagaatgtacctataattttggggtacatttgaagaggaattggtaggcattattggtgatccttgatggacatggaactaagagaaggttaattaataacgtagtaaaagacaataggatagtggagaagatgggggaaaatatttttgaaaacgattcaagatgtgagtggtgtagctttggatttagtgagtatgggaataatctttaaatgggaaaggtagagaaggattgtggggtgggaaaaagctcaatttggaacttagttgcacggaaggaaaatgggtgaccagaaagaggtcagggactttggcaggaaagatggcaaggaagtggaagaaagattaatgtaactagaaaggatggttttgatagatacaagtttgggcctctgttgggggaaaaaacagcacatgttatggaacattgggggaaagggggtaacaataggtttggacagtaaaagaaaaggggaacttacaagtcgccaccgcgtggacatcaacgcagccaactgtgcaagggaagtggaatccgagccacgaggctcatggagacagcaacaatttgatcagactatagacaaacgtggaaacttctaaaagagatagtaactccacagacgatgataacaaaccaaaactacacgaggaacaaagcgaagtgctggtaacaccagtgaactagacacaacggtctgtgaacacataagacaacacaaatcatgacacgagcaagatgatcagcagagaatgactaa

SEQ ID NO: 632441 - DNA, 226 bp, Homo sapiens
acgtctgctcccaccttaggcctctgggccagagtgtcctctggccatgctcatcttcccctggtttttgcacaactgtgcctacttcagatctgtcattcagatgtccgcttaaacatcactccctgagaggggcctttcctatcatctcagttccgcagggcccctcactctgctgctttgcctttttattagcctctctctgattcgtgtatcctctgacgtc

SEQ ID NO: 632442 - DNA, 666 bp, Homo sapiens
gatataactatcatacaaatcagatactacacaaaacatccacagaacttttttcatcttttattttttgaaatggtacacaaccattccctacttaacccaacatccaacagaaaaaatggtacatcttttccttccatttggcatacaatggaaaaccaagtatatattttttttacaaagttaaactaataagacactagagcaaattgacagttaaagtctataggtgaaaaattatctaataaaaataatcaatttttccagctattagtcactcccatacccaagtgttatcctgattaataaaacttgctgcgccactcaaaattctggtattatactcataccattactcaacttgtattactgctccccaccttattttcttcacaactaaactatagaaatattgttgaaaagtaggggcaagctattggcaaaaacaaacaaaaatatccccagcttatttataagctatgatttatgttatcgagggaatttctccccagcaatagatttccaaaccatcaagaattcaccagaactaggttggccaagtaatttggcctatgtccaccaagagatgcacttatttgtccaccagaggagctgacaaataaccttaggtgtaagatagggggtgggttgcgacctccagccccc

SEQ ID NO: 632443 - DNA, 1137 bp, Homo sapiens
cttgcgtttgaagcccctagttgattcaatcaccgaacacgttcgtgttgatagagcctcccgcacggacatggtcagccagcgcgtgtcgttggaaacgagtccctctgagaccgtctctttgtttagtgtgtgtcgcagaacgaagatgagtagtgtgttggatgaagaatgggggggagaaactaactgttgtctacattcactcaccccggagtgatatcttcttttacggggggggatttcttcctctgcggacgactcttcccccccaccacagaaggtgttgttcatcactgatgacatcgtagaaagtgtttccatacagagtgagagaggaggggcccacagacaacagcccacacgggggggtattacccacccccccggttagtaattcttctcacacgcgacactcttttgggggagggcgccgcccagtgtgataggccgggggtgtcacaattctagaggtgtatcagcgaggtgtctgttaaaacagaccccacaggagtggcgcgcacacacaacagaggggtggaaacgccgccccgcgtgtgtctttcatcctggtcgataaattcccacatctccctcgaaactcacactacacaccacacacatttatggtgcgcgggcgtgtgggtggcggacacacacacaccgctcgtaggggtcacgcacagcggggaaccttcttgtgagggaggccatctagtggcccacgcgaggagagttccgctcgtagacaacccacgcggaaaccccagagaggtgctgtcacaggcgagcccccgagagagtcctacatagggctctcgcgcagttccccacctcggggtaacagagagatgtggaatctgctcttttctccacaaagatcccccttgacccatcatagctccatctcacagcctcacccagatttattaagagggctgacaaaatcaaacacaactatggtggttgcaaaataagaggtcattgataaatggagaagtataacccaggaagctaatttttggggggcaaaaatttgggggccaaaaacccctattgggagaatatgtgaggggaaaattttttttttttataatagaagcacaaatatggggataaattttttttattttacca

SEQ ID NO: 632444 - DNA, 470 bp, Homo sapiens
agcggggataactgtgcgccgcggtgcgggccagtgcagctctgcgatgggccggagcgcggtggagccatgcagtaaccgcatcccgggccgggcggcgggcgctgtgtgggtggcgctgtatgcgcctcacgcggattggtgcaaagcgagcatgaaacacgaaagtcgctttttacagtctgaaggacactccgtggtgctcggcagggacgcgtgcagagctgcgacgacgccaagtgcgtccgaaaaccgaagatggttgcatcgagcaacaatagcaatgattattgaagcactgtcctcgttcgattggttcacgccccaatgatttgaagaccctccgcagaaaggtttggtaccttgcaaagggggcaagaattacaaaactcctagaaatttatcccatcccgtaagacaacaaatcgccacgccaggagcaaacaactggacacgaacgggcatatata

SEQ ID NO: 632445 - DNA, 231 bp, Homo sapiens
tctgtgcgttacaacacagtagccactaactattgaacatatcaaacgtggctgtcgtaagtaaataaaaatatcaattgtatatttctatctatattttattttggagagggagttggccctgtcgcccaggttggagtgcagtggcgcgatctctgctcattgaaggctccgcctcccaggtacatgccattctcccacctcggcctcccaaatgtgtggggataacag

SEQ ID NO: 632446 - DNA, 193 bp, Homo sapiens
gtggtccctgtgggcccacaagtaaaagtagcgcctatagtagtcccctctagcacagaactagagggcagagtcctcagatgtcagcctagtgagctccatattggctgcgctgtaggagttgttacgctcagtggggccctcgccttaaacttctattgtatcgtactccctctccggaaaatcatcatta

SEQ ID NO: 632447 - DNA, 895 bp, Homo sapiens
ggccgtcggagcccttgacgcctgtctcttgtagcttctctcaggcctagcccagcatcactatggtggacgcttcctgggcacctggaactagtggacagcaagaatttcgatgactactttgaagtcactcggtgtgggttcgctaccaggcaggtggccagcatgaccaagcctaccacaatcatcgaaaagaatggggactgttctcaccctaaaaacacaacagaccttcaagaacacagagatcagcttcaagtggggggtggagttcgatgagacaacagcagatgacggaaggccaggtccattgtgacacgtggatggagggaaactggttcacctgcagaaatgggacgggcaagagaccacatttgttgcgggagctaatggagtggaaaactcatcctgacactcacccaggcaactgcagttgggcactcgccttcttgagaaagaggcatgacctgactgcactgttgctgactactactctgccaatcggtacccctcgattcagacacattgctcaattcttcctctgcatttgtacaatccaggaattctcgtgggtcaggtgccctgaccggaatcagtcccaggacgagtggggtatgtggttgtatttcaagaaggtgaccataggggggccggaggcaccctaagggagcaaggccccagtgcttttgctcggtcccacaaaccacaacgaaaaaatttggggggctgcaccaaaaagtttaaaccttggggggggcaaagagagagaggacgtgcgagaccgggagagggggtcccaaaaaagcgcggaggtggaacaaggcaggctcggtaaccgcacacaccccagccgggcggaacaacgcaaaaagccacgacaatacactagcaggag

SEQ ID NO: 632448 - DNA, 901 bp, Homo sapiens
  misc_feature (1)..(1): n is a, c, g, or t
  misc_feature (109)..(109): n is a, c, g, or t
  misc_feature (158)..(158): n is a, c, g, or t
  misc_feature (247)..(247): n is a, c, g, or t
  misc_feature (252)..(252): n is a, c, g, or t
  misc_feature (269)..(269): n is a, c, g, or t
  misc_feature (325)..(325): n is a, c, g, or t
  misc_feature (333)..(333): n is a, c, g, or t
  misc_feature (339)..(339): n is a, c, g, or t
  misc_feature (342)..(342): n is a, c, g, or t
  misc_feature (376)..(377): n is a, c, g, or t
  misc_feature (387)..(389): n is a, c, g, or t
  misc_feature (429)..(429): n is a, c, g, or t
  misc_feature (435)..(435): n is a, c, g, or t
  misc_feature (456)..(456): n is a, c, g, or t
  misc_feature (479)..(479): n is a, c, g, or t
  misc_feature (528)..(528): n is a, c, g, or t
  misc_feature (533)..(533): n is a, c, g, or t
  misc_feature (536)..(536): n is a, c, g, or t
  misc_feature (543)..(543): n is a, c, g, or t
  misc_feature (552)..(552): n is a, c, g, or t
  misc_feature (566)..(566): n is a, c, g, or t
  misc_feature (568)..(568): n is a, c, g, or t
  misc_feature (573)..(573): n is a, c, g, or t
  misc_feature (575)..(575): n is a, c, g, or t
  misc_feature (577)..(577): n is a, c, g, or t
  misc_feature (579)..(579): n is a, c, g, or t
  misc_feature (581)..(581): n is a, c, g, or t
  misc_feature (584)..(584): n is a, c, g, or t
  misc_feature (589)..(589): n is a, c, g, or t
  misc_feature (616)..(616): n is a, c, g, or t
  misc_feature (632)..(633): n is a, c, g, or t
  misc_feature (735)..(735): n is a, c, g, or t
  misc_feature (892)..(892): n is a, c, g, or t
ncttttctcctctagcactggttggtaagataagcccctttgcttctctagtagccaggcattatggacttgacagtcttaaaatgaggctttattgtatttcaggctngaggcaggttgccttttctcctgaggaatcttcaggcagtggtaaatanttacttatcactcagtacttctgtgccatgaagaataagcttcaatttattcaatccttagaaaagttactatcgtcccctggtcagantactnaggtgtcttgataatgntccttgagactaccacttagtctttattctaatttgtatgtgaataggtttcaggnatatggtncttctncgntgggcctgaccctttcctaatctcattttttttnnacatcttttnnnttttttttcccccaacatttccagccagcatattaccctntttctnggaaattgagaggagaaacantattatttatatatatttctttnatattggaactgtgagccaaacctaataaataatatttattgtgtaggntagtngtngtagtgnggaggtcanggagcaatcccttntnttttntntntntnttnctcanggaacatcagttcacggggggaaggcngtttctggaacaaacnngggggctgcccgacgctcaaaggcagcaacattctgtttgacaacctcatcaaaaaacatggtggccagctgggagtgcagcagagaacgaaattcaaaggnaatcgaaaagtccacagtgcaggttcgaggataggcaggaataccagggctgaatcgccaaatagtctctaagtggttgaagagcttgccatcagtacaaacagcttgaacatgtgaggtttgaacatgggaactgcagaggtgtaagtttcctganaggtgggaa

SEQ ID NO: 632449 - DNA, 249 bp, Homo sapiens
gctccgaggttccgcgcgcctcatcgcgccgaggttccccactgccgtcaatgctcagactggatacatgcacatgtggtacatatcaccatggaatactacgcagccttgccaggaacatgatcggctgggcgtggtggcttccgcctattattccagcactttgggaggccaaggcgtgtggcttgcttgagcccaggagttcatcaccagacctgatgacagagtgagactccatctcaaaaaagc

SEQ ID NO: 632450 - DNA, 332 bp, Homo sapiens
  misc_feature (99)..(99): n is a, c, g, or t
  misc_feature (104)..(104): n is a, c, g, or t
  misc_feature (138)..(139): n is a, c, g, or t
  misc_feature (144)..(144): n is a, c, g, or t
  misc_feature (152)..(152): n is a, c, g, or t
  misc_feature (154)..(154): n is a, c, g, or t
  misc_feature (157)..(157): n is a, c, g, or t
  misc_feature (198)..(198): n is a, c, g, or t
  misc_feature (238)..(238): n is a, c, g, or t
  misc_feature (255)..(255): n is a, c, g, or t
  misc_feature (280)..(280): n is a, c, g, or t
  misc_feature (304)..(304): n is a, c, g, or t
  misc_feature (315)..(315): n is a, c, g, or t
  misc_feature (321)..(321): n is a, c, g, or t
agagagagagagagagagagagagagagagagagagagagagagagagagagagagagagagagagagagagagagaaaccatttatgacagagaaatngatanaggcattgggggccactattgaaattattatttnnggggncaacaagntnggnactttctgacttctgtatcttaacataaggggattttaggnaatgctaagtcagttgtctcattttttgtgataagttttngggatttttagttaatngaaataaataatgcttttacttggncaaaatgcatgtatagcatttctntcatcttagtnccttgngtttccctatg

SEQ ID NO: 632451 - DNA, 174 bp, Homo sapiens
ctctagaggatcctaccccatctctaccaaacatacaacaataatacaggcatagtggcgggtgcccgcaatcccaactactacaggaggctaaggcagtagaattgcttgaacctagggaggcagaggttacagcgagccgagatcacaccactgcaccccagcctaggcaac

SEQ ID NO: 632452 - DNA, 1384 bp, Homo sapiens
gagaggccagtgcccggggtgaggcggcggcagcggcggcggtgctggggcagccgcggtgcagcctcgagtctccggatcctgggccgtgtgctcggcgccattgatgccggcgtgtcgggcctttcggggcaggtcgggcccgtgggtggtctcggcgccgacgggggcagcgagacctagactctgttctgtggtagccctggcgtggggaggcgtgagtgatgcgtgctgtcgctgtttatccgggcgcctccagcggttggcgactaggacgagggctcagggcccgccgctagggtcagcggtagcccggcaacgctgccaaagtgcctctgagtcgtctacgcccccaataggcacccgcttggaataggctttagccgtttgacctcgccgactcggtgccatgtcgttggagtcgtcctttggagcctaggctacggggggaccctcgaaatatcagggaagtaatggttaggctggctactggatcatccagaagaaacttggagatttcccgaacacccactaggtttcgtaagcagtgtcctccaggaaatgtgcggagggaacgcactctgagggacacctgtctggggacgatactgatgcttgaaaagtcggggctcgaagggggggcattggcaggcggccggccaggagcaatgggtgcgctaccccaaaggcaatcggcacctggtgggcgccccgcaatgtgagggggcctaaatgccctaggattcgatcacctaatcgcaaaggaaaggaagacgttccgtggggtcggacactcgcgtgggaatttcttgggacctcgtggtgcgtggaaaatcgggtgccattgggagggggggtgtccccatttgcctgtgtggccaccatcacacgtttctcgacattgattttgacaaccgtaaacattttcggaaagtttttacagaccgaacaatcccgttgagccttgcgtggtagtaaatgggagagaacccacgggggtttggagaactgcgctgggtaaaattgccttttacttagagaagttgacttgtatagggtcggagaactacacgggtccccattgatagtaagacgtggaagccttgggagtggatgggcggaaatggcctgggttccgcaagggtatgtgttggccttgatttggaacgccctttgcacaaattgggttgggggggggcccacattggcgaataattgggcttggtttccacaactttggggtcggacaaacacattactggcggggtagatccccctgtgaaggagagagtggcgcttcccgtagaaatcgttgtttcacaacgaccgaagggcacaccccgagaacagggcttgacaaatgaggatttcgtggaactaccaa

SEQ ID NO: 632453 - DNA, 150 bp, Homo sapiens
ctatagcatgttggcccacatgaagattgggggcatgcgcagttcaggggcagctgtccagtgtattaggcccagtgtgaacacagccttctctgtgaagcctcccagctctttccagacccggttggagccgtgtccacttgctttgcg

SEQ ID NO: 632454 - DNA, 303 bp, Homo sapiens
aacacaaaaaagaaaggagatcctctctcctgtttactgaattttaaacaatcttgtggggttttttgtttgtttgttttgagatagagtctcactctgttgcccaggctggagtgcagtggtgtgatcctggctccctgcaacctcaacctcctgggttcaagtgattctcctgcctcccaagtaactgggactaccaggcgcacgccaccacgcctggctaattttcgtatttttagtagagatgggatttcactgtgttagccaggatggtcttgatctcctgacctcatgatccaacca

SEQ ID NO: 632455 - DNA, 158 bp, Homo sapiens
cccgtagtgatctgaatgttgttgtcatgcaatgttgcagaactgctgggaatggtcccccaggccccgtctgtgggagcagagtcgagatttgctggcaggatgtgccccctggggagctgcagatggtcctcgctctttctcctacgttgtagaga

SEQ ID NO: 632456 - DNA, 380 bp, Homo sapiens
ccgtactaggctgggacatcatagatagcagagactgagaaaatacagatcatacagagctcagaaatcaggggcagtgaggtaccagtcgggggcatcagactgcactgaccttatctcgaattatagccacaatttcaagcttgcccttaccttaaacccgaagctcatacctaatgcccttcctatactctcccagaagaaaaccttatctcctcttttactttgaagagctgaaatagagccgctactgtttccacttccctcacttcacttccacatttctctagctctctgcctatgtatattttcttatctgctctaatgacagagtaagttacctaaattctaaaactaacctcttagggcaaaagctctcc

SEQ ID NO: 632457 - DNA, 136 bp, Homo sapiens
  misc_feature (25)..(25): n is a, c, g, or t
  misc_feature (51)..(51): n is a, c, g, or t
tgttactgccccgcccgtgatcccncttggaccccctcgtcttccctccangatcccatgcccttcctggcttggggtcactggggtctcattctgggggctaaaagtttttggagactggctcaaattcctccct

SEQ ID NO: 632458 - DNA, 183 bp, Homo sapiens
tatagaggatccggtcagcaagtcagccaccagccccgatgggaagactgctgcacgcacctatctgccagttgatcctggaccccatcttcaatggtgtttgatgctgatcatgaatttcaatgaaatgaggagactatgcagaaactgactagagaaacttggacatacaaacttggacat

SEQ ID NO: 632459 - DNA, 172 bp, Homo sapiens
aacagcagatgaccaataagtgtcaggacgttgtaccagacggcaccggccagcagatacatcggctgctgataccagtgctcatacagtgatgttcccaacatagtgtaaatggcgatcagcaatgcaccgaagcaattgttgcatagcgttgacccagaccgccgagcaa

SEQ ID NO: 632460 - DNA, 477 bp, Homo sapiens
gagaaaccaaacaatgtgacggtacatgtgatgaaaagctctgggtttatttttctcctgcttatgaacatgtatttttatttgccgaatgaaaatcgtggtgtgttgctttgatgaatggaatttcaggctctccctgtgcacagccggtgggaagtcaacccttaaatgcctcttttctccatatctgtctgttaatctccacaaaggttgcgtttttcagatgaaagctgggtgtctgcaaatagtctgtccttgtataagagtcagtgtggtgacggtcaatccccaataattactggttattatggggcttagcacggctgtataatagataatatgttaataaagaagctatatttatgtggattctaatgtgagtttggttctgtacatgcaatattctgcatggagtataaaggggggtaagtgagccattatgaaaacggtttatctattgtgtttccagaaggaagt

SEQ ID NO: 632461 - DNA, 129 bp, Homo sapiens
tctgccctgactcttggaagcggggcagcaggtggtgagagatgacccctgttgaggatttcacttggtgtctgccacaagccgccatggcatacatgatagaaggcgtactggtccgttcgtaggagc

SEQ ID NO: 632462 - DNA, 649 bp, Homo sapiens
attttatttttgtttggggttatttgggttttttccccaacatttggtatctttaataacatacacaagggttcccagccatatacataacaaaatgttattcataaatggtttctaaaaataacatttttttccctttatcggggtgaaaagctggagaatgtcccagtggggaaggtgggtagaggtgggaggagggcgtagaagagggagaccctggcttccccgaagtctgaacccccaaatcccctccctaccaccggggccccgaacacaacccctcataaggaatcgggaccagaacagtcgtgtcggactcgtggggcgtgggacgaactcctcgtgggataagtagatataggtgtcccacttaagtgaaggctcatgacatacagtgggggagggaaaagggcgtgaaagcaaacagggagggggctatagggaacaacacccaaaacgccaaagcaatccccgtttccctaatcccagtgacccccaggtctcaccaaccagacctgggagcggcaaagggtgtgtgtcccggggggaaggggacgtaaagggcaccaagacttcctgacctacacgggataccctggttgccacctccaacctctactccgggtagccgggctggggacactggtca

SEQ ID NO: 632463 - DNA, 390 bp, Homo sapiens
tcacgagccactggtgggctcgaggcagtggtggggacttgtatttaaagctcaaatccacgaccgactctgctgggctggaagatggtctggcttcattttccatacaaactttttcaaatagctagtcaagtaaaaatttacctgttctaaagatgaggccaggcacggtggctcatgcccgtaatcccagcactttgagagcgtaaggtgggaggatcgcttgagcccaggaggtggaggctgcagtgagccgcgattgcaccactgcactccagcctgggtgacagagcaagactctgtctcaaaaaaactagttttcttttttatttttttttttgggtcctatccttttaaaatgtaccgttgaaaagttgtgggtaccgagct

SEQ ID NO: 632464 - DNA, 1052 bp, Homo sapiens
tgcccgctctcgcacataagttttatggtagcattgagccatcctcactcgctaggattatgactctactcgttcatactgcatgtcctcgctattatgcctagaacccgaatacattactacttccggttcatctattaatcgtacgctacaataatcccatcagaattactccaatgtccacgggcttaagcactgtattgtgggcgtatcgtcttatactagtcttaggcgtcggagaatgcggacgcgatgggtcgtttgcctgctccatctccaagtgctaccaggagcgtaatgaacactatatgtgaggcggttaacactagatccttataaatcatatgtcgcaagtgacgtgcacaactaatcagacccgcgaacacattgtatttcctgacccatcttgatgttcacttctgccatatatacgcatgcattgcactgcgatactcataggcaacggcctactacgcacagcaaggcatatatccctttgcgctctgagttcgctcactcctaacttgaattgtggatcttcccacaagttcaggcaacattcggctaatacgtaacagtgtttcacaccactgcttgtctgccatcgcgaaaacgcactcaaggctaaatcagcgcgtccctaaactagctccctgttcacgctgcatccacatcactcggccgcactagttcatagggcggccatccatgccctgcgcattcaatccgcaccccacggacagcgatcgccactcgctgtactacccttctgctcaccctgacttatgaaagcccgttcaccatacaacttcaccttccactggccgcgctatgcgcgtcgcttcgagatgacacttctacccccctggatcctctcgacgctcagctctctcgacaacctgcacagacgcctctcttccgcgactgcgggtctcccaacactcgccctactccagccccaactccgtccaaccatctacagcctatgcgatccgccgccaaagctacgacccaacagatccaaccatcaccaccgcccaccgcaccctatc

SEQ ID NO: 632465 - DNA, 138 bp, Homo sapiens
tgtactttcggcatcgatgaggatttcatgagatcatttgaatttcttcctgggtggtctctctcaaggatgaggttttgtagatatgtcatgttcagaagcagacccgtgccggccagcgcaccaggtgctaaggca

SEQ ID NO: 632466 - DNA, 234 bp, Homo sapiens
gtgactctagaggataccgacaccatagaatgccaaaaccaaggagcctgccacccaatgtgcctgagccctgccacccaaagtgctgagcctgccagccaaggttccggagccatgccacccaaggtgcctgagccctgcccttcaatagtcactccagcaccaggccagcagaagaacaagcagaagtaatgtggtccacagccatgccctttaggaggcggccaccagatg

SEQ ID NO: 632467 - DNA, 762 bp, Homo sapiens
gaatgagtcggtaccaagtatcagcagagaagagaggggtgtgggcgggaatgggtcttcctgaagtacatccccgtggggacttgaacagagctccatgaggagctggttagtgatgtcacgcccgtgcggtttgactccggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacttgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcactgggaatgggacctatctggaaatagggtctctatggatgtcattgagt

SEQ ID NO: 632468 - DNA, 441 bp, Homo sapiens
agatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggctgtcacgcctgtggtccaggcactttgggaggccgaggcgggtggatcgcctgaggtcaggagtttgagaccatcctggccagcatggtgaaaccccgtctctgctgaggagaatgcagaaattggctgggcatggtggtagcgcgcgcctgtggtcccagctactcgggaggctggggcgggataatcgcttggacttggcgggtggaggttgcagtgagccgggatggtgccactgcactgcagcctgggtggctgagtcgagctccgtctc

SEQ ID NO: 632469 - DNA, 1041 bp, Homo sapiens
acaccagagactgagtcctgccaaccagccgggatccctcatcagacaacagggacaccacaaggcaacaggagctcaagtacgctctcggcgaaccctcctgagtaacttgtggactttgtcgtcttggccacttcaacgcaggatccggccacaggacgtacagctcagcgctggggagggggttccctgaaaaagtcacactggttttaaagacaaaaggagacacgtccttcaggtatggaagaaagcaatcctccccgggacagatcctgggacgccacccgcatcctaagtcagggacagagaagagaggggtgtgggcgggaatgggtcttcctgaagtacatccccgtggggacttgaacagagctccatgaggagctggttagtgatgtcacgcccgtgcggtttgactccggctgagaaaacgctggggacagtggctcacacctgtaatctcagcattttgggagcctgaggtgggcagattgtctgagctcaggagttcgagaccagcctgggcaacacggcgaaaccccatctctactaaaaatgcaaattagctggacaggggtggcgggcgcctgtcatcccagctacttgggaggctgaggcaggagaatcgcttgaacctgggaggtggaggttgcagtgagccgagatcgcgccatcgcactccagcctgggcgacaagaaggcaagggaggaaaaaagcagggaattcaggggcagcacctgggcgaggcaggcagagtcggcgcacatgggcgtgtgccagggagagtcggggccgcactgccggtgagtgggcaatggcagggccttctctggtgatcccctgattcaggcgccccaggagggttgcctgttgcggggggcgcatgtagctgcacgcccctctgtaattgctgaaataaaaagatggtctgctgtagtgcagtgaatggtgtccccttaaaagatatattcaggtgctgaccctcagtcactgggaatgggacctatctggaaatagggtctctatggatgtcattgagt

SEQ ID NO: 632470 - DNA, 255 bp, Homo sapiens
agctgaggatttcgttcgcgaatatacagtacatccttaggatatcctagagcagctctggttccaggaccccctgcagataccaaagtccgcacatactcaagtccagcagtcgtccctgtgggaactcatgtatacaaaaagtcagacctccatatcggtgacgtttcatactcctgcaaactatcgccacttttccatccacacctagctcgtgcgatgcggacacacacagactatggacgagccaaactg

SEQ ID NO: 632471 - DNA, 1115 bp, Homo sapiens
ggagagaactgtctcggttttttctgatgggggattcctataaattaattccattttaaattctctgtaccaaaatttctcaatctatgaaaataaagttggcaaagggcacaagtagcccaggagcctcaggtcaggaggctaagcacgctgacctaacactatattgtacacgttctctctcccacgaacggaaagaagaggcctactggggcaaagcccgagttgcaggtccgggaaaagccaatgttggtctaaccgtcagcacacagggaaaagtgtaccccttcatatttcccgtgataaacacaggaggcaaaaaagccacataagggtgccatgcagaaccaaaggaggggggccccccaaaagtggcttcgagccccgtgaaaggtgccccggaatggggaccaccgagaaggttccaagcaccactcagtgggccgccgcggcacctaaagaggtctcacaggaaatcgggccccgataggggcccattcacacgcggaaaaaaggggccacacagtgaaggcgcgcgagggtaccacaacatgtgtgtgtgaaagtgccaccaagagccttcatcatatggaccacagtggcccattctagggccctttctcaagagagactttacgacaacgccagtgggatacctagaaacagcccgtggtcagcgggtgaacccaaagagtgtggctcatacggagacaccacgggtggtgtgccatatagacgccgggtggagaacacacaaccagggcgggaatcaaaaacgcccggtgaagaaaagcgacgcaccatggtgggcagacaacaatgacacaagggcccgagagaaatcattacccatcctgggcccgaacacccgccacaagacacagaagcccccacacattcagcgcacaaagaataacaaccacatgtggggcgaaccagaggatacaaaaagcagcctgagaaagatcaacaccgggaaaatatgaggggcccgcaaaaataggggcggcgccccgatgggacacacaccaccaggagggcagtggctattgaaaaaccctcgagggccaaaaagagcggggcaaatcaagaagaagcacaaacaaaatgaaccc

SEQ ID NO: 632472 - DNA, 481 bp, Homo sapiens
tcgaagatcgagaaatagtgcaggaatatgagtcggcataatgggagctgtcgaagcaccattgtttatggtggatagacaatagagagattgtagagcaaatctgatgataaaagcctaagagtttggaaatggcgagttgccatcagtagaatatctgatttacataaagcaagctgttcaaacatatatagacaaagatgaagcctgatcctatgcaaccatttgaatatttttagcaactgtgatcctggcttgctagtcaaactgttctaactatttaagtactgacaatatggggattacatcccaacatgctaccatttataatcgttggacagactttccaaagaatgtgtatcttgagttgtcttacttatacggataacagcttagtatattgctgtcttacattctttattaggtaccttattcatctctgtaaaataactggcaagacagtagggggacagagcataag

SEQ ID NO: 632473 - DNA, 137 bp, Homo sapiens
actgacctcaagtgatccctgccctcggcctccaacaggactgtgattcccagtcctgttgaagattctggagaccaccctttgcggcgttttttgggggtcccgaagcctgacaagatacctacacaatattcaga

SEQ ID NO: 632474 - DNA, 218 bp, Homo sapiens
  misc_feature (43)..(44): n is a, c, g, or t
gctgactcagaggattaagcagctatccaagagagcgatagtnnatatgcagcaacggggcgggtagtaaattcaaatgacgcatgatttttccttgagttattgggtagaggttattcggctgctggtgcattcatgcggccgccaacgctgaactgcgcaacggcgaccaacatcactatcacggccagaaacaaagcgctggtccacatggcacc

SEQ ID NO: 632475 - DNA, 975 bp, Homo sapiens
  misc_feature (885)..(885): n is a, c, g, or t
ggtctctggcaatggcggctctagactccctgtcgctcttcactagcctcggcctgagtcgagcagaaggcccgcgacgacgctcaagcaagtcggctctgtagcgcgcatctgcgcgaggtcgctactcaggctcagcagaccctgggttccaccattgacaaagctaccgggaatcctgtgatatggcttggccatcccgactcagggatacccggcagtctctcctttccttgtagagcttacatagccagtaagaagatcccacacatgagccccaggctaagctgggtggtggtgccaggcgttaagcgtttacatggaggccagactatccttggagtgtcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgagcccagagcagattgaggaggctgtggaggctgctatgaatcaggcagcggcccaggctcctggttggaacgttaccagtttcaacatggggctgctgatgggagaggctcgggctgtgctgaaagtgggcggatgggctagatgatcgcgaagtggctgtggacatgcggtcctaccagtgttctgggcccacgtgggaggctgatctggagaagaagtccaacgtggcaagagctcggtagaagaacagaccgacggcggcaagatgtgtggagaaggagactgtgcaacccgttcggagggccatcgggggagcctaagtccgaggccgtgaagttaagaccaggaggtgggtctcaaccggtctttgtcccggantggggagtaccgccggcacaagggctgcttgacgcgccatactgggcagccggtttggcaaccacgagatctggcgcgccaacagtgagt

SEQ ID NO: 632476 - DNA, 377 bp, Homo sapiens
  misc_feature (114)..(114): n is a, c, g, or t
ttacttttaaccaaatcatcctaggctttggcagtcttcttctgtatgcttctttaaacaagactttaaagatacataggtatgtgtttgtctgtaatccctccatcccccacnttttttcttttttttaaattttgagactgggtctctttatgttgtccaggctagtcttgaacttatggattcaagtgatctacctgtgtcagcctgttagctcctaccaccacacttgactttgcttgtaactttgaaaggttcattcaaaattgagacttaagaattagggcttgctccttaagagacttgaatggaaaggcaatcttgtctgggagactagcatttgcagattatacttctgggtgcttctagggaaaaat

SEQ ID NO: 632477 - DNA, 408 bp, Homo sapiens
  misc_feature (22)..(22): n is a, c, g, or t
  misc_feature (120)..(121): n is a, c, g, or t
  misc_feature (127)..(127): n is a, c, g, or t
  misc_feature (218)..(218): n is a, c, g, or t
  misc_feature (339)..(341): n is a, c, g, or t
  misc_feature (408)..(408): n is a, c, g, or t
ggagagagagggagagagaagnggggggagaagagaggggagagaagcgcgcggggggcagggggggggaaggggacaggaagaaaaaaggggaagaggggccagaaaaagggagagggnncagacngggaggagggggggggggagggagaggggaggggggggagaagagaagaaaagtgagtgtggcgaagagaggggtggtgtgaaaagaaggngaagaaggaagggtggtggtgggtgggggaggggacaagtgggtgggggaggaggtggaagagtgtgtggaggtgtgtgagtgtgaagaaaggtgaagtgtgaaaagtgaaaagtggaagnnncccgtggaaaaaaagaaaagtgagtgtgtaggaagaggagggtgtgagtgtgacaaaaagagaaaan

SEQ ID NO: 632478 - DNA, 678 bp, Homo sapiens
  misc_feature (11)..(11): n is a, c, g, or t
  misc_feature (22)..(23): n is a, c, g, or t
  misc_feature (29)..(29): n is a, c, g, or t
tggaatggganaaggggaaagnntccttnttttgggtaaccccaagctgggaccggaaaggggccacattggggccccttttcccccctggggccccaaaggggggctcccccccccctaaaccccccccagagagagtggggggaaaaaacaagggggcccgcccccccccaccccccccgtttgttgttgttttttttttttttttttaaaaagagaggggggtggtttccccccccttgcccccccaccagggtgtgtttttgtgcctccctcccgggggaaaaaaaaaaaaaacctcttctctcctttgttgggccccccacaaaaaaaagggggggggtttttattttaattgggggcgccccccccccccccccgcgccgggggggagaaaagttttttttttttgggggagaggggggggggggggcttttctccctcggcggagaagagagggtgggggggaaaaaatttttttaaaagccccccccccccccgggggttttttttttaaaaaaaataaaacgcgcgccccgccggggggggggggggggtctcccccccttttatacacaccccctcggtgggggggggggggcgggggggggggtttttttttttgttggagaaaaacacaccccccccctccgcgttgggagtgagacagccccccc

SEQ ID NO: 632479 - DNA, 258 bp, Homo sapiens
  misc_feature (62)..(62): n is a, c, g, or t
  misc_feature (79)..(79): n is a, c, g, or t
  misc_feature (121)..(121): n is a, c, g, or t
gggtcaatgttaacattgtagacgccagttgaggtcatggatagatttacattacttttggnctttggaaatggatctnctgtttcatgcataagtaatttggggtaattatatgtgagtntgtcatattaaaaaatcttttgagtttggtgattctattggattgggggggtctatttgagttagtgtcagctgcttatcccaaagaattcttgaattcttggccctagtgagtgtccctcagaatacttgcatttt

SEQ ID NO: 632480 - DNA, 267 bp, Homo sapiens
agcttgaggatcttgtcatgcttcggatggggtctgggcagtggggaaggggccaggcaggggggagctcatacgagtctggctggcacaaggctgagcaggagcccggggtcacagtggccgaggcagggctaggaccaggcccaggtgtgcgggcagaactcagctgctgtggtagatgcggaggcgctgggcgatcgccttggggcaacagcgggcaagggtgcggcagatggcttggcaagcacttgtttggcaaaaggcaga

SEQ ID NO: 632481 - DNA, 917 bp, Homo sapiens
ggagagagagagtactagtctcgagtttttattttttcaatttttgggctctaaagggggtaaaggggttgctatagggataaatgggggcccatattccaacagacattataaggggaaataaatttcctaggaacgcagtggcgcattaaacacgtggggtagtgcaatcccacagaattcacagaacgctatgaaccgtaaagataataccccgaggtatagatgtactagccggttgaaacagatagcgtggaggtatacagaaaccactacgcgaagaaatattcgcaatatagtgagtattttacaaagtcactaaacagtgagtggcgacaacacatccatacatataaagttgtgtaaaacatcatagactagtaggtgatagaatgtgataccatacttatattcatcaccagaaaagatagctgtcgatatataacaaatacgaagccactatcaatatcatatataaataactaatgctactaacattaaaaaacattcaaaattttcatacaatttattaaaatacatgtgaaactaatcatattgaaatatactcaatatagtacgtaacaatcattatcaacataacaaaaatttaacacaaaaataaaataaccaacatatccaatcacatatatacataaatttaaaaaaaaataacacaaattctttctactaataacaaaactacaaaaaacacacaacaacaaccataactaatctagttattgtttacaccaatcactacatttaacattataaacataatcatctattctctaaactcactatacattttcttttatcaacaatcaataataaacacaaaaaacaataagtaaataaaaaaaacacaaaaaatacaatatctaatatgaaaataaattaccaagaaaactaaccat

SEQ ID NO: 632482 - DNA, 195 bp, Homo sapiens
ctgctcgttatgagagttcgctgcgacaggtctctgcagctgtccagttctgaccctactggctattgtaggccagcccccatgtactcaggagggagctgcctcctgcgtaacagctgctgatagacaagagtagtctcctgcttggtgcttgttcgcaggtctgagcaagaggtgttccccggacatgttgcg

SEQ ID NO: 632483 - DNA, 92 bp, Homo sapiens
gcatcaaccttatttccatgttgcgtaagagcctgtgcgagaacagcttaggaccattcagtggttgctcctaccccttctgtcgtcttctc

SEQ ID NO: 632484 - DNA, 384 bp, Homo sapiens
ggtagcagcggtccttcatggctgcagtgcgcacatccagctgtccgtacatgctcacggtcttcatatctgggtcgcagctcagcatagcgagcagaataggagggagcggtatatacgagccatcagggagctttagttagccgatagccaccagttccacatagctcatcagcagcttatcatctgcagcagcaacttccatcatcctccagatttagcctatcttctccaggccacgcagtcacatctatgtacttaaacagcgtagttagggccgccatctttcaaccagaccccagaccgcagatctcgagagtgttctgggaaggaaggcccactaggcaaggccatgtcaccagcagcaagcgcggcgccggttcc

SEQ ID NO: 632485 - DNA, 541 bp, Homo sapiens
gtggcggagattgtccacgcgcaggcgttcaagctcaaaagcctaacccatagactcccacataactgctgaaccccgcacacgcgaacagtccagtgtgtccccaagatgtggccgcagacctagacagctgcagtcctctactgctatctgaaggttcctgacagctctgcatagtacaatttatcaaaggaaatgagtaaagtgccagattctagacccattttggctctgaactgaaggggaggtgggaagcacagtatctcattatgttgcctatactaggaacagatccacacaacacacaggcaacagggatggggggaaacgctgcgtcagccccgcagtcagcccagtgcagcaccagcaccaccccctccacccccaaagcgccttggcccagcagaaaagaaacccgcaggccattcactgcacccagccagagaggccagcctccaccacgcacggcgaaaggagtgaactagctgggacacacacacgtgtgaatgcatgcaagcattcactgcatcttctccgtgaa

SEQ ID NO: 632486 - DNA, 350 bp, Homo sapiens
taaaagtacaaagattagctgggactacaggcacataacaccacacctggctagtttttaaaatattttttgtagagatggggtttcccatgttacccaggctggtttcgaactcttgggctcaagtgatctgcctgcccaggcctcccaaagtcctgggactacaggtgtgagccacgatgcccagctatgtatctctaaaataaagacttttttcttttaaatataatcagaatttcatgatcacactccaaaaatatttaaccgtaattgtttcataccatcaaacatttcagtcaggggcacaaaccagtatctttacatctggttttgaggctctggaggaagcg

SEQ ID NO: 632487 - DNA, 135 bp, Homo sapiens
aggatccccagactattccaagtgatgtatcaggtatgatcagctgatgagaggctccagaaggattctagatcgcttcaagcgtatactgatggccttagctttgtacagtcattgtaactgggatagttgtca

SEQ ID NO: 632488 - DNA, 374 bp, Homo sapiens
tttggtgcctgggatgagcaaagtagtgcggcaggcgaggggaagccggccaggaggtagaggccagccacgcacagcccaggggcacagaccctggtgcagtcccaacgccgagggccacagcgcttccctggcaggctgtcaccccccttccagggaccctggaccgagagaaggggagtcagacagctgaggggagagacgaataaatctcgaggagcggcctctgagtcagggtttccagggtgattaaatgacccgaggcccctggatctgcgtgattgcctgacctgctctccttgtaaatgtggagctgtgttgggttaggatcaaatgtttcaagtttccaacccagctgaagccctgaatattta

SEQ ID NO: 632489 - DNA, 140 bp, Homo sapiens
gaaatctaaaacttgtttccgagactgggaggtaaagtaggctttcttttgctgtattgttttataaggctactttacctcccagtcttggaaacacgttttagttttttattggtttggagactgccttacaaaatacc

SEQ ID NO: 632490 - DNA, 205 bp, Homo sapiens
agtatcagatgttatcagcctcaggagcttacataactagaggcagaaatcagatgtacatgtagactcaggcagcatgtgacacacacaaatgtgggcagctctgagcacaatggtggtcaagtgaccactgaggcccagagccgtaggaacagtctcttagaacagggtggaggacttaaaactgggatggtattgctcagcg

SEQ ID NO: 632491 - DNA, 104 bp, Homo sapiens
tattggcaagcttgcaagttactgctggtggggctgtagccgtctctgctgccccaggctctgcagcccctgctgctggttcttgccccagcttcagagtcctc

SEQ ID NO: 632492 - DNA, 342 bp, Homo sapiens
tcgatgagggcgaactgcaaggagcattgacccgtgttgtggctagaccagagccagaggacagcggcgtcggtgactcgcgcaacacagtgcatggaggcagcagccatctgctcgaagtggctagcgcagtctcggcagccgaagaagtagtgcacgtagcctcggatggctgggaggacctccttggacttggctgcttcctgtgagtggtctacatattgccgagctggctgcacagtcaagaagtggaagaggacccacaggaagcagggaaagccccggaaatgcggctcactcccctggcagccaatccagttcgcccccagcgaggggtaccga

SEQ ID NO: 632493 - DNA, 99 bp, Homo sapiens
tataaatgggggtttttttttttttttttttttcccccaaaaaaatttttggggggtctctgggggctcaaaaaaaaaaaatagccaaaatttgggggg

SEQ ID NO: 632494 - DNA, 114 bp, Homo sapiens
cttggatgtccttttttctaacataagcatttaccagaaatgatccaagttaagttttgcttatgctcggatgtagtatgaccccacgaagtgttgcttgtgtttgtagtttaa

SEQ ID NO: 632495 - DNA, 146 bp, Homo sapiens
caggaagtattatacgcacgtactctccaccagcaatgcatatgtaactcacttgcacaatgtgcacatgtaccctataacttagagtatacataaaaaacaaaacaagacaaaagattggtgtgtatccaatttatttacaacac

SEQ ID NO: 632496 - DNA, 110 bp, Homo sapiens
acggagccgaaactgccgcagcaagaaaagccaagaaccagccggaccaggaaggggaggtttgttccacggccaaattacatgcactaagaggaacagaccaagtaatg

SEQ ID NO: 632497 - DNA, 298 bp, Homo sapiens
gccagagagagatatagagttgattagggagttggctcatgtattgtggaggctgagaaacccaccacagggcattcataacctggagacttggatgctggtggtctggctcagtacaagtccaaaagccttgaaccaggtaaactgatggtgtaatactcagtccaaggctgccttttcaagtctgagaaccttgggaactccaggaactaaaactataactctcacattccacccccaggtcagaggatctggggtcctaatgctcatgggcagttggagaaagagtgtattcctg

SEQ ID NO: 632498 - DNA, 255 bp, Homo sapiens
cttagtctctgctgatatctcctgtcacatgcctgcccgcagtccgctccaacccagcagctctgtttgccctgcgtggagggcttctaccgggccagttccgacccaccagaggcccctgcctgttcctccatcggctccccaggagctttggtttgaggtgcaaggctcagcactcatgctacactggcgcctgcctcgggagctggggggtcgaggggacctgctcttcaatgtcgtctgcaaggaaccacg

SEQ ID NO: 632499 - DNA, 152 bp, Homo sapiens
  misc_feature (39)..(39): n is a, c, g, or t
ggcaacaggcccaaaaaaagaggggaggggaaaaaaaanttttttataaatttttcttggagaaaaaaaaaaatttgttgttgtaaaaaaaacccccccccccccgggggggagaaaaaaaattgtggggggggggaaaaccccacccccca

SEQ ID NO: 632500 - DNA, 118 bp, Homo sapiens
  misc_feature (59)..(59): n is a, c, g, or t
tgtcgatcgagctcggtaccttcactggacactgagtgtaaaacttctcctgtggcaanaaacccggggaaagccaatttccatgatgatgaaattttttgagtaaaccataaatcca

SEQ ID NO: 632501 - DNA, 278 bp, Homo sapiens
agtattgagaaaatccctattgcgagccttacacgtagacctcgctagtaactcttcaggcaatcaagacggaccatgtgttatggccccagatgcacgcatcctgccctcccctcaaccttagttcatcctaacagaccaacctgactcctgcattcatatggaatgaggaaaacagaaaaacaattcaatagtatgtaccaaaagacaataacagtagcaaaccataagaaactactcttagtacatagtaaccaaaaaaaactagaaacgagatc

SEQ ID NO: 632502 - DNA, 1004 bp, Homo sapiens
tcacactaaacacaaaggggctcatgtctttcctaaagggggaccgatcatttgacgcaccgctgcgaaaactccctctgtggggtgacatcaacgcgctgcgctcacctgatggtgttccaatctgatgcccgcagcaattgtgcttgttctgctatccaccaccagacaaagaagtgttggggggtctcacccccccatcctcccactgcgaccttgttgggtgcgacatatcttgctcgcccgtcttctgctttgaaacaaaatttctgcttactctccatgacgatgggtttgttgtcgctcacagttggttgatctccctgcgagcacctcgtatgtgcattcatcatatgtgggttgctgcatcattattctcccctcatctggctgccttctatttggatgtcttgcccctgtcattgtcgtcaacctagtgagtagttgtgcccacccctccctctgcattagcccttcttcttctccaatgtctcgccgtgggtggtcttcctctccctcgccgccacaccaccacaacatactggtgtgtcacccccccctcgattgttttgtcgccgttctccctctgtgtcgccaccccaccgcgctgtcttttgttatggtgggaccaaaacaacaactatacaacagtggggtgcgccgctggggcacacccctcgtgtgtctcttcgaatgatggagtagtttttatgtgctcctcgtttgttgtccacaccactccgttgtgtctgctccgataataccacacgcgcttcgtagttttgtcgacgcaaaacacgcagtgggttgtccctttcctctcctaccccccgtgggtccccccttttgtgcgggggggggtggtgtgcccccccctctaacagatccccccacccgccccctttgggttccccgcccccgcctcccctttttttttgggaaattggggccctttttttaacaagttttttcccccaccaaccccccaaactttgtggggggga

SEQ ID NO: 632503 - DNA, 494 bp, Homo sapiens
  misc_feature (22)..(22): n is a, c, g, or t
  misc_feature (34)..(34): n is a, c, g, or t
  misc_feature (58)..(58): n is a, c, g, or t
  misc_feature (167)..(167): n is a, c, g, or t
  misc_feature (200)..(200): n is a, c, g, or t
ttcgcggatctcaaagatcttngagcatcacttngaataaaccctgcctgggcttttnggtcctggctgccctgtttctgctatactgcattctcaccggccccagtttatgggatcagaggtggatatctgaccaaggagaaacaagctatttcagccaatcagantctctgactcaatattttagtacctgaactgcnttaatgatgcagcactggactctttgtactgacagtccagaactgtattgattcttgtctttcctgagatcattccatttccttttccttgtagaccatggggtgatatttttataatgctccttttaaagtaatttattatttaaagacacatatacagatggtaaaatctataaagaataacgagaataattatctcaaagagcagcataatggttgcctctgaaggagagggagggagatattttcagacaggggcaaatatggactttttttttttttttttggggccaa

SEQ ID NO: 632504 - DNA, 151 bp, Homo sapiens
  misc_feature (143)..(144): n is a, c, g, or t
atgacggttctccattacgtcgatgacttgtgaattaacagattccagaaggaagactcgaagccgtctcagttaacagttctacacatttcccactagtttttggccttggtttttcatggcattttcagaagtgcacaacnnttccctc

SEQ ID NO: 632505 - DNA, 815 bp, Homo sapiens
  misc_feature (423)..(423): n is a, c, g, or t
tggcccgatcctttgattttaagacggtattgttggccaccccagattacagtgaccccgctctcaactgtcttggtgtggttggacacgggcacacaggtacgtcacacggatctcctccccacggaggcgacgatattgaaacttctgtcgtgagtaaggatgtaaacccaccctcacagtgggtgtgcgagagattccccctagcgctgagaactagcgaggctctctcttttcagaggaatagcagtgttccccccacactctcctcacaaacgctctatttccacacacgacactgtctttcgacaataattaagaataaaatgttgttgtctataggactcagtgcgcgtcgacagtttgggtgacactctgagtgccgtgtatgattctccacccacctactgttagtgggagacncagtcacttcagggcccagcggggttgacttcccctctctagtggaccctccgccgagagttttcaccaggccctcgctcctctgggtggctacaacgactgtgcgcgacaaacactccctcactgttggtcttcttgtagagcataattgcatcacatctatagttctggagttttagaggacaacaccccaccgtctatatcccctcctatgcttcgggagagctcagtaggacaacaagatttaggtaataacctcgggtagtccccagagggatccgccgtggtgtaggaatacacaacaccctgtatactcccgccccagcggcgaaccaccaatttgtagtgctctccttattacaaaccaactatataaaaaataccataacaca

SEQ ID NO: 632506 - DNA, 237 bp, Homo sapiens
tgagataatagtagagtacacatgcaaatgtaaaaagaaaccccatgtacagagatccagtgtgcacatatagacattctacccactggtcacatgttgcaacaacaccaagaagactagagttctatatagatagtcgatacgaagtccctccacagggtaccttaggggcccttcacaactgtgtatcccttcagagtgatgttcacattttctggaatgtcaacagtctgatag

SEQ ID NO: 632507 - DNA, 455 bp, Homo sapiens
  misc_feature (106)..(106): n is a, c, g, or t
caggcttcagtgtttgtaggaggaaacacagcaatcacactattaatagtaaattaaaataaatgggcaactgctgcatggtaatacttttttttttaaggcaaanaataaaaaatagtgaaacagagaaacaaaacatgaaacaccggcagtcaacaggcaggcaaagaacctgggggtgggggtagcagcggtcccaccctcaaaaggcccgggctgcccagaccaagagaaagcgatgaatctcttctggtaacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcaag

SEQ ID NO: 632508 - DNA, 940 bp, Homo sapiens
  misc_feature (351)..(351): n is a, c, g, or t
  misc_feature (456)..(456): n is a, c, g, or t
cacttatcagtctgaatctaaatatggtttatcactttaaacaagagtattgtatctcgtagtaggctccagggatcattctacatatatgtacaaccactagattgcagctgggtcataatactatggttgaccaagagccagtgtggtgctgttggaaaatgtcctagtggtcgaagcacatacaccacagcataacagaggcgtcgccatggagaaagtccaccccagtggagtagcaatggtgtgagagaactggttcacatcatgttacagtctacgagggacatgaacgagctaagatctgcttcagtaagtgttcgagtgctagacaatgactgtacgaatagngactgagctgatgatagcaatatcgtaggtgtaggtggcaggtgggattcaggaggaaggcttgctaggctacgaaccatgagaagcagcagcactatctattgncattaaccaaaggaatgcatgcttgtacttttgaagaatccaattctatgttcagaaggagagccaacagggagccattgcatgtgagcagggtcatggtaggaacaaaacaagtgttataaggtatagatcaagaaataggttctataagatggcactttcgaatacttactgagtcctgttcgccagtggcactttttgtggtgaagtagcgtaactatctcaagtgaaaagattagattgttcctaaggcgagagagattggaatctctattgtgtcctgtaatcgagggctactagtgaacggtctgggagaggattgatggtacatccaaatcttaataacctactacttctctcttcagctaaaaaatggacagaacaggaattaaatgcgggactttcgaatgaaatacgggacttattaattcagggaatccaatttggctgtatatacaggtaggaggcattccccgaagtccaa

SEQ ID NO: 632509 - DNA, 631 bp, Homo sapiens
cttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggctggttgtggtgactcatgcccataatcccaacactttgcgaggctgaggcaggacgagtgcttgaggccagttcaagctgggagccaggcttggtgtctcacacctgcaatcccagcactttggatgttttagaagaatcctcccctgcaacaccaaatggaaccaagggcaaagatgagtcccagcacacagaatctatggtacttcagtcctcacgggggatcaaagtggaaggctgcgtccgaatgtacgaactggtacacagaatgacaaggaacagagggcctgaggctatggcaggaggagcaggagaggaaggtgcaagccctctcggacgatggcatctgacacaactgaacgcggttgatgaatggacggaacctgaaagcagcataaaagaattcccaggacttgcgggaagtacatggacgaacagctccagagaagcctgggacac

SEQ ID NO: 632510 - DNA, 530 bp, Homo sapiens
  misc_feature (106)..(106): n is a, c, g, or t
caggcttcagtgtttgtaggaggaaacacagcaatcacactattaatagtaaattaaaataaatgggcaactgctgcatggtaatacttttttttttaaggcaaanaataaaaaatagtgaaacagagaaacaaaacatgaaacaccggcagtcaacaggcaggcaaagaacctgggggtgggggtagcagcggtcccaccctcaaaaggcccgggctgcccagaccaagagaaagcgatgaatctcttctggtaacgtcccttcctgtcgcatggattcaaggccgacctgccccagcaccaccaccagcagccttctgctggggccggcacagctgggagcaacctcctactctcaggcggccgctcccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcaag

SEQ ID NO: 632511 - DNA, 885 bp, Homo sapiens
cggccacactcgactgcccccaaacaaattgaaaaatagaaattttcagcaactcgagagaggaggtcttgtaaagctgaaacctcatgaggaacctcttcgttctgagattttcagtggaaaattcaccatcttagtccacctaatcatcctgtgaaagtggattctctatggaaagctctgtttgctcactacaaatacatgcttattccttaagggatgcgacacagtccctgtgcacctcaccataacaacccccccaacacaaccttgtcagggccctcaatacccctcttacagaatgcaaacctattcatctcccacaatccccattatcctcatttaaacaccctaatccacccccccaccccccacaacacctacaaaacagcaccacgaccccacccccacacactcaataacacccccacctctcttctctccacccaccccatcaaagtaaaaccctacattcattcatatcacaaccaccttcccacaccaccccccccccttaaacactgataaaacgttatatcccacccccaccccaccctaaccacaacacaccaccacacccacgctcaccacattaacccctacgactccgcgacttagtacacataacactataataaatctcatctcagcgaccaaatgaaatactatcccgctctacacgcccctgatccatcgcgtgcatctgtatcgtgccccacgcactcctcctgtcgatctttcatagtaagccaatcataaatcgtcttcactgccctccactccttctcaacattacaacaacagaacactcttagccccaccacgactattattcgatatacccaagatcaccatcgcaagttgtatagtttagtaatggtgagt

SEQ ID NO: 632512 - DNA, 411 bp, Homo sapiens
ttggaaaaacatgtatttttaccgtgcacgtaaattggtcagcagaaaagtgatcccagttatggctgcagatggatcatgtacttgctgggttttccttttctttgggactttgaggggaaatggtttttagaggtgagggttggtccatgtgtaggaaagaatgtgtctctgttggtggacagaggaatcttgggattccatcgtatttctttcaatctgctcttagacactgcttgtcaggtgagtctgcccttagactgcatgtccagaacccctgcctccatttttccaagctccgtggtgaataaccactaagtgaaagtaagaaatatctatatatatataatataaaatcacttggtgatttaaaaaataacttctttataaattaaactccttaagtcaaaa

SEQ ID NO: 632513 - DNA, 862 bp, Homo sapiens
gcggagaagatgcaggacctgggggtgatctccagcatctcgctgtcctggttcctgaccctcttcctcagcgtcatgcccttcgagagcgccgctggtcatcgtcgatgtgcttcttctatgagggcatgaaggtgatcctgcaggtggccctggacgtcctggacgccaacatggagcagcctgctgggctgtagagagaagggcgaggcatgagcatgctgggacatgatacctggatcattgtggtcaacaagccgagagtgtctctcctcctatacccgaacctccgtgccttgttgagcaggagcgatgaccgccacctggcagaggtggacatctctgagctcctgtagaagtgtcctcatgcagtaagattcagcgagcctgagggccgtaagacattgtagcatgatgcggttccaacagaggctgaaagtgatccagtccttggaggacacggccaagaggagtgtggtccgagctatacctgtggacataggtttctccattgaagcgctgagaggacctttacatggtgtttaaggcaagcacctggactagaccagctactgggggtgcagcctgcacaattggacggaccgtctgggaacacagacatgacctacctggagcaagtaacgagattgatgccagcaagttccgggaactctttgccagcctgaacccatggacctgtgggctcaccatagcactactgctgggcaagggagccatgtacacggctacctggacgaaaacaaggactcggtgatacaacttcaaggaagtcgtgacaggattgacgggatgtaccaagggacctgaagagaaggacaaggtgatcaaaagtagacataca

SEQ ID NO: 632514 - DNA, 1179 bp, Homo sapiens
ctctctccccggacagcatgagcttcaccactcgctccacgcttctccaccaactaccggtccctgtggctctgtccaggcgcccagctacggtgcccggccgttcagccagcgcaggccagcgtctatgcagtgcgctcgggggctctggttccccggcatctccgtgtcccgctccaccagcttcaggggcggcctggggtccggggtgcctggccaccgggaatagccgctggtctggcaggaatgggaggcatccagaacgagcaaggagaccatgcaaagtcctgaacgatcctgcctggccatcttaccttggacagagtgaggagcctggagtaccgagaaccggagtgctgtgagacgcacaaatcccgtggagcacttggacgaagaagggaccccaggtcaggacgcacgtgggagcctattacttcaacatcatcgacggacctgtgggctcagatcttcgtccaatactgtggatcggatgcccgcgatcgtttctgcgtgcattgacaatgcccgtcttgctgctgatgcactttgagtcccagtatgacgactgattctggctcatgcgtcccatgtctgtggcggaccgactatccactgggctccgctgggctctttgctgtacaccagatatcacactgactgcagctgtcagacctgagatcgaggctcatcaaaggaatgagctgatcgttccctgatggaagaaacgactgaagtagtgaagttgaaaggccctacatagcccgagaattgccagctactgaggttgaccgtggaggtagatgcccccaaatctcaggtactcgccgatgctccttggccggacagtccgggcccagtattacctaggctggctcggtgagaactcgtcgcggaggtatccaaagtgcgtgtctcggcagcactggggggggaaaccccccaaatgtgcgttcgccacaacagtactgactcgaggtttgcaacacggcctgtaacagaaggctccagagagaagtgtgaccagtgtaaggtccatccctgttaaagattatgcccgtgcgaccttcgagagacaaacactgataggtgacgctggtggacaaagcttcgtgatagagatacagacgaaatcacagccacgagaggagcactacgagtctagtgcaaaaagaagaagag

SEQ ID NO: 632515 - DNA, 266 bp, Homo sapiens
  misc_feature (43)..(43): n is a, c, g, or t
tgatgtcaggataatcacctgatgcagtgaagcagcgcttccnattggtggtcaccttttgctccagtcaaggttacaacggacgtagaatctgtctgaaatgcaccatgaatgctttgatgtgaagctctatccgtggggacgaatgttgggctccaacagtcaatgaatgtgtctgtcaagagatgttctgtcgtgacaacgtatgctaggtgacagcgcaaaagtgacccaccaagtggaagcagctggcgttcactgctcag

SEQ ID NO: 632516 - DNA, 674 bp, Homo sapiens
agaaagaagtagtgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatgccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaatttcagacctagatggattggctttgggataacaaatccctacctatagccatgtggaagcagctgtgtcactgttttttaccggtgtaccattttttggagggcgaaattagacagtggggccctctttgaacacctaccttttatcactgaatattttagacggtcctccagtatctgcagtcagagttcatggtacttgtgtcttttacccccaggtggcattcttagtctaccttcagtgagacttgcgttgcacgggagggggcgtatgtgcatcctcggcctccgttgtaaccggctgtccgtcatgctggtgcctgccc

SEQ ID NO: 632517 - DNA, 176 bp, Homo sapiens
ccaggttagagtctacgagagtaggtataggtgcggtgggtgaaagagtatgatagggtggtgattgtgataacttgaatgagtgtagaagctgaataatttatgaaggagaggggtcagggttgattcgggaggatcctattggtgcgggggctttgtatgttaggtctacctgg

SEQ ID NO: 632518 - DNA, 187 bp, Homo sapiens
gccgcccatgcacttcggtaacgaaaactggacaattgtatgaggcatgctcgttaccttgcagctagggtgccattatgctgcaaagagcaccagcaggcccttgatgttcttgacatggagagcccatcaataaagattatttgaaaatacttgagggacgaaagtggcttcaaagatccttccg

SEQ ID NO: 632519 - DNA, 316 bp, Homo sapiens
cacagactaaacaacatagcaagacctcatctctaaaaaaataaataaataaaaaacaaaaacttgtgtgccttcgcattctatttaccaatataaccaaatgatctcggccttcacaccatcttcttggacacctctgcaccatgagagcctagtggaggacgcgactgcgcaggctgaagcgcaaaagacgcaagatgaggcagaggtcccagtaaaccacacgctaatgcacccatggaggctccaggagcagaaacatggaatccagaggctggggatagctggtacagttattgggctgcatgctactgtc

SEQ ID NO: 632520 - DNA, 487 bp, Homo sapiens
  misc_feature (54)..(54): n is a, c, g, or t
  misc_feature (78)..(78): n is a, c, g, or t
  misc_feature (92)..(92): n is a, c, g, or t
  misc_feature (94)..(97): n is a, c, g, or t
  misc_feature (99)..(99): n is a, c, g, or t
  misc_feature (111)..(112): n is a, c, g, or t
  misc_feature (114)..(114): n is a, c, g, or t
  misc_feature (135)..(135): n is a, c, g, or t
  misc_feature (142)..(142): n is a, c, g, or t
  misc_feature (177)..(178): n is a, c, g, or t
  misc_feature (180)..(183): n is a, c, g, or t
  misc_feature (185)..(185): n is a, c, g, or t
  misc_feature (189)..(189): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (216)..(217): n is a, c, g, or t
  misc_feature (220)..(220): n is a, c, g, or t
  misc_feature (225)..(225): n is a, c, g, or t
  misc_feature (229)..(229): n is a, c, g, or t
  misc_feature (232)..(232): n is a, c, g, or t
  misc_feature (240)..(240): n is a, c, g, or t
  misc_feature (243)..(243): n is a, c, g, or t
  misc_feature (264)..(264): n is a, c, g, or t
  misc_feature (266)..(266): n is a, c, g, or t
  misc_feature (275)..(276): n is a, c, g, or t
  misc_feature (286)..(286): n is a, c, g, or t
  misc_feature (319)..(320): n is a, c, g, or t
  misc_feature (322)..(322): n is a, c, g, or t
  misc_feature (351)..(351): n is a, c, g, or t
  misc_feature (357)..(357): n is a, c, g, or t
  misc_feature (366)..(367): n is a, c, g, or t
  misc_feature (371)..(371): n is a, c, g, or t
  misc_feature (386)..(386): n is a, c, g, or t
  misc_feature (415)..(415): n is a, c, g, or t
  misc_feature (457)..(457): n is a, c, g, or t
gcgcgggggaaaacagaaaatatattattgattcaagaatattttgcacttgantgataaactgcgatagctttttcngggcccctactggngnnnngngggggggggtgnntnggggggggctccgcctccggngggggtngggggggtcggtcggggtccctggggccggcgggnntnnnngngttnggcgttggtgccctcggcnggngcngnntgnggggngggnggngtgcgtgngtngggggggggtccggggctgtngngcccctgcnnggggggtctncccggggggggggggggtcttcggtggcgtttnngnctgcgtgcgggttcggggtcggggtgggngggggngcggtgggnntggnaacttcatcgatatnattgttttcagactgattttccattttanccagagcagaactgagttcttcatccttctttttcaaaagtnctatgtttttatcaacctcggctacttctt

SEQ ID NO: 632521 - DNA, 233 bp, Homo sapiens
ccatcgcttagagccttaccctccagtgctgaggagtatgacagtactttgatatttatatactctaaagcattcttcaaacttttctacttgtattgtcgttgggatttaggtcagcccaggagagaaagataactgctaaaattcccctataccccatcctttcttgtccttaccccttcagatggagacttcattatgttactgaacaagatatgaagaaaatggcactc

SEQ ID NO: 632522 - DNA, 178 bp, Homo sapiens
caggctggaccaaagccgacatacacccatcccttttttcttgttgttttgtgaaaacaaacggaaactgtttcttttttgtataaatgagagattgcaaatgtagtgtatcacgtgagtcatttgcaggttttctgccacagacctgtgggctgccttatattgtgtgtatggtcgg

SEQ ID NO: 632523 - DNA, 917 bp, Homo sapiens
  misc_feature (1)..(1): n is a, c, g, or t
  misc_feature (3)..(4): n is a, c, g, or t
nanntgtatgtgaggaatagttgttagttatatagtagtccgcagtgaatacaaattggctgtgtgttacggaaacgtacgcaacatgtgaaccaggactgttaacaactgggttctggcagattcttgtccgtgccgtgtgtacccaccgtgcttagttctgtcacgacacctctatcggtattccccctccgccccggtacccagttcggcccagggcctgggccgcttggatcgggctaacaagcccatggacaggtggcaagcaatcatgtgggaaaacgctctcgtgtgtcgaaagccccgatatgccaacctgtatgggccccctccagggaatgccactgggtaaggaccccccgttaatatgcttttgctagacccgtatgccaagagatgaataaagcacggggccactcggttctaatttcaaaccacctttttagacctctccaccttcatttactttgcacagggaaccttttcccaataaatttgaaaaaaaggcgacacaccctgtgatattaggtgactaccccgctgtaagtatctgtgcaccgatttataaaacaccaccggtgggccaaacttgcacatatagcagtaaaatgtgtcatcaccgtgttagtactgaacttctcactgtgagatcggttagattcacccgctggacaaccaccctgcattattttatgaagtcgcacccctgagtgtctttaaatagttgcccaaagccctttgttttacaggctatgtaaaatgcttctcttcgcgtattgagaataacgaattgctttggctcaacaagcccacttagacttaaatcacgagagcccgttattaacaattaccacatttttaaattttgaaaaaaaaattttaaatccccaaaaaaacaaaaaaaacaaagataaaaa

SEQ ID NO: 632524 - DNA, 1584 bp, Homo sapiens
gtgcacgggtcggggtcgtcttcctgttcctcgctattattctttcgtgcggtaggtggacgactgtcgttttcctcgcgtgtggtgtggttttgcctcccccacctttttgttgtttcgacttcgccccatcacgatggttgttgtttgttgtgttgatcggttctaccttcactcgtctgcgtcgccatccgcggcgcgtggttgttttttgtttatgccgactgatagttttattctctgttgtggtctgcgaccgcgttctctctcttctttttttgtctgttgtccttcccgcctgccgcctccgtcttcctgccaatagttgcgcctgatgggttgttgttctgctgcgccgtccgcctgcgtcttgattattgcgcgtcccgttgtttttggttttggtggctcgcgtgtgggttcctctacccctccctcttcgttgttgttgttatggcgcccctctcctttatacttccccttcatgagtgtctgttggcggcgtccgtctccgtggttacttctgcttccagcatgagtggatctgtgtgagagggatgtgtgtgtgtgtgcgatcccttctcgtgcggcgccgcgtttatagtgttctttctttttcttcttctgttttttgttgttgtgtgttcgtgttttgttttgtgtgttttttttttcttcttctctcgtctttgttgtggcgcggctgttgtgatgcctcctctcgacgcgacatgttgttgtagttaaaataaccactgtcgtgtgtactgccgccgcggcggcaaatgagggtgtgttgctactcgccactcactgcttcttcgtccgccgtgttgttgtgaggttgcgcgagactcttactcttctcttccccttctcctacactattgttttcctctgcacttactaagtggtggtggggccgccgacgacgatgagattctcgtagtcgttgcgagtagtcgcactcgactcgtggtgtgcgcgtgttgtgtggtgtgagagtagtatagtgtctcttctgtcgctctactatatatagtagaggagatagtagcgcctcgttgtggtgtggacacaccacgagagactatagtctccctcgtttgtcgcttcttcgtctctcatagaatgaacgccgcaccgctcacactctctgtcctctgctgctcacacagagaagagtagagtagtgggcgcccaacactctctctctctctcgcacacacagtctctcacacacacacagcgcgagagagaggtgagaagagcactctggtgttcgtgtgttctctctgtgagaaagtagagaggtagagagagcgccgacatatatctttttctgtatatgtgtgtccccgagaaaacctttttatattgtgtggtttatatgtttgagaatagagagagagcccttttgggcgcccccccttctccccctttttgctctcccccacaccttgagagaaattatgaaagcttttggttttccctcggggatgggtggagcctccccaccggctttcccgtacacccgaacttgggacccccttgtaaatatataaaggcccccccctttataaa

SEQ ID NO: 632525 - DNA, 791 bp, Homo sapiens
gtctctgaccccaaggagtggcagaagatcccttcactcagagaagcaaggctgatattagcttgtgaagtgtaagagacacaaatgaagaagaacaaagagcctgagaaagcagcaagaggtacaatgagtgaaaaatacgtggagttgatgagaaaggggagccaaggtctttatacgtctagagaaaatattcagtagctgagatccggccagtgatagcctgtgggcaccagcagcaagggctgcatgggatacagcacccatctacaaagactctattacataaacagctgcttcttacaggaaacaaactcttctgggatctcctttgtgaaaaccagttgatgtgctaaagagtaaaaagtctattgtccagtgtggtcttgtgcgagaagcaggcagattggccaagtgtggtttttgcccctccacgtcagaaagccctgcctttcccttcagaaaacgatggcaggcattcctctgagtttacagagcagagactcactccagccaaagtgagctgggagttcagaaccatggtggaataaagaaatgtgcatcgtggtctcttctgtggttgaatttcatatcagattaaatttctttagcatgttgggtaagtctagatattagagatgaggtgtgcctaatccctggcaggtctggtgaatagactatgatgggttccatgggaaaatgactcttttactattaaaagacaaagaaaggttgatgcggattttggtgaaggatgtgatggacaaggtccaggggaggcgctggaagga

SEQ ID NO: 632526 - DNA, 557 bp, Homo sapiens
cgtcatagctgttccttgagtaacaccgttacctgccaggtatatacgcgattactgagatggctgtgtcagatggtatttcttggtgtctaatcctcaatgaaatcacccaatgtctttcacagtggttgaacgtaactttacactcccaccaacagtggttcaagcattcctatatctccacgtcctctccagcatctgttgtttcctgactttttaatgatcgccattctaactggcatgagagggtatctcattgtggttttgatttgcatttctctaatgaccagtgatgatgagctttttttcatatatttgttggccgcataaatgtcttcttttgagaagtgtctgttcatatcctttgcccactttttgatggggttgtttgcttttttcttgtaaatttgtttaagttcattatagattctggatattagccctttgtcagatggatagattgcaaaaattttctcccattctgtaggttacctgttcactctgatgataggttcttttgcagtgcagaagctctttagcttaattagattccattt

SEQ ID NO: 632527 - DNA, 232 bp, Homo sapiens
tcacatgtatctacataactatcttgtcagataacacacaatataaagagccttatgaaaaacagagattacatatacttctaaagtcttatggggaatatcctgtgggcatgggataaccaatcataggtgcagctgcagtagcaggatatgcatatgcctgtgggttcataccatggtgcatattgggaacattacttccgtatggctcagcgctatcataaccattctg

SEQ ID NO: 632528 - DNA, 738 bp, Homo sapiens
gacagaactcgccccgccaccctgccgccccgtctcgcccgggcactggcccccctcgtcgccgcccctcccgcaccctccgcggcactatgcccgccctcgacacgcccgtggcagcgcaccgctgcgcacgggccgatggtcattggctggctgccgtggccgccgcgctggcgtgggcggggtccggctcggcggggttgctgtgggcggctgcgtgcgggctggctgcttgggggctgcgcgtggtggggccgggcgggtggtccgctgggcgctctcggtgtgccttggtggggggccgtggggctgtcggggccggggcgttgtgcggtgcacggcacgggtggcggccgggtggcccgggctggctggctctgccggggtcgtggtctgttgccccggtgggcggcctggtggggtgcggtggctcggtgccggtgcggtgctcgcgcctgcggtgtgtctgtgcggcggtgtgcgtctggtcatgtgtgaatgccagggcggtgctgcttggctacgcacatacccgtgggctgcgcggcggtatgcacatggttggctcgcgcatcgtggatgctcgttgctccctatgtcgtagccaccgtgtcgaatctcgtgaacgttgcagaccgtgcggcgacatcgcacgttcgtgcttgtgtcaaccgcttgccttggcaacccgtccgtcatgggcgcgtgaagcaggagtccgcactgctgactgcgcga

SEQ ID NO: 632529 - DNA, 196 bp, Homo sapiens
  misc_feature (111)..(111): n is a, c, g, or t
gactacaaatgctcggagtacactggaacgtagagaacaagctagcagggctatgaggaaactacttcttcatcttccgagaggtgacgggtttactacatgagttgaaancaggttcgccttagtaagcgccgggccaggctggggttcagtcaggcaccaacgccctgcttgtggtcaaacatcgggacatgaa

SEQ ID NO: 632530 - DNA, 122 bp, Homo sapiens
agcgtatcccctatatgtcgccagccgctattgcgaatcggaccggttggagggctttgtgcgtcggcggttcggtggactatcgggcggcgcgatggccgccgcgctggccgactgggtcg

SEQ ID NO: 632531 - DNA, 189 bp, Homo sapiens
gaacaaccgccccccacagctgaggattgtggggaggtgtgtgctgggtgtgtgtgtgtgtgtgtgctgcatgcactctacaggcagggcagtcctggcatggggctgttctgggctagaggggccggtgtgtgctctgggtgccccatggccagggctctcctctagacacaggctcagtctgctgga

SEQ ID NO: 632532 - DNA, 1350 bp, Homo sapiens
ggccctgtggggtcaggcccaagcgggcagagcattccatgatctacttcttccaccactacgagctgcctgccatcctgacagcaggtccgcatccaggagatgctagcttcaggcgccgccactgggccccgggaaccccaggagacgcccgatgacatgaacaacaactcgggacggcccggactacagaacactgactctgacggaacagcaccacacaggccatgggaaccacgaaatcgaccatggaggcaaagcgtggaagtcaccgaggacctgatggaaagcggacagcaccaaaaacacaatgaataggaacagcaggaaaaaactacagacgagacaacaaagatgaccagagaggacattgaaacacaatggggggataagagaacatgggccacagcacagaacacagccagggaaaaacaatcaaaagtcaaacaagcacagacccatacccgtaagccctgactcacgggaaacatgacaacggccacacaacaataacatgacaaaccagcaaacgacacaagaacacaggacccaggaactcgagcagcaaccatatgcccatcagcgcgggcccatcacgcggccaagacaagcgagaaccaaaaggaggaaaacagaaggagagcacggacagaaagagggaagaacaaaggaacagcatagaacagacaaacacaaagaccaagacaataggcgagaggacgacagggaaaacgacagggagagaaagacaggagaagaaaaacaaaggaacacaaagaagggcacacagaaaacatagacaagcgccggaagaagatacaaacaaaacaagaaaaagaaacgacggacgacaacagacaaccaaagagacacgacaaagaggacagtggcaccacccacaaacacagcaagacagagcagaaagagacaggacaaagacgcggggcaaacccgcaggaaagaagaaccaacagaccgagcaaccagaacaaacgcacaggaaagaaaaggcacagcgaaggcacgagcaacgcagaagacagacccgcagccgagaacgaagaaccaagagacacacagacaaacacaccgataacaggcgcaggcgagcgacaacaggaaagaagggccatcgacacgacgcggagaagagcagaagtaagagccacaacgcaaggctcagaccagcagcaggcggcggagacaaaatgacaaacaagcggaaggcaaaggcgcaagaacgaaaagcaagggacgagagacagggcggacggaacggagaaaggaggatagcagggagcaaaagaggccgcgagagcacgagaaagcaaacaggacggacggaacgac

SEQ ID NO: 632533 - DNA, 121 bp, Homo sapiens
gcgccgatatagaggatccccatcgcgtgctgagcattatccgcgtcagaccatgaatcagataggggcatgcatccggcaatggggagtgacacttctcttgcttgctgtcttcacctcc

SEQ ID NO: 632534 - DNA, 151 bp, Homo sapiens
  misc_feature (2)..(2): n is a, c, g, or t
  misc_feature (95)..(95): n is a, c, g, or t
tntatatgaagttttattctcaaaatataaaaaaaaaaaaacaaaccccacacaccaagggactaagatgatgttatttacagtcacttgcttgngaagaacacaattcaaactaatggacaagttcctccatgtgctctaggtattcaaa

SEQ ID NO: 632535 - DNA, 102 bp, Homo sapiens
ctccccaggtaggcgatgcatgtttcaaatatggtgactggctaactggatgatacctgggaagatggtgaaaggaatgggaggtgctatggatttagtgtc

SEQ ID NO: 632536 - DNA, 457 bp, Homo sapiens
cggcgttatcaacacacacaagcttctgatgacctggatgaagagcagacacaggtgcacacggtgctgtgtacctctcagcaccatgatgatcccaaagcaaaaagtgtgtttgaggtgttgaaagaaaaggctggacctggctgtgatgttgaattgactgctagttctgggtggtgtaaacaattcaagaatcgttattcattacataatgggaaagtggtgagtttgtgagtgctgatgtaaaggcagcggaagaattttgggaaactctagatcagctgagtctggaggaaaatcacttgccagaacaaattttcaatatggatgaaacctttctattctggaaacagatgcctgaaaggactttgatccatgaggtagaccaaagcaatgccaggcttcaagtcttttagggactggatgacagtcttgcttgggggcaatgttgcaggcc

SEQ ID NO: 632537 - DNA, 167 bp, Homo sapiens
atttccaagtcaattttcttttacactaaaacccaagaatctatctttctaggtctcatactcagttcttaatgtagtcacttagtaaataacctgaatatgcttgtataatccacactaatttaagggtgaattcctcattccgcttttcagatcatggggtacgg

SEQ ID NO: 632538 - DNA, 326 bp, Homo sapiens
  misc_feature (34)..(34): n is a, c, g, or t
  misc_feature (48)..(48): n is a, c, g, or t
ctgcttcagacggaaggagtttaaagggaagatntgggcagaattganagagcagtgggcagccaggcgcagtggctcagcctgtaatccccgcactttgggagggccgaggcaggtggatcatgaagtcaggagttcgagaccagcctggtcaagagaccagcctggccaacgtggtgaaaccccttctctactaaaaatacaaaaatggccgggcgtggtggctcatgcctgtaatcccagcactttgggaggccgaggcgggcagatcacgaggtcaagagatcaagaccatctggccaacatggtgaaaccccatctctact

SEQ ID NO: 632539 - DNA, 442 bp, Homo sapiens
gtgacgcgtaggtcgatgctggttccctgtggtgttggtcggaattggggggcagagctggttccctgtggtgttggtcggatgggggggcagtgctggttccctgtggtgttggtcggatgggggggcagtgctggttctctgtggtgtaggtcggatgtggggtggggcagtgctgtgttccctgtggtgttggtcggatgtgggggcgtgctggttctctgtggctgttggtcggatggggggacagtgctggttccctgtggtgtaggcggatggggggacagtgctggttccctgtgcgtgttggtcgtgactggggggacagtgctggttccctgtggtggtgtcccttcttgctgtgcagggtggagggcatcttgccacgaccaaaggagccattgaccttcaccgtttctagaaggtatgttgtatgttcacc

SEQ ID NO: 632540 - DNA, 471 bp, Homo sapiens
  misc_feature (3)..(3): n is a, c, g, or t
  misc_feature (121)..(121): n is a, c, g, or t
  misc_feature (132)..(132): n is a, c, g, or t
  misc_feature (278)..(278): n is a, c, g, or t
  misc_feature (291)..(291): n is a, c, g, or t
  misc_feature (334)..(334): n is a, c, g, or t
  misc_feature (460)..(460): n is a, c, g, or t
  misc_feature (471)..(471): n is a, c, g, or t
ctnaaagtagggctggtgtcttaagttgtccttaacatgcacttagggtaaggaccttggggaggaaacatcatcatttcccaaagattaaggactagccccagacatccctagttttaanactcatttganctgtcctcccagagattttttttttttttttgagacaaagtctcgctctgttgcccagactggagtgcagtggcatgatcttggctcactgcaacctccacctcctgggttctcatgcctcagcctcccaagtagctgggattacnaggtgcaccaccnacgcccagctaattttcgtatttttggtagagatgaggtttcncatattggccagactggtcttgatctcctgacctcaggtgatctacccgcctcagtcgcccaaagtgctgggattacagcatgagccactgcatctggccccagatattaaagttaaacctctgancaacccacttn

SEQ ID NO: 632541 - DNA, 248 bp, Homo sapiens
  misc_feature (41)..(41): n is a, c, g, or t
tccttactgtaagagccatttaaacgattaaaatcccactngccataccgtaagatgataggaccaaccatacctaccgatcaaaaatttatcaatccaagccaactacactcccactgctaaaaagatgaaaggaccaatcaaagatttaattaaactaaagggaaagaatcagagacagagaatgaagaaagaaattctaagttgcgacggacaaaccagaacagacaatgaagcctttcaactgc

SEQ ID NO: 632542 - DNA, 130 bp, Homo sapiens
acacagtcaagtctttgagtcaatgtgtgttacgactaccaaggctcattagactgaacaatgttaagttggctctggatgcagatgatatgcatgctaatgtcatgaagaagaaatccctatctaagac

SEQ ID NO: 632543 - DNA, 885 bp, Homo sapiens
ggtctccaggcatcctggtgctacaatatcggtccccgcgggttggaatggcagacttcggctcaagcgtggcagactccccggcgaggcctcctgtaccagctagagccccacccccgaccccagcccggagagggcggaggcaagaagaaggctcattagaacctggagtgggaacccagacgggttctggacctctttggtgcagtcccctggaagaatgcagggggtccatgcaggatgcgcagagactactgcgaggatccgaggggatggcgttacagctgtgcgcgctgtgtggatgcgtgacgcgcgcatatgctgcataccagtgcagcatgaagccgctgcacccatggtgaaggaccccatcatgcagtgacgcctcaggtctaagtctctggcttcaaagtagagctgaggaaacagggcccgacaagagtgaattcacagatgcgcgacgatacttgtaaccaatctctgcattgcggtcactgcgacgtacgcatcaagaccacaggcaaccctttagtgcccatttcatgggacatatgtcacctgaaaaccgacattaacgaggtcagaccgtcgctggggcagaggtcggtgacaggaaaggaacagaattgtagtagttctcgtgtgatgcaattccccaagtgcagatggtcgggtgggaaactgaaggctgagttccttcacggtccatgagccctgtgcccttgcgagaggtgtggtagacccgggtgatggagcacgacagggaccaccaacgtgcaacggacaaatgatcccactgggaagacagctattagagagaagccatggcaggatgccatttcgccgggcctgacaaggtgctgagagccaacaagagaaggacac

SEQ ID NO: 632544 - DNA, 205 bp, Homo sapiens
acgggtttcaccatgttggccaggctggtcttgactcctgacctcaggtgatcctcctgcattggcctcccaaagtgctggaattccaggcatgagccactgcgcccagtctacacactaattcttgttagcccacagctgttctgttctatctaccctcatttaacgctcaaggggtcatacctagatagttacacacaagggg

SEQ ID NO: 632545 - DNA, 167 bp, Homo sapiens
catggcccaggtcaccccccccctggtccacatcatgaggaagtagaagaaaacaggacccaagatggcaagcctgagagaattgcccagctgacctggaataaggcctaaaccccaatttttttttcctaataaacagcctcctagaggcctcattttatttttta

SEQ ID NO: 632546 - DNA, 137 bp, Homo sapiens
tcgataaggggcaaaacatgaatttatttctggaattttccacatcatatttttggaccaagggttgcctcaggtaacaaactacagaaagtgaaattgcacgatgaggggattactgctcctctgctctaaaattg

SEQ ID NO: 632547 - DNA, 553 bp, Homo sapiens
agaatcttatatttagctaccttactaaattatcgtattctagaattctattaaccagagtattagtattttctttctcttttttttttttggagacaaagtctggctcggtggccaggctggagtgctggggtgcgatctcagctcactgaaccctccacctcccgggtaccaagtgattctgcctcagacctgccgtgttgttagctggggattacaggcagggcgccaaccacaccgtggctaatttacgagtattctcttaggctagaagaacggggatatacaaccaatgatatggacacaggaatggatcctcaaatccttatatgacacattcggtgactaatggccccgaggtcataggagccctaccacaagacatatgagctgggagaatatacacaaggcaaattgagagcttacacgggaaacccccaagccagaacgtcatttatggtaatataatactggtggtaataaccaagtaccaatatcaaggaaaaaaacagggtatacataataaggatttcacctaggtaacacttatctc

SEQ ID NO: 632548 - DNA, 181 bp, Homo sapiens
cacgaggccagtccctctccctcccctccccactcccttcccctcctctccaggcctgcgcgcgcgcctcttcctccggcacgcgccgctgctagccgagcactctcgccagaacctctggctcgcgcgtgcccttttcccctcaggttgtggggagagcggaatcctggctccgccgtcc

SEQ ID NO: 632549 - DNA, 1232 bp, Homo sapiens
gagcccgcggacaggcagccgggaggagcgggcgcgctcggacctctccctgccctgctcgttctgctctccagcttgggatggcaggatacctgcgggtcgtgcgctcgctctgcagagcctcaaggctcgcggccgtgcctgtggcgccggtggccctgagagccccactcgcaagagcagcctgtgggccacatgtgagtgccgcgcggagggtccaggcaggcgcagtgcccacagctgcgacgtggtgcgtgttccccagtgctggggccgggaaagacacgtaccgcacagacctgcatgccgggggaccggcggggtaaacggcgccacaaaggggcctgcaggctggcaacgtttccgactcccagcggataccccacagacaacgggctcgcaattccccgggccttgtggacaaatgcgacgcactggcaggttgcgccacctttcgacgccagaccggcagtgggcaacttttgagttgggccctgggggacagacggccaaagtatattagaaactggcaacgaaggcatcgcgcgacccatggcccgccggcagaccccccgaagaggcaaaataccccgggccacaggcgcaggatcccaatggaaaacagcgtgtccacacggggaacaccccgaacacggggtaggcacatggcaccggacagcatggagacacacttggacaccaagcagccacaagacacccccagcagcgccaggcaactgggaaacaccaccacggacggcggcacccccttggccgcacaagcgaaagaacacagggagccgagagccccggcccaacgaaaaaaagggcaagggaacggccgacgagaaaacttgtgacagacgacccccacagcccaatcagcagcacaccagcgatgcagcagccctgaaaacagaagcgcgccaacaggaccgcggaaagtatcaagggcaacccactacacacaaccggcaaaagcacacgcacaagcaagcacatccccagtcactacacgttcgagcacaccgtaaccggcatgggggtaggagacacaaccagacacacgcagccaacgatcagcacccatccacactggaagggcaacaggtaggcgacctccaaccagaggggcgccgcacacgacggacgacaagaacacgcggccgtaggcaccacagaaaacaacagcactaaaccagtacaccgtggcacaacacgagcggacaaaa

SEQ ID NO: 632550 - DNA, 391 bp, Homo sapiens
gtttgacgcagctgccgaggagcgaagacggtagattggtgacaggtatcttatgaagggacaatggattcccccaagaagaggtactatcaaaagagagtattgtcctgatagggatagaatagtaaggtgtagatatctaagacatataggaaaaaacaagctgtgagaagtaatccaatattataacagttgacaatagtatatagtgaaatgacaaaacgggcattataaaaatgattgtgatataaatacttgatagtacaaatataagcttactcataagtatagtagataatataatgaaatagggtaatgaatagaaatagaagtataaacatataaagaaatatgagtgataatttaagtgtatgagtatttattcgttccg

SEQ ID NO: 632551 - DNA, 146 bp, Homo sapiens
tagctgtagaatgtttatgatatagattattgaacacagtaatgaaaaaaaaaaagaaggaaacagttatggagatttgctcattgaactgagcttggtctttctcttaattatctcctgtccatagtgatgatggaatttttatt

SEQ ID NO: 632552 - DNA, 205 bp, Homo sapiens
cgattgttcttattgtatgtgctgacttccttaacaatttcctcatatctcttcgggcatgtacgggtggcatcagatggaatccattttgttaacaccgactattagttatttcacaacccagtgtgtaagccagaagggcatgctctcggggtctgcctctttcattggagcatgccagcgttcaaattcacgcaacaccagc

SEQ ID NO: 632553 - DNA, 117 bp, Homo sapiens
agataaggcagtttgacctgacaccacattttccttctatgcaatcatgcctgtctagataatcttgcatatgctttcctctgtagctttagtagggtcctaagttgcacactgggc

SEQ ID NO: 632554 - DNA, 339 bp, Homo sapiens
ggccggtacctctccctactgtatctatccaaaggtcagtacctcaaagatcaaggcagataaatccacaaagatgagaaagaatcaatgcaagaacgctgaaatctcaaagagccagagtgtctcttctctaaatgattgcaacacttctccatcaagggcagagaactgggctgaggcagagaagaatgaattgacagaagtaggcttcaaaaggtaggtaataacaaacttcgctgagctaaaggagtatgttttaacccaaggcaaagaagcgaaaaaccatgataaaacattacaggagctgttaaccagaatggctaggatacagtagggaga

SEQ ID NO: 632555 - DNA, 610 bp, Homo sapiens
  misc_feature (224)..(224): n is a, c, g, or t
  misc_feature (274)..(274): n is a, c, g, or t
  misc_feature (353)..(353): n is a, c, g, or t
  misc_feature (377)..(377): n is a, c, g, or t
  misc_feature (384)..(384): n is a, c, g, or t
  misc_feature (470)..(470): n is a, c, g, or t
  misc_feature (474)..(474): n is a, c, g, or t
  misc_feature (485)..(485): n is a, c, g, or t
  misc_feature (492)..(492): n is a, c, g, or t
  misc_feature (495)..(495): n is a, c, g, or t
  misc_feature (514)..(514): n is a, c, g, or t
  misc_feature (542)..(542): n is a, c, g, or t
  misc_feature (545)..(545): n is a, c, g, or t
  misc_feature (555)..(555): n is a, c, g, or t
  misc_feature (574)..(574): n is a, c, g, or t
  misc_feature (576)..(576): n is a, c, g, or t
  misc_feature (599)..(599): n is a, c, g, or t
aaccggaggcccaaagtttaaaaaactgtgcggaaggctcaacaaaggcccccaatttggtttagcccagggtggattcccaagccaattatgtgcctttcccatatgaagtcagaggttttccccccatatacttcttccagcccccaagaagtttaatccaaagaaatatgaaggtggccgtgaattaagtgtttttattagctatctccaaagagaagctnccaccccccctgtaattcaagaagaaaaaccccagaagaagaagaaggcncaggggggtctttaaagcagtagcccaacccccctttgtaaaagggctcttccctcaaagatgggaaaacccttggggngggctaggacccatatgggaattntttcctntcagggccgagagggcagaatggatataatttgaatcctgttaaattttctttaaactgttttttagctgccctgtttatggaaanaccngggcccgtttntgtttgnggntttgggaaaaattatttgngttgggggaaatgttgtggggggggggntgngttggggggnttttttaattttttttggncntttgggacaggggcaataaatgnggcccctttta

SEQ ID NO: 632556 - DNA, 561 bp, Homo sapiens
cttgaacctggagttcatcacattacgtcacagcttcccatctggtggctttcctgagtcagctacttcacactatgtcaaggctgttgtaccccaaaactcagacgaggactttctatgcatgttttccgctcctccccccaatatcccccccccgagtcaccattatgtccacaggacagcacttgagaagtagctttttgattcctagtaggtgtacatttaaattcgtaaagaaggttgcaatgtatcatgactagttgacgaaactgttgtatggtcttcttgtgacagaataatactatattgttacaagtggtacattgacgcctagttccggaagctgcagccgcttaacaacacacattaatgacaactggcacgcactggaatgcatctccagggcaactacacacaacactactcacaacataccaaaaaactatgcaaacactacatgcgcgacagaacaagaacagtcgccagcacgacgaatcagcaagccagcgcacacacctaccaacatacagaccacccacgactgaccaccaccagccagga

SEQ ID NO: 632557 - DNA, 1534 bp, Homo sapiens
tctagatcgcgagcgggcctgcccttttcttttttttttgggcaggcaatgacaaaacctcagttaattaaatggtgtgcaaagtcggagacagcttgacgggtgtcgctccttaccgccggagacagaatggctttatcatttatatgggaaagtgacaggctttcacctactttaccactattatacactgtcacgttataacactggcaagagacccgggtacaagaaaccagtgggaggtgggcggagcctagggagaaactcaagaccaagacccaaggcggcagcggccatctcacgggcatgagaccgggtggcaaacaagaagtgggcgccaggagtagacggataacatagctagctcagagacgcctcaggagagagagcacccaatagacacagagcagtggaacaactgagcgaagaccccccgtgaatataacaaagcaaaccacaacagatagatagcacacactagtagtgagagagcgcccaagtagagaagagatacaacaatgaacacaataaaacgccaatcagagagacaaacactcacaacaccctcacacaataggagaatcacatcaaagaacacctatcaaaaagtaatcccaatatagagacatataggagcccccaatgaagaagccaaatgtagaaagagagagcaaaagcaccaagacgaagacccaaatgtagataacaacccattgagtgtgacaaaaacaaaagcgcacaaagagaggagaacaaataggacaaaaggagcgcccaaaccagcggaaggagagaacgcgagaacgcaccaataagcaaacacaaagagaacacatacacacctgaagaagataacagactaaaggacccaaagacaacacccacgcatgacacaagcgaccatgagcccacccacacacacgtagcaaagaacaaacgcaggggaccatgggagcatagcgaacacagagaacgcggcacaagagggccccccccccaacgtagacaacgagcacacaaggcaacacaacgggaacaaaaaaggagaaaacacaccaaaagaaccatccagaaagaatacaacggaaccagaatcacgataaatagacaaaacccaaggaccagccacaccaactgaaccaccagagaaaaagaagccagacccaggagcacgagaacaccaaacacacacaaccacaaataccaggaagacaaaacagagagataccaccccaaacactgagcagccaccaaagccaccccccaaagtgaacacgagagaaacacccaacgaccaaaaagagggacaacaaaacacaagcactaggaagaagaccacacaccaaaaaactaaatgaacaaagacccaaccgactgaaaaccaagtcctatacaaacacatgtctcacaaccacaccccagaaggaaatcaaaagaaccactaacatgaacatactagcacaaagcaaaaaaacaacaacacaaacagaacaaaccacaaaaaaggacacaaacacaccccaccctatccccc

SEQ ID NO: 632558 - DNA, 746 bp, Homo sapiens
gacaagtgtcttttgaaataaagaaccagtccctccaaccctcaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaataaaaataaaaaatatgataaaaaaaaaaaagatattataaaaaaatgattgagatcggggcatagtatagatataatgttgattgagacgtggtgatcagttgtgctgttgtgatattgttgttaagggtagcgttaagtgcgaggggtacgtagtggaataatctattcggagggaaacgccgtgatcatattaaggatactattacaagaggttagaaaggaggataaattataagaattgatcaacgagagaacaataaaggctcgtaaaacaataaacggtgtaaataagtgtgaaggaggttatggaaagaatttgtgcgtagtcaagaggtgtgagtgttgaggtatttgtggggaggaaacgggttattttgtgtacaaggaaggagtagatttagtgagagcgaagagggggggagcagaaggaggagggggcgagagggagtggaggagatgagagagaggagggaggcaggggggtgccgagagggggagaggggggaggaagagaggaaggagaggaggagcggacgaaggaggagagggagggaggagagggagggggaggacaggaggagggagacgggagcgcagtggaggagc

SEQ ID NO: 632559 - DNA, 109 bp, Homo sapiens
tctgacattgatctaccaagtgagataaaaaaaaaaaggagggacagtgagagggaaaaggagagggagaggtagagagagagaaaaggtagagagagagaatcttact

SEQ ID NO: 632560 - DNA, 1087 bp, Homo sapiens
  misc_feature (29)..(29): n is a, c, g, or t
  misc_feature (43)..(43): n is a, c, g, or t
  misc_feature (325)..(325): n is a, c, g, or t
  misc_feature (377)..(377): n is a, c, g, or t
  misc_feature (385)..(385): n is a, c, g, or t
  misc_feature (422)..(423): n is a, c, g, or t
  misc_feature (426)..(426): n is a, c, g, or t
  misc_feature (428)..(428): n is a, c, g, or t
  misc_feature (431)..(431): n is a, c, g, or t
  misc_feature (440)..(440): n is a, c, g, or t
caggtatgcctggtgtaaatcggacgagnctctggcgcttgtnctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggcctggtgccggcgaaggaagaccctggttgcggccttcttggcgcagctaatgagagcgagattgcgtggcatcgagaacgacgaggccttcgccatcctggacgtgnggtgcgcccccgggccccaagccgcaacggggaagccgccgggggtgtccgnatgctgtngatggagtaatgaatggtgaatactaccaggaaagtnntgntncanacagacagntatgcagctatattaacgaatgtggatcgattgcagtcagagcctgaaagtatccgtaaatggagagaagaacaagaatggaaaccgcttgtgaagcaccttggatgccaattctcgggaagcacagaatactagaagttgaaacgaaaaggcatagtaatagggagctagagtgaatggtatgcaaacataggacgagcagttacagaaaacaaaagcagtcaagcatgacagcgagaagaaggccttggtaaatgacattgacgagtcgtgcccatgcactgagtgggaccggctggtcgattgtgtgagttaagccccaagtctatgagcaggccaagatgtttctcgcatgggctaagtcattatctccctcattaggcgacgcggatgactgaaagcaatctggtgaaagactacatttgatattatctactaggaaactatcaatgcaaagcttaattatttaggcctttggcagaccttagattaaaggtattgttggatgatttctcttaggttccggttaaagcagaggggaagaggggaggcaagattgggtggatagagatgtgagataaagagaaaaacgatgtgaggagagtatctaaaggaaaaaaaaggaagattataatatatattataat

SEQ ID NO: 632561 - DNA, 276 bp, Homo sapiens
tccccccccccccccccccccccccggggcccccccctttgaaccgggtcttttttttatgtttcaattctgtgacctcacccaggccctctcctccttgggggtctgccttcggggtttttatccctgggttttgggctggggagggtttgccccggtctttacgctggtgcttttctgtgtggtgtgctgtgtttttgtctttttttctgtttttttttgtcttttttttcccgtttaaattcctgcctctttggcttgttctttggcatgtta

SEQ ID NO: 632562 - DNA, 559 bp, Homo sapiens
  misc_feature (168)..(168): n is a, c, g, or t
ggaaagcgttcggatcccaaaacactctacctcgtcatcagggtgtggtggcgcaaaatgtccttgctggcgcgggttgcattcctacccatttgacaccgttccccgccgcattatgatgcagtcaggggccaaaggaatttacatcatgtccccaggcccgcttgnctggtggcggaaaattgctcgttaaaagagaggcaaagcttttttcaagggggcatggtccaattttctcaaaggcatggggggggcttttgggctttttttgtaagaagaaacccaaaaggacccaaaagttttttcccaggatttttccccccgggaacaggcatgttggattaaaaaacaaattttgggcctttttggcaaaactccggggggtcagttttccaggggccactatttacgggttgaaaaagggaacccaaaaaatttctttgccccgtttttttttaaacccctttccctgaagaagaagagggggccccattggattttttttttccgccccccctgataaaaaaccaatttggggaaataaaaattttttaattta

SEQ ID NO: 632563 - DNA, 1196 bp, Homo sapiens
  misc_feature (29)..(29): n is a, c, g, or t
  misc_feature (43)..(43): n is a, c, g, or t
  misc_feature (325)..(325): n is a, c, g, or t
caggtatgcctggtgtaaatcggacgagnctctggcgcttgtnctcctctcccagtcggcaccacagcggtggctgccgggcgtggtgtcggtgggtcggttggtttttgtctcaccgttggtgtccgtgccgttcagttgcccgccatggctgagctggatccgttcggcgcccctgccggcgcccctggcggtcccgcgctggggaacggagtggcctggtgccggcgaaggaagaccctggttgcggccttcttggcgcagctaatgagagcgagattgcgtggcatcgagaacgacgaggccttcgccatcctggacgtgnggtgcgcccccgggccccaagccgcaacggggaagccgccgggggggtccgggtaatggtccaagcagacagttatgcaatgctataacaccaaagtggatcggatttggcatgtcagagctctgaaacgtatttgcggttagactgtgatgaggacggaaagcaataagtgtgaaaccgcttggaaggcccttatggatgccaaattacttcggaaggcaagaatgccaggagtggaaagggaagaagtgcattaaagggaggctagaaggaattgggtattgccaacgaccagggaccgaaggcaggcgataacctgagacataccataaatgtcaaatgccacagcgcaggggctgctctgccgatttgaaactcgcgtattctaataagcacgaaatgccatttcgggttgaccgggttgaatgcgggctagtggtcgaacgagacgcactttagaccaaattcccctgttggcctaaaccacggactcgttatggaaaaaagcaagtgtcgcatgtcacaggaaaatgaagagggcgccttttgtgcttagcaagttggaccccattttggcacacggacagcgaacggctatcccgcgcagagtagccaaaccgtgtagagttttggggcacaaacgcggtgcaattgaccgcccgggggcactggttgtatgagcgactttaaaagagcacacccaacaaaggtaattaaagcacggaaggtcaaggggcccacaagaggaagtggcttgtacccacgggagaatgccagcccccaaacagcaccctccaatatcatacgccctcacagagggcaggggccgcccaggaaggagagtaggccggtgcacagaagggccgcgccg

SEQ ID NO: 632564 - DNA, 951 bp, Homo sapiens
  misc_feature (590)..(590): n is a, c, g, or t
  misc_feature (619)..(619): n is a, c, g, or t
  misc_feature (689)..(689): n is a, c, g, or t
  misc_feature (737)..(737): n is a, c, g, or t
  misc_feature (781)..(782): n is a, c, g, or t
  misc_feature (807)..(807): n is a, c, g, or t
  misc_feature (811)..(811): n is a, c, g, or t
  misc_feature (823)..(823): n is a, c, g, or t
  misc_feature (836)..(836): n is a, c, g, or t
ggcagcagcagcagaaagccttaaacagggacgaagaactcataactctagaagaggtggcagatatagcctaaacggcctaagatgtacacagagaaaacacatagctgcccatagacacagaaagcggaggaaacgaattaaatctcgaagtgaaaaaaaagccataaaccaccaccgctataatcccggccgcctgccggcgtctatacgttactcggcccgaccacgctcctctcaaaggccttacccccatgccagaccccggagaagtcctaagcgcttcccccgtcacgaggcccgaggatcgtcctatacaaggcacgtcggcggcctctgcccgcacccccgccacactccccctacagcccccaacccccaaccccccgcccccaacgcaacccccgctttaaactcaaaatcggcacaagcatccaacaagccaaaaaggaaagaaaacactccgctgccaaacgcgaacgcactccatgttatacgcaaccaacaaccaaccacacgcccaccccgagaaaaatggcccaaaaaccgacaggggacagcacgtagacgcgtacacccactcaatctancatcagcacccccgccccgacgaagcaanatctccccacccacgcgcccctaaccccaatcaagaaacaaatcccaaaacttagccaaacccccacacncacccccagctagtctctcacccgaagagccccacccgaccccaccgnaccactaccccccgcccgacaaatcagacaccgatttgtgccannttgtacgccgaccacccgtgccagnaccnaaaccaccccgntaacctaacactnctcacacccacacaaccaagccacaccaacccactattccacccacacacagacccatccccaacgccacaccagcacgcgcccggcccgaccccggcccggcaagactcgtcgg

SEQ ID NO: 632565 - DNA, 416 bp, Homo sapiens
aaatcaaaacttacataataagggcaagtaacacaataggcccacacttgcatgacatgctgtgtagaaagtgtgcacagatctgtgactcagaccagatgtcctacgcaccatgagcaggtgctggtgctaaagacactcacagccttcgccttcatccaatactaataaataacctacagaaagagcagcgctggaggctggcccttgagccacccactgctaccgatgcgcagccaggcctgcctcatagccctctgtcttcatgtcattgagccctagctcctcattgtggccaaaggtgcgcttgtagcgctccaccttcatgtcaggatcatgttcaggcgcatacacattctgcaagtaactgttccctgctggatcatccatactaaagagtgcctgtatgtcacctt

SEQ ID NO: 632566 - DNA, 820 bp, Homo sapiens
ctcctgaaagtagctaaagaatctggcaaaatctcctgtgattgtaagagcatggtactggcacatggacggtctacctattgcctataagccgactggaggtcgagttggggtgtctcacagcagctgcaccccaatgacccatcgacccatgtgttaccgagtgggccaatgaggaccttagctggaatagctgagcttcatccatgagtagctcactcgtgaagtcctgcaggagagtgtatgcagaggctggcagggaccagggcatggaaaatgaccggtggcaagaaaggcagaacgttggaggccaacagtgtgtttcgtcaacacggtagcaaatgtttcttatccatgccgtgagtgaggaggaactcctggcatgcacattgttggttgattgccagtcccatccggagataaaggtcctgctatgacgggtattaagccgtaattctcgtgatatagttacaggagatgaatcccggaggtatacaatctggacgcaagggttgtcccacgattcttaaacgtaaggattagcatggttggtattgaacaacgatacttactatacacaggcatatttggtagattgcaggttgttctcggaaaattgtcatgttactgacaagcgactgtgagtggttggacaagataaaacatgtgacgaaccagggtcatctttaaatctctacctatcaggcgcagtccggtgaccccttcctctcgtgaacttggatgggacaccgggctatccaaccaaaagggttacgctacttccatgcattgttccaagtgaagaaggccaggcgaattg

SEQ ID NO: 632567 - DNA, 645 bp, Homo sapiens
  misc_feature (572)..(572): n is a, c, g, or t
gccggggggggccagcgaggcacgttttttttagcgcaggtcctgaaacgcggcctggaggagatcaccggccacggcggtctccgaggctatctacggttttttttcaggacaaatgatgcgaaggttggtacattagtggcggaagacaaatatggaaacaaatactatgaagacaacaagcagttttttggccgccaccgatgggttgtatatactactgaaatgaatggcacaaacacattctgggatgtggatggaagcatggtgcctcctgaatgccatcgttggcttcacagcatgactgatgatcctccaacaacaaaaccacttactgctcgtaaattcattcggacaaaccataaattcaacgtgactggcaccccagaacaatatggaccttattctaccactagaaagaagattcaggggcggtcccccatttaccaccttacaggcaagacaatgaagaccaggggaaacatgccaaatttcgagcgtttcctggaactactcttctcctggttacccattccctatcaatcgacccttcgatagtgggggggctttcnagcaaccgtttcgcgccgccctcggtcagggttctgggcctcgcccggcgactccaaggtcctaactgggccg

SEQ ID NO: 632568 - DNA, 318 bp, Homo sapiens
acccacagcttccacagtcatgtggtgaaaggtgtgtcctctggctgggcgtggtggatgcctgtaatcccagctctttggaaagctgagatgggtggtttgcttgaggtcaggagttcaagccgagggtggtcaacatggcaaacccccttctctactaaaaacacaaaaataagctgggcgtaatgatgcgtgcctgtaatcccagctactcgggaggctgaggcacaagattcgcttgaatccagaaggtgaggttccagtgacctaagattgtcccactgcactccaccctgggtgacagagtgagcctctgtc

SEQ ID NO: 632569 - DNA, 99 bp, Homo sapiens
acagccgtcgtaggcagtgatcactgcctacgacggctggcaccgcaaccacagtcattgagatacaagtttccgaacaggagcccccctccacaggta

SEQ ID NO: 632570 - DNA, 84 bp, Homo sapiens
gatccttcgaagcactcagttcactcttccccaccacagtggttaaaaggcgtttgtatctgccactatgtgtgtgttttaaaa

SEQ ID NO: 632571 - DNA, 1233 bp, Homo sapiens
agcggggggcggatccaagatggcgacggcgatggattggttgccgtgcgtctttactgcttttctccctgactgtgtgcaacacaagcgccttctagtgtgacctggggttcgcgcctattcaacttccaccagatggagactccggcaaggaaactcaatggcctgtgaagtgcgtcaacagtctctgccgatgcccagactagccttgatgaactagctgattcactgatccgttctgtgcagacccagtgaagtataacctaccaaggtcagagatatcttgggcagcatggtagctgtagtaggcgtgatccggcatttgtctaacggacctcttatcggaagttcttcattgaacatctgacgtagagcaatgtgtgcacagtacttgggcatgcccatttccgagctcaagccgagatgaacccgtgtacgcgatggcagctgagaagccggaacatccgttgagccagctgcgggctttccactaattaacggaaacttaacttaaactggtcacaacccccttcgaatttgaccttgaacaagacctcgtggacccacttgttcggagttcgaaccgcaccagggcgtttttgaggttaatgcccttttcttttaggctgtttccaccaaaagcagtcttgtcatctgacactaatatgacttgaatctttggaaccccattaggtgaagcacagaacactgctggtattagtctcacactgtgaatttcgttgcggcccaaccgcctttcgtgtacgaggacacatccttcatctcggtagtgggtttaactataccatagtgtagtcaaataatccctgtgtcacattattttacaagaccaactggttaatcatagctttcccaaaaaaaccaacactcgcaaaaattccctataatacccctcgtttgtgcccagagcactatatagaacccctcacatcaccccgtttgccgattaccaaacactgttctcaaaatttttccccccacatatgtttactacaatctcctttcaacattttcgctatatatttccccgatacccagttcaatgcatacagaactcctcaccatttgtgcggtcacctcaactgctccaacttgtgcactgattcatcccccacacgtgggacaaagcatatcccaaccctatatctcgcgcttttacatccacacacaatcgttaggacacttccgcatcactaaatcatccgtagcact

SEQ ID NO: 632572 - DNA, 156 bp, Homo sapiens
tccagagagtgtgaggccctgccatacaaccatagattttggacttctgaccttcagaaccagagagaatatatttctgggttttgtccgttcatttgttttactgagatggagtcttgctcttgttgcccaggctggagtacagtggcgtgaccc

SEQ ID NO: 632573 - DNA, 133 bp, Homo sapiens
aggactgaagcactgggggtggataataatgtcccaacactccatatccttccgtggctttcaaacgataaaccctggagtcccaagcagctgccttgtctccctcaactgcagtcctcccccaggctcacag

SEQ ID NO: 632574 - DNA, 496 bp, Homo sapiens
  misc_feature (1)..(1): n is a, c, g, or t
ntgatcgagctcggtcccactatgttgatggtacaatcacacccatcatagctttcacccacatgactatcctactgcatcgctaaccccagtaaaacactcaccaatgaactcaaaccgctgatccccatgcctcaggatactcctcaatagccatcgctgtagtatatccgtaagacaagcatcatgccccctaaataacttaaaacaggctgttaaacccattatatctcgcccaatagttcagaattctagcatgaggtcaggtggagaggggcgggagccctgcaccttgcagctggttggtgtcgagcatgggtggtgggtgggcccagagcacacgcgtgtgcattcagaagtcgagccgctgagccactgtcagtgccagaatgtcagccctgggatggggatgagccggtttttatctcttccggctgtgcaggatttacatgcttttgaaacgcaggattcttcagaagaggccggtgttttaatc

SEQ ID NO: 632575 - DNA, 237 bp, Homo sapiens
aactatatcgctttcaatctactgagggataagactaacatttttaatccccattttaggaacctgtcaatagaagagtaacaaagaccttattggcaatcttataatgctcaggttctaactacagagcttcttcacatatcacgagcagaccaccctaccttaggaaatctttaaaactgctttataagagagtagccttggtaggcaaaaaaaggaagataagaatggaaactt

SEQ ID NO: 632576 - DNA, 391 bp, Homo sapiens
tgtgaggttggataatgttcagacagagtgattacatctttaacagatagttaacattaattctcttaattcttttcttaagggggaattaattctttaacaagtagtactaatgctcaacatacaacagtgagcgagacttaatctctgccctccggaagcttatacggtagttcttttcagcgaaagaacttgtaagtccgaaaaatgtacagatggcattcacgagagtgtttagttctgttgtttgcgttccttctttaataatgttttaatatctccacatagttgaaaaaaagaaaaaatggaaaatatcctggaaggtttagtaagcaattattttctttattagaacaaagtgttgtttggtttgaactctattgtcatgggc

SEQ ID NO: 632577 - DNA, 337 bp, Homo sapiens
gctgtggtcgcagaatgctatcgctgcctgtatcggagacacattcccgtcagctggatgctccgcgctaccctgagatgagtcggaaaacttcgaagacagctgtatggcaagttggacaagactccccttattgctgatgtttattacattgtatggtggcacgtccccccgggagggggtggtcatcacgaggaaccgagatggcaccagcagacatttggcctctagatcctttgaatggagccgtggtttccgagttgagaacaaataacgaccactggacagccagcacccaaggaagatgaccggagaaaatctgccatcacggccctta

SEQ ID NO: 632578 - DNA, 84 bp, Homo sapiens
ggatttgctggtgcagtacaactaggcttaatagggagctcgaattaacgttagaagcttgaattcgagcagtagtagtagtag

SEQ ID NO: 632579 - DNA, 425 bp, Homo sapiens
aacaccacgatgacatcccaccggaacaaggcccagaaccacttcatcatggaacatcttattagtatcctgctgggcagcaagccatactgccaagacccctcccgcccatacctataagtacccccagcctgtaagcagcggtgggctctggcattaggcttgtcccccacttctgcaggttttatcctgggcagaaagcctgcatttgctgttgagccaccctctttctctctctctgtttgtgtgtgtgtgtgtgtgtgtgtgtgtgtgtgtgtgtgtgtgtgtgtgtctttctttaacccttgcgttccctttcaaacctaacaatatgtatcaggagctaaatgttttcccgaatccctattgaatgtctgaatacacgcaatcatataaattcaatattcttgattagaaacttaaaa

SEQ ID NO: 632580 - DNA, 420 bp, Homo sapiens
gcctactactactaaattcgcggccgcgtcgacactgcactccagcctgggcagcagagtgagtgagactctgtctcaaaaaaaaaaaaatcctcatggaaggattacttctaaatcgaggctgggcatggtggttcacacctgtaatcctaccacattgggaggtcgaggcaggaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaaa

SEQ ID NO: 632581 - DNA, 232 bp, Homo sapiens
tcaatttggcgggatggggtgagtgtaacagctttattgagatataattcctgtaccatacaattcacttaaagtgtacaagtcagtggtttttagtttattcacaaaattgtgcaactatcacctcgatatattttagaactcttctctattccttcaagaaacttcttttctgtcaataaacacctctttagtctgtcataccctgtaaaatttctgtagcccatttcaa

SEQ ID NO: 632582 - DNA, 791 bp, Homo sapiens
cgataccagggccactgaagggatagttgttggctcaacaagagactgttctcgatacacgtcgatatctcctaaatatttattctttggtgtcttgggacatgctgcagatcacagcacattgtcacacccggctcatgtgtttccaagcctggggctccactctcctctccactggccgtcttcccagagttgtgacagccaatcggatggctgaagcagatgcttctcaggtattaaggcttacatttggctgcaggtccctagtctttagcggggagtagattgttagtctggatcctcacctctacatgcagtctatcctcactggactcaactgactaatgcctgccttagtgttcaccagtgggttctggcctccttggcatgcaactggctgtatctcgacagactacacgtttaggcccagaccactggatggaggacggatatgcccaagaatcatggtcgatcgaatgccatcgcagctggcatcttccaccgatcctgggctccggatagcaagcaattgacctctgcgtcatcacgcaacgtatcaatgcatcgattttctccgcccatacacagtgcccaacaagaaggggatccacggcttggccggtacagtgtgtgagtaagggacactactgcgagtcctcaatctgagataaatcactccctctggtagatttgatggtgactggaaggagacagtcctaaacaatgacacttccatgaatggcatcagtgggtggctgcctcggttctggaagacggtgagcattgaagcc

SEQ ID NO: 632583 - DNA, 1284 bp, Homo sapiens
  misc_feature (946)..(946): n is a, c, g, or t
ccgtagctaacgagttcatctcggtgacgcggaatgcgcccgactacaaattttttcgttattatagcacaacacgcttttattctctaagttatattctcttggcctcgcggttttcctcgagaaactatatttccctcctgtggaatttttgcgggctcattatatccggccgcgctgttataatcgtgtttcatagtgggggccataacatacctcactttgtattctaaactttatgtgataactcccctctattgtgtgtagtacacgatcatcggagagttttgtccagatattatgtcgcccaaagttcatccaagtatttcccacatgttgttacaaccggggttgttatctccaatgttcttattgtggagtatactagttggtataacacttctgtggggatcaagggtgttggaaaaatttgtgagaatattttcagattatttatcttcaattgtgagatcgtgggtttcttccaaactggctttaatattctgtgtgattgcgtggtttttgttgactggcataaatgggggaacctcgggttttcctaataaagtcccgctagagctcctcttggtcccggctaaatgtgcccccaaaagtagataactctttgttccacattgtgagaaaagtccgggcaactttttgtggtgtttccacacaactcgtcctcgtgctattttcccggagaagatttttttaaattttgtttccgtgtccccctttccccatgtttctctctttaattggtaatctttatatgtgttatctcttggtttatatttgtttttctattttttttttatattttttttttttttgaaactaaaacacggccaaatgtgaaatggttattgaatctgagacactcagatggaagaacgcgggaatggggaataaaatgagactgtagtatttctgtgtgagaaantaagacccccttcttttccacctataggtggcaagagcgtgcaattcacgccgtactctatagtccattagtaaatcccagctaaggtataatgtttgcgatcatcagcttgcgtttgtgaaccaaaacaaaagaaaaaacatacaaacaataaaaatcctttgcataccgttgttcaattggagaagtatttaatgtttttcatttatcattgtaaaacaaaggagctaatgatgataaattatctttagtacgtagatgtaaaaatgtagggcaatgctgtactttaagtaagggaataaaattaggctgctaaaatcaaaaaagcatcggtagac

SEQ ID NO: 632584 - DNA, 116 bp, Homo sapiens
gtctgacacggagtcctggcttctttcctcgggggagcccattctcttcaattcctcctctgtgtgagtcatagctgcagccctctgggcattcacaaacagtttgtgaatgatcc

SEQ ID NO: 632585 - DNA, 633 bp, Homo sapiens
cggcagtcctccgcgtgggacccgggcgcggtggtcctttccctcgacggttctgccccggtccctagccattactcatctcgtgccctcaggtcgcatcagccatctactatttccccctacttaggacaggacagatgcgtgtgcgactggacagtagaggagcgcctcccaagtgggcatccaacggccaaccaccaaagcttcacaccgctgctcccgctcagagaggacggtatagatgcacgaggcccctgtgagaggctcattgacaagcctgcccctctgggtccccctgagcagagcctgcatgacccaattgcccacctttgcggctttgatgcctatgccatgtctagcctacatcctcaggcggctaccaccaggtatccatcgtgtgggaagaacggagtaacgagatctcacagcagaaaaaggtcttgagagcaacttgtggcgcaaccagtgtaactgtgacgaaatctcacaagcgaggaatgaaaggggacactgtgaatgtgcggcggagtgtccgggtgaaaaccacgaatccacctacatgcctggagatcacgccaccatcttacagaaaagctggatcacagcagatgcggcaaaaggtgacctctctaa

SEQ ID NO: 632586 - DNA, 1623 bp, Homo sapiens
  misc_feature (278)..(278): n is a, c, g, or t
  misc_feature (311)..(311): n is a, c, g, or t
  misc_feature (388)..(388): n is a, c, g, or t
  misc_feature (906)..(906): n is a, c, g, or t
gccgaggtgcaccgatctaggcagacgtgcgcggcatgtgttgcagtaggagggtgcctccgattcccctcggttgatgtgtgagtctcgtgagtggtgacctgtgcggacgccggtttcgaggaggacccaaggcccaccatggtgtcccctggctggtaactcgatggcacaaagcgatcagcccggcgttcgctaacggcgtgaggaagctgctgttccagcgacagcgcaatggatgttgagactgtaccatcgctgtcgctcaccagctgagnttccaagtcatccccgtggagcatatcgtgcancgtcctgcacggtggcatggtaactacggaaagagtatgagcgccttgtatcatgcttatgcatgacaatgtactgncccctatatgtgtaagcatgtgaactaagatgttcgagcctcggttgccacagcgcatttcgcggagaggaggcggtctcgcgaattagaaggggttcccttgcgacctcgaaatgcctgagatcgcgagggcctcctattcggaaggaattgtgtaccaacaaggaacgggtaaatataccattaggagtgccattggctggcacccccaaagttcttgacataattacgcgcgtgatgtcgcagcgtgtggatcgagagaaaagagagggatcaatccaaggggtgcgatggagatacccacgttgacgtgagagagatacagcttaggaaagagagctgcgtcgagatgtgtctatcgcaaaccccccaggacgtcggtgacccccgcgaaacggaaaaacaatgtccacgggccttggaagcttggccccaagactttactcctagttcgtaacaggcacgacatgcgtaggggttggccctttttgtgtgccaaaaactgaaaagataattcnctctcccggaagcccgaatcccgattgaatccctgaacccggtgtgccccgcaagagccttccttggctcggaatggagcagtttgttttcgccaagactggaaggtagttaagatatggcgacttcgggaaccatccccccatggtcagaggcatttaccccacggaaaaaggatcggcaatttctggtgaaaggggcgcccgaattccccaaaaggaatttaattcttaaaaggaccaccttacacaggcattacaggcccacagaagaaccttccttgtgaactttttctgcgtgtggacacagaacactgcggagtgtccccaacgccacaggtcatttaccctccaaacgtctgtcaagaagaacaacctttggacgccacacacgacttgggagctactttaggccaaagagggagagcctactcaaattgtggagacggaaagcagtctcaatccccggggaaacccttcacccaaatatcaccttggagacagttttccttggcacacaacgagttattattgagacacaccgaattgcacttcccccgcgggggcagtcactggtcacacaggattccacaaagaattcactgagtggacgagccaaacactcccatcatacataggttgtctcagacagccatccaaacattagtaagagccttctttgagtcacctttcaaaaacacagtcaacgaacagagtcta

SEQ ID NO: 632587 - DNA, 205 bp, Homo sapiens
tctagagatctcccacgctgctcacagaaacacctagaatatgttgaccttatattggaaaatcagagcaaaagttaaatctcaaaaaaaaaaaaaaaaaagttttgccccattagctaggcccttgtggcccggccagttggacacttaaaataacctgccacagtatcttctaaaaagtaaaaaaaccccttttatcttgaag

SEQ ID NO: 632588 - DNA, 799 bp, Homo sapiens
agcggaactactcccacaggggggcggggaaggaagatggcggcgcccagcgtcccgtgaggagagaggacacagggaatcccggggagcggccccagactcgtaaattatggccgcatctccgcacactctactcctcaacgccatcctgacagggttgcgtaggaggctctgtctggtatcttgaagagaagaagctatacaggactcccctcacaagttcttacatcttctcaggaatgtcaataagcagtggattacatttcaggcactttagcgttcctcaatacgcatgtatgtcacgacgagctgaacagaaggcacaacctagcaaagtaagacgccaagccagaacctagtagctatcatccatttcctggcatacaaaacgtcgtcaggtcaagccaaagcagaaatatatgagatgagacctctctcaccgcccagcctatctttgtccagaaagccaaactgaataaggaagttgatagaactagagccagactcggtaattgaagacgtcaatcagatgtagggacaagagacataaagaggaaacagcggtggcaaagagatgaacgctgcaagtgtatgatttgccaggaatttaggctcgactatccaaatatcaaactcacaggtctggtgtaagtaccactgcaggtggattagcattggctcgggcccttttggactggccctgttacctgcttacttactgtatgggacaggctgggatcctgtgctgcaactccatcaatcagtggtaagagatgccatttgacttcaaacatgaatg

SEQ ID NO: 632589 - DNA, 393 bp, Homo sapiens
gtggaaagccaccctcttttagcttactgctgtgtttttcagctttattcactttgctttttttctatattttcgtttcaactcaacttttaaaaaatcatacttgtatatttgtatatttatatttattttccaagacctcatttgcctctttttcataatgggctattattgctccatggtacagaatcttctgttctttcctaaactattagttatttttaaaatatttgttaactttctcccccttgctagttctcaggtacccgctttctcccagagtgctggctttccttaattatttgctgacttgtgctggtgtgtaacccttcatacttaggtatttctatttgtctgactgctgatttgattccaatccagtgtttcttctga

SEQ ID NO: 632590 - DNA, 129 bp, Homo sapiens
ccagcgtggctgcagacaggcccggcatgttacgagaccccttctcagtaaaatctttttctggtctctcttctacctccttctcgtgccgctccagctccttcatgcggatctcgcgagcctccgcgg

SEQ ID NO: 632591 - DNA, 730 bp, Homo sapiens
tactgtttagtgctcctcactttgcaatgttgtgctacgccagaatttctccagtttttttcattatcatccccctgagaaaaaaaattacattgaatttaaattttccctaataagagaaattaaatatgaaagaataggatttgttgggtaagattgagctttggaaggtcacgaaccattattctatctaaggtgtgtgtttgtttgttttttttggtttttttttggtttttttttggaatccctttccccttgaaccaatttcacttggggattgcggacctagatggtgattaaaaagctattcttctataatggtcaggttctctccaatttctcagcttcctcaaagactatggggttggagtggggtgtgccatcactggagagctcgggaactttggactcttagggacattttagattaggggttcatggcttccacttgttgcaccaatgtgatctctgccccttcatgctggatcaagaaagtagaaactcctcgtcgcttcaggtttgcagtcgcagaacatggcctggtgtggattgtcagacaaatggaactggtgtcattaagattgtagcaggccgctgatgtgcgatagattccaggaacatgtgtttgttgagattgaatttggccgaagaaaggtgaggttatcaattgtaccaggtgtcagtgggtccccggactggtgttggacggggttaaaaccaggaatttttg

SEQ ID NO: 632592 - DNA, 1754 bp, Homo sapiens
gggccgctgtagctcagtggtgtggggtgcgcaagggcacggacctcggagctctccgccggttgcggccgagtttctcatgctgccgttccgccagccacaataccaggggttctcgccagatgcggtcagcacatcagagatgcaggcccgacgctggtggccggtcagataaccagcgaccaggggccaggtatgagttgccacaaaggaaaggctgtcgttgcttgttggtgccccaagaaaccatgcacgtgagacacatataatagtagacccaggggtcccccgttgacagccatctgcaagtaagggcaatttcgacacgagcctgagccgactggattcgtgcagtgcttgcgaatcccggtgggacccgggacgccacaaacctaggcggtgaaacccggcgagcaacgcgcgagcaggtctgcctagagcaagagtaccccagggcaacacaaaggcccagacaataacaacacaccaagactagacggccaataggcgagcatcccgagcaaggggaagcgctgagaacacaagcggccacagcagagcgtaccaaaccgacactaaacataaatacaacggaggttggcgataggaacttatggagtaaggcgtacaagatagagcgtatagaccaccaagaaatcactattcaatccagagaaagactcgttcgaagaagcaaggaagaggctgggtagaacccctatgcggttacaggcgcagtacaccccagttgcgagttgaaccaagagacacgggagaccccagccgttactggagccaataccacaaagaggacaatatggcgaacacctaagtggatacgagggacacaaaatgaacaaaggagccaattcacatacgcaaacattagcgaaacatccacaacatggaagtaccaagggagatacccccaaatacgcacaaaccaagttgaaaccggctacattgcggaaaacaggaattgatcataaccacaagataatgaacgcaaagaaccagaaaaagcagacgagtacccatataggaggatagagaagtcaaaggaaaggaaccgcctacaagcgggaccatgggcacacgacagaaacaaaattacagcccgctatgcgaatgggcaagcaatcacaccgcgagagtataacaaatcagcaggagaacaagaaagatagacagaacaacatcaagaggacgcacacatggacaagtgacccaccagtacctaaagcatcagggaccagagcacaggggaacaggcgcacaaaaagacccgacacgcagaacacccggaaggaacgcgacaaagcaacatccaggacagtgggcaagaacaccatgtgaaaccagaaagtagggacaacaaacaaacgagagaaacagcagcccacgcagaagagcaatagacaagcacagacagaggcagacacatgtaacacacaagacaaaagcaagaaggagcaacgagagaaaacgaaacaacaagaagcaagaacaagaacaaaagaaaggagaaaccagacagaaaagagaagaataagaaagaaagacgagaaagacgaagaagagcatagcagcaaaagaagaaaacaacaagaagcacaaaagaaaagacgaacagaaccaaccgaaaaaaaagcaaaacgcaacaaaaaaggagcagaagaacaaaaaaacaagaaaggaagaaaagagcgcagaaagaagaaagaaaaagcaaaaaaaaaaaacagagagactgc

SEQ ID NO: 632593 - DNA, 481 bp, Homo sapiens
aagatgaagctttcattttcatatcagctgaagatgacggtaaatatattcgcacaccaataaaaaaacctctaagcgaatcagaaatctgcagccatcactggaacgttctgcctcctgggttcaagtgattcttctgcctcagcctcctgagtagctgggaccacaggcatgcaccaccacgcccagctaattttagtgtttttagtagaaacggggtttcaccatgccggccagtctagtctcgaactcctgacctcaggtgatctgccagcctcggtctcccaaagtgctgggattacaggcgtgagccactgaacccatccctacttatttctttcctataaaattaaaatggaaagatagttaagggtcagttagcgtttctcaaccttttctattatcacttacccttccccaaggaccgtttgtaggctattttttcatttttaagtggtgcctgcgggaattcggggatcct

SEQ ID NO: 632594 - DNA, 121 bp, Homo sapiens
agccccctgcgagaggagcatgtgacctgcgtacagagcatcttggacgaattccttcaaacgtatggcagcctcataccctcagcactgatgaggtagtagagaagctggaggacatttt

SEQ ID NO: 632595 - DNA, 287 bp, Homo sapiens
agggagccaagtagtctggcaacttcttgtggctcagtgcaatgtgaccacagaacttccactgtggatctgtgaccctgggcgctgaaaatgggaccaggaatccccccgtcaatatctaggtactcagataggtccccaaggtcattcatatctcggtatgagctcatatcttataataacacaaagtagccacagaccgtgtctggttagtatactagcacctggcaggggtcactccctgggcccgccctcctcgtactccacctccctccctattccctaag

SEQ ID NO: 632596 - DNA, 1227 bp, Homo sapiens
agcgggtgtaccccgcatcttattagcaaccagggcagatttctccattttcctcttgtctacagtgcggctacaaatctgggatttttttattacttctatataaatataacgaactacacttgggctcctttatatgtgctcgacatttaccacccttattatccctccctcctgtgctgctgcatatttcagatactacttacgactaaacaatttcttataatacccggagtagtatataaaataccagagttctagtaactcgtacctcctaacacaactcaacacaacaaaccccaccttaccacataccgacactgtagatgaagcacgaacagacaagacaagcaacgcccagcaaaacaagcaaaacaagaatgacacagaaacgacacaccaacaaaaaaatcaaaaaaccaaaaaaaccaccacaacataaacacacacgagaacaatagaaaacacacacacccaacatacgaaaccgaaaaacccacaaggaataacagaaagacgcaacaacatacaccgcacacagaacaccaagcaagacaaataagagaaatcaccaagccgtgcctacctcgaacgaagacccatacacgctagactacatcaacaaaagacatagcaatgaaaccagaaaatgtcgcaaaacagcacacaaacaagggtacgacacaaaaacacaatgtgtaacaataagaaggaaaggaaagaacgaaaagaagcaagaccccgatacatagaacactaacaaccagaagcggaccacgcacatcgcaccgtcggacagcaaaccaaaggcacgagaaccaagagcagatagaacaggataacggacagccaactgaaaacgtaaaaagcgaaaacaggcagagcaacgagtaggctgaagtatagtacacagcaaaggacaaggtcgaggaggcgagagaaagagaacagacgcaaacggactaagaacaaggccgaacggcgaataaagaccgaccagaaagcaagacaaagaggggggcaaacaaacacctcatatgtataaaaccacaaaataatattgaaaacttaaacacaatcaaaaactaaacaacaatatctcacacctactcagcaacccacgacacaaaagaacaataataactcatctacatacccataacaaataacacatacataaaccttaattttcaaatcaactacacagctactacactaaataaaaaa

SEQ ID NO: 632597 - DNA, 225 bp, Homo sapiens
gtctctggcatcttggacttctggcatacctggacttctggcatacctggaccttctggcatacctgtgacgcttctgtgcttacctggaccttctggcataccttgaccttctggcataccttgaccttcttggtagcgctcgggttaatatttaagttgtcgatagataatgtgtccctggtcttgtggcataatataactgaatttcatgagaaggtccagg

SEQ ID NO: 632598 - DNA, 185 bp, Homo sapiens
  misc_feature (9)..(9): n is a, c, g, or t
  misc_feature (19)..(19): n is a, c, g, or t
  misc_feature (38)..(38): n is a, c, g, or t
  misc_feature (46)..(46): n is a, c, g, or t
  misc_feature (63)..(63): n is a, c, g, or t
  misc_feature (90)..(90): n is a, c, g, or t
  misc_feature (99)..(99): n is a, c, g, or t
caaatgagncctgtatcantgtatcccctaatctggantagtgccntttggacagtagactgntctgtaattaaaatgtagtatactgcntttttgtanagttttgttttaataaaactttttttttttttttttttttttagtattgtacctattagagaataaaatgtataactgaaaaaaaa

SEQ ID NO: 632599 - DNA, 171 bp, Homo sapiens
acccactccaccttactaccagacaaccttagccaaaccatttacccagtagctgggactacaggtacacaccatcatgcctggataattttcatattaatttagtatttatgtagagccacatttcaccatgtgcccaggctaggagttccagaccacctgggcacgtgt

SEQ ID NO: 632600 - DNA, 702 bp, Homo sapiens
tcgatgccgcatacctcatttaggcaaggcctgggataccaagtggaggccggtcaccaagatggaccgcttgatcacggacatgacgatccagtccctggaggtcatctatctcttatccatgcccatgaacgaatcagagatcattgctttcattctgctggactctgtcaatgatgcggttttgacgattgtgccagtgcagaagccgacccagaccgcctcagtgacccggttccagtcatttcgatgcatcagctactacaatgatacacggctacctgcatgctaagtgctgcgaggatctggccatcggcatccgcaaggacatcaccatggccaagcgttagatcgatcacgtcgcgacatactgaggtaacaagatcgccaactctcacactagcccttgcaagacgacagtccactgagcttccatgctgctccgactcaaccatgcacccatggcaccgccaccgctttccgacattgcactaacatcttcacacacatgcttacaccgacgagtcgtcgacctatcacctcactccactgtcacccttggcaccttgtcaacgccaccttgctagccttgcccctacactattagacccctacaccctcaatgccactcgctctcacccacttgcctcctatcacgataacctgaccacccctttcgaccccacagtccttctcttcccg

SEQ ID NO: 632601 - DNA, 718 bp, Homo sapiens
atccctgagaatccaaaattctccgtgccacctatcacacccagaaaaaaaaaaaaaaaaaaaaaaaaaaaaaaattgggggcggacaggagccccaccggaaacaacctccaaacacacaatccgaagaggggcccgcgaggcccacgcagcgcacacgcgaaacacgggccaaaaaccggtacaccagagaaaaaaaacggactaagacaaagggagcggagaaactcctacaccaaaaaaatagagaagacagcccacgggcgggcaacacgcgagaggccaagcgaagacaaaacaaacacacagggagaagctatagagaggccacataacgcgggacaaacaaatacacaagccgaggacacccaaaagacgaacaacgaaaaaacaaaataaaagccaagaaagggagaaaaaaaaacaaaaaaaacgaaaagaaaaaaaaaaagaaaaaaaaaaaaaaaaaacaaaaaaaaaaaagaacaaacgacagagaagacagacagagaaagaaaagacaaaaggaagaaaagaaggagaagaaagacgggagagacaaagaaagcgggaaaaagaaaagagaggggggggggagagggggagggaagagagaagagagaacaggggagaagagggaagaataggaagagaaagacaggaggagagaggaggaggcgcgagaaaagggagaagggaaagaggcaaaggaaacgaa

SEQ ID NO: 632602 - DNA, 585 bp, Homo sapiens
gctatatctgaacttcagcctttctcaaaatcggggacggtcatcgtggagcggctggtggaagtgtacctgctgccggtggagggctggaagctgcgcttgacgggacatcgcgtctataagctggtggaggacacgaagcatcggcccaaagaaaacctggagctcatcctgacgcagtcggtggagagtacggcccgggctgaggggcttcctctcaggctggtccggtttggcatcagttttttctaagcctgtcccccctcaattattttgccttgttttttcttgtgtggaaacaaatccaaattctattatgtgagaaggagggaaaggcattaaaaattattggtgattggttgacactgggcctccaaggcatttgaaattttaaaactataatggcagcaacatcattaccggtgtgttggggagaggagcctgacatttggtgccacagatactgaaatcctccatgggacggacaactccctctatacaggggatattaacatttataccatcaagttctaaagaaactaattagcagtctctaaaatcttgtcctagggaaatgagttagca

SEQ ID NO: 632603 - DNA, 1578 bp, Homo sapiens
aagtgtgttcgacaaccgatagtcgtgccttgcagagctttcgtgtgtttccgcgaagagttgtccttctatcgcagctcgttctctgttgggtgttaaccctcgttgacaagcggggggggggccgctcccgagggcgctcactgttggttccccccgttggaagttggggaggacaccctgctggtttgttttttcccgcgctgggggtgttttttgccgaccagtgtgggaatacttcctggcggacgaccaagcggggtttctatcacgtggcccctgtgttggtgaccggggggcccacctgggaggttcacagtagtggctcccccgcgggaggtctctcctcgccgggaggtggcctgacagcccggcgcgcagagataattaataagagggaagatggtggggatgtgcccgccgcgtcgcccgcgcacgaagatgttgggggcgccacccgacgttgtgttgtccacaaggcgaaccgtgcgtggaaaagacatttccctaaggtgcccccccttgggagggggagaagaattctgtgagagtcggtgtcgtgtgttcgtgcccgcgattgccgcccccattttatagggggagattgcctcggggaggaattcctcagtgtgggagaggtgtcgcgtgtccccttcgggggggggcgccttcttgtcgttgcagacgagagattggagagcggtttgttgtggaaaacggattgttaatgtccccacggtggcctcagagaagactacggatacccccgctggtcgcgcggctcacgggcggtgcacaccacgaggtgttcaccaggcgcactttgtggtgtgtgctaatttcgcggtgagcctacaccaaatggggcccacccgctgcgcgcttctgtgtgttgtctttatagattggcctccccacaagggagaggttgtgggcgccctccgcgcacatcccttgggggcgccttctatatccctgggccacacagcgtgcttcgcactatctgttcccccccgttgcgcgcacagagaggctgtatcttgtggggggggacacacaacagaggtctcgcgcaacatagcgccgcacgcacacttgtcccccttggcacaaggtgtacacacaggcccgctgtccggcgtctcttgtgcgtgtgtatccgcgcctctagatccccgtgcgacacccacagggcgcacaccgggcacatctcgtcttctccgcacccctgtgtgcgcctatatgagaagctggctcacttgagatggctcggtatatcgagatgagctgtcgtaacacccctcacagcccgcgggctcgcacctggccacaccctgtggcacacacttctgccacacaggccacccctttgagatgccacattttctatagaacctatcacgctatcctgagacccccgagaccttctggaaaggagagctgtaattcaccccaagtttccctatcacggaggttcacctgagccacacctcgtcaaagagcccaccacccacagaggttctccgtgcacgcggactcaggctcccgctgtggctaccacatagggtttttatacca

SEQ ID NO: 632604 - DNA, 868 bp, Homo sapiens
tcgtaacaaagaaatttaaaggcttaaggcacagggaaaggcgggaatcattaagcatcctcaaacacaaggggcccagcgggctgagcaaaaaaacagagactactctccctcattaccatggggcgcccgggacagtccccgtgaggagtagggggcactccagctcttgggcacggggccggggggcaggaaggtgactagcatgatcccagcatacccctcgtgggggaatacggccaccaagaaggcagctcttgggctcgggataaagttcaggcaatggtgtccaggggctccaagctcgggaggaatgaggggggcacagtgcccatagggcggggcagtctctgaacagtctcctcagccctcagggcgcaacaggggggcttcttctggcgggcagtaaggtagaggtggctggtcatcacggtggaggcgggacaacatccccaagggtgtagagccccgcgatttctccagctcagccagcacatgggcctcaaaggtcagggctggccacagggaagaagaattctgggacattctcaccagtgagagatgagacgggccagtactcaagccttacatctcgggggccaccgggagggcggtcttcctccatcagcgcatactgagcaggctacggacagaaaacaagccggcaagggcacctcccgttcagggaatcgccagccaggttggtatgtccagaaaatgcccatcatcgggtggacacccaggagaggtggagccccaacagagctgcggaggttagaccctccggccaggtacccaagtgaacgaggaaggcaaccaaaggtcaccaaaaccccaaggggcggatccacaaggttgggaccaaaga

SEQ ID NO: 632605 - DNA, 1024 bp, Homo sapiens
ggtggctgtttgctgtgtgcggctaggccctgcgttgctgctggatgacctcctgctgcttggccccctgctgagcctcctgtccctgtgcccctgtgctgctgcgtgttctgcctgtggctggcatgccattggtgtgtgcccccgttgtctgcgggcttggtgtggctggctgtggccttgcttgctcgtgtgtcttggtgcgccttgctacttgctttttacattgtgcttaaatccacgggcgatgggctcagtcgacagcgcgatggtacagaacactgactgaatactcacgaggcctaaccggcttcttctgaaatgttcccctggcaaggtgttgccccttgtgacagtcaatttgtggatcgttcacgagccgggtcaatgtctcgttccccgtggaccgcctcctggccccagtagctctcccagagatacggtgcaagtgttaacccattgggcgaaaggctcatgccatcggtttgggctcccacaaggcagccctttcgtgcaacgcccgctgaaaccgaacctatcacgcctggaacgtgcggctctccattacttgcaccttgcactcttgtttcccatcaacacttgtccgtggcaacacatcataccttttcacagtcaacaaaaccctatccccttattataccccctgatcatggctgacaggctcccacacccgcgcgacctggacatcctgcgttgatatagcacgctccacgctttacgtgcgaccaccgcgcatgcgcgcttgctttgcaatcatccgaacacgtatgagcgagcgcgctcacagcctacacctgtgcccactgcgcccattcactctccagcggtactcaacagcggcaacactgccctaaatttcaactactccgtcgtgcaccctctggccgcgttgcgataattgccccacacgtttggcttggccgtaacatctaaagaacagctccccccccaaatttacgcacacccccaggacagtctcatttccaacacgtgcacgtaacaa

SEQ ID NO: 632606 - DNA, 238 bp, Homo sapiens
ccgatggcactggtaactcttggcagacatcaagtcccaactgaataggagttcccctgcacagacagagaaacatgctatcttcatctgaatagctgtcgccagccatgtactttgcccttccgttaataagcgttcgcgtcttggttcatcctctataacctcgattttcgtgcatcctatctttgataccactcctcgttaaacaactttcttgtttggaacaaacccttcggca

SEQ ID NO: 632607 - DNA, 317 bp, Homo sapiens
ccactccccgggtaccatgcatccccaaaaccaaggagccctgccaacccaaggtgcttgagccctgccagcggaaaacgaatgaccgctgctgcacgaagatgccaaagacctaggaactgatgggcagtgagccgtaccatttgacccagctacgctgcgagatggagcagaagacccaggagtaccagatcttgctgaatgtgacgactcggctgcagcagaatattgccacctaccgccgcctgctgaggggcgaggacgcccacctttcctccaagcatgcatctggccaatcctattctacccggggaggg

SEQ ID NO: 632608 - DNA, 212 bp, Homo sapiens
  misc_feature (41)..(41): n is a, c, g, or t
  misc_feature (169)..(169): n is a, c, g, or t
  misc_feature (174)..(174): n is a, c, g, or t
  misc_feature (185)..(185): n is a, c, g, or t
gggtcattacacattgtggccaggcatagatggcccacggntgagatttttgtttggctgttttgtgaggtctgcacagtgttttaaaaggcaggttggggttcctgtcatggctcagcggttaatgaatctgactagcatccatgaggatgcaggttcaatccctggnctcgntcagtgggttnagaatccggcattgctgtgagctgtgg

SEQ ID NO: 632609 - DNA, 401 bp, Homo sapiens
  misc_feature (16)..(16): n is a, c, g, or t
  misc_feature (24)..(24): n is a, c, g, or t
  misc_feature (59)..(59): n is a, c, g, or t
  misc_feature (82)..(82): n is a, c, g, or t
  misc_feature (132)..(132): n is a, c, g, or t
  misc_feature (226)..(226): n is a, c, g, or t
  misc_feature (373)..(373): n is a, c, g, or t
  misc_feature (382)..(382): n is a, c, g, or t
  misc_feature (388)..(388): n is a, c, g, or t
aagtttagcaaaactntgactcanagacccaaatcccaaccatccggtttttatatggncccatgaccccaaaaaaatagtnccttacatttttaaatggttaaaaaaaaaattcaggccccggttcggtgnctcatgccctgtaatccccagcactttgggaggccaaggcaggtggatcacgaggtaaagagatgcagaccatccctggctaacacggtaaaanactgtctctactaaaaatacaaaaaattagccgggtgtggtggcacgtgcctgcagtaccagatacatgggacgccgaggcaggagaatcgtttgacccagggaggcggaggttgccgtgagccgagattgcgccactgcactccancctggcaanaaaagncggctccgtctca

SEQ ID NO: 632610 - DNA, 122 bp, Homo sapiens
gcgcgcatgctgtgtccagcagctggtgggtgcgggttgtgcttgctcctgccatcaggcgcacggtggcttcatgcagtgaacaccttgcgtgtatgctggtgctggaagctgtgtgctgt

SEQ ID NO: 632611 - DNA, 1221 bp, Homo sapiens
tcccctaataatcggtgcccccgatatggctgtttcccacgcataaacaacataagcttctgacatcttaccccaccatctcatccatacatcctgctcgcatcatgcgtatagtggaaggcctggagcaggaaacaggttgaacagtctaccctcccattagaagaggaactactcaccacacctggagcctccgtagacctaaccatcttctccttacacctagcaggtgtctcttctatcttaggggccatcaatttcatcacaacaattatcaatataaaaccccctgccataacccaataccaaatgcccctcattcgtctgatcctgtcctaatcacacagcagtcctacttctcctatctctcccagtccatagcatgctggcatcactatactactaacagcaactcaaactcaaaaccaccattcttcgaacccgccggcagaggagacccaattctataccaacagcctattctgacttaacggtcaccctgaaggttatatacttatcctaccaggacttcggacataatcgtcccaatatcgtcaacttactaactccggacgacaaacgaccccctaggcctaccatacggtatcggtctgaggttcatgatcatccactttgtatttccttagggattcatcagcgtgagcacaaccatatcgtttacagtacggccgtagacggtagcactacaatgaggcaatcattgcacgatcgatatccaataatccttggcgtatcaccaacaggcgagtacaaggtaatatagatgtagcgggtcacaatcaaggaagacaaacttacaaggtaatgtatgcagtggctctgagcccagagaccacatgcctatccccggaagaatcacctgacagtagaatgacctatggaccacacccactcattcggcgtctccctacatcgcaagataatacaaattacaacctaataccacaatttccataaaaacacagactcgtattacccaacacaaagagacaaacatcattcacaattacacggcgacacactaaaaagctcacaaaccttcactactcctctcgcccatcactaccacacgcatactatcacagccattcaatcaaacatacaacctctacatcagtctctcacatcagcatttccttctgcccttctgtctcccttcccccccctcccatcgccgctgctcctatccacaagaccaca

SEQ ID NO: 632612 - DNA, 230 bp, Homo sapiens
gtgcaggacaccatgcagattggcctgtactcggcgatcccatacgtggccgcggcggtcttcatgctggggttctgcgcgcagctccgaccgcctgcgcgagcgccgctggcacacgctggtgccggcgctgctggccggcgtggcgctgtgcattgccaccgcggcgccgacgcaattcgcgctatccctgacggccatcacgctcgccacgggcttcatgtgggccg

SEQ ID NO: 632613 - DNA, 1189 bp, Homo sapiens
  misc_feature (498)..(498): n is a, c, g, or t
ggtgaggaccgagccggcggccgaggcagaggcggtactcgtgcccgtccgagtcgccctcgccggccggtcgccgtagtgagctgcccggtggttcggctatgctgaggcctcccttgtcccggctactagggcgaggccccagtgagtagctaggctcagggactgatgcgctccgacatgctcgggcccaggcggtgtcggaggacgcgggaggaaacgagggcagagctggccgaggtccgaaccccgggcgctggagaatggcgatcgcggtacgatgtcctccttcagtcgaccccgaggacttcgttggtacgacgatgagcgaggaagaattactgggaagaatgtactcataagatcggccccaggaagcagatggaatcgattcggtgattgtagtggacaatgtccctcaggtgggacccgaccgacttgagtaaactcgaaaatagtgtcatccacaagatcttttccaagtttgggaaaatcacnaatgatttttatcctgaagaggatgggaagacaaaagggtatattttcctggagtacgcgtccctgcccacgctgtggatgctgtgaagaacgccgacggctacaagcttgacaagcagcacacattccgggtcaacctctttacggattttgacaaagtatatgaccgatccagtgacgagttgggatattccagagaaaacagcgtttcaaagacctggggaaacttacgttactgggttgaaaaagggcgaatgcggagatcagtacaggggtgacttttgaggaagtggggaaccggcttcactctttctggcgactgtagcgttacacagaaccccgtttttcactcgtgcgcacagcacgagcatttgtaacagaagcctcgtagttgtcggtgaggttgtcccctaaaggggggaccaacccacggcggtcccctttctctccgaagggtgagcctctctgctgagagcggagacgaaaaccaaatgcaacatactcatgaccacgatgcgatcacaacgagggcaacacatagtcagcatcccccccctgacagcagccggatccacgtatgctccatcctgccagatcacgacgcctagcctcaccatacccgcaccccaactgcgcgaagcacaccagcacatacggcatcgccaccatgcgacactcagctcaaccacct

SEQ ID NO: 632614 - DNA, 317 bp, Homo sapiens
tccctcctctttccccacactagttttatttttgtgagaaggagttttgctctgtcgccaggctggagtacagtgacacgatcacgagtcactgaagtctcaactgcctgggctcaagtgaacctcccgcctcaacctcccgagtagctgagactgcaggtgggtgccgccacgcccagctgatttttaaagattttgtaaagatgttgtcttgctgcgttgcccacgctggtcttgaattcctggactcaagccattctcccgcctcaagtgtcccaatgtgctgaaattacaggcatcggctcccgaaagaggag

SEQ ID NO: 632615 - DNA, 653 bp, Homo sapiens
ccatggcaattcgtggcctaagccataaaaccgccataagtttctaagttttgggataaagaaaagtctcccttctaccagtaaccaatagcggtgggctttttttctgtcggccagtttcaaggtgaccatccacaaccacacctgttctttacagggttaaagaagccgctgctttgcagaatatgaatggtctccactatttagtccttctttttctcttccaccaatgtctgttggaaaactgcacgattggaaagccaccactgatggaattcgtttataagctgagggtggatagagccacttagctgtgccacctcatcaagggtagaagtaataaagatccctcgcactgtttctaaggcagcgtagtggaaaagtgtgttctcaggaccagatgtcagtttctctgtgttatatatttctaattctttttctggaaggtcctttttcaagtttcccaaatgaaatgtatttgcaagagtaactttctttttagtgtccttaagcaaggtccccctttctggataaccatcagagccatgagattctctttgcttccgtactgcatccggtgtagtatgggggctaaagctataatattctccactttcccaacctttgccagatccaaaaaaaaaacggtaggg

SEQ ID NO: 632616 - DNA, 552 bp, Homo sapiens
  misc_feature (9)..(9): n is a, c, g, or t
cgcggcccnccgacacggcttgcgagaagcccgacagaaaggggacttccccctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 632617 - DNA, 1064 bp, Homo sapiens
gttgatagcggagtgtagtcgatgaagtgaggcagatggaagagtagagacggtgtccgtagagtcgagtgagtgaagtgtgtcgtggcgaagattgataaagcgtgagcagagagcaaagggtgagagcgtgagtagagggatcagtagagtagagcttgctacgtgtgatgatgctatgataatggcagacacgtggacatgatagtgacagacgtgtatagagaacggagacgtgatcgatgtagccaatatatagatacgctagagaagatgcggcgataagtgtggtagagaaggatcatgtacgaacatgagaacgagtgtaggtgatcgtgaatagagcgaacgttgagcttagaccgctatacaatgagagtgggagagtaggcggatgcgaagaggttgtagctgcatactgagaggttatggtgctagagagacgcggattggtatcagatagacgcgtgttgcagacgatggaattagaatgatgaggtgggcagcgagacgaaggaacacgtgcgagtaaagggatgaaatagggaagcgagaagtgcaccggctaatgagagaataaagggtacagttatgagacagtcaaagatggctagtagataggatgagttcgagaaagggaagacagatggtagatcgtgtaaggataggtggtaagatgtgaggagtgaggagtaagaagagaagggggtgtgagattatttgtcgaaatgacatagagagttgaggcagacaaggaaaaaggtagggcgataaactggaagcagataaggagaggggagtaaaaaagtaaaggaatgtgcgaggtctaggatcttaggaattagtaatgtcggacgcgaggtctaacagcgatcacgatacggatccgccatgataaaagcagcccaggccccaacagcgcgctgctgtctggccggatgacagcaatcgtagcggctcgggccagacagcaccggtcctccaaggctgtccctggcccggctggcatggaaatcagtggagaaccaaatgattaatttaataaaaggccttggctttcggag

SEQ ID NO: 632618 - DNA, 897 bp, Homo sapiens
  misc_feature (9)..(9): n is a, c, g, or t
cgcggcccnccgacacggcttgcgagaagcccgacagaaaggggacttccccctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgacacaaaacacaccaaacataaacacaccttttgggccgccttgggctctggaaaaacttttcacaaccttcttttgggcccgcggcccccacgagggtaacgtaaacctggcgccaaagcggtgctccccgaaggaagaaaaccaggagcacacagacaacaagggggactaggatctgccccgcacagtttaaaaaaacggccccgggggcgacacacagaagcgtttttaggacaagtgctcccgcaagtgggaggccctcaggggagcacatcacgggacgatcaaactaacacaagcgggcctccgaaacgagaggccgagatattacaagttttcgcg

SEQ ID NO: 632619 - DNA, 976 bp, Homo sapiens
gtgagtggcaacatggcgaggttgctgccgaaatcctgcggaccgatgttctccgataatagacgtggacaagtctccgactacgtgaccggcgctcttgcccagggcgcagtcgcaggacttcgagtctgtgtattgacctggtggaaagctgtaggagtgaacctatatgcacagaggtgtccggcggacatgcaaggcatgacgcaggtgcaatcacgggaccagtgatgcccagtcgacactgtcaccaacagcaactggcgtctggccattgaggccgaacaataggctcgatggtggaaatcagacgaggttgactcactggtcaccagcgccctagtccaagattgtctaagagaatagatcggcagtagactgagagacactgctgggaaacccaataagtctagcacgggacgtggctaaacagtagcgcgcatccatagttcctcgaacccatgtgcagagtggcaagagcacccggttcctccagtacagagccggcagcgcatccgaacttctcacaggggcaagagccagctgcacgcagatccgcctcaagaaacacaggcaccacgacgtccaatgtaacctaggccacagccatcataagcatgctctaagacacgacggtgcagtgcagaacaagcctcagggcagggccacggcgcggaaaaagggcgaacactcggggcgggacactcagatcctggggcaaggaacacataactccctagtgatggtcgcctgagagttggagcgaaccattctgactggtcggtgaatcacagggacgaatagaaccataggtgccgtgagcctgcggcgccggcaattgtgtaccccgtggcgcatcgggatcccgcataattaccccgggcctgaggcgcagcgccgggaacactggggtggggaggataaccccagaacagcgccacgaggacaggaatcgacgacaacccctcaacgtacc

SEQ ID NO: 632620 - DNA, 658 bp, Homo sapiens
  misc_feature (9)..(9): n is a, c, g, or t
cgcggcccnccgacacggcttgcgagaagcccgacagaaaggggacttccccctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttttgtgaaaaacacaaccccccttgtcagtcgtcattatcccaaaatcctctgatcttcgcttaaaacgtcgaaataaattacattgaatattccttaattacattca

SEQ ID NO: 632621 - DNA, 530 bp, Homo sapiens
  misc_feature (9)..(9): n is a, c, g, or t
cgcggcccnccgacacggcttgcgagaagcccgacagaaaggggacttccccctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 632622 - DNA, 475 bp, Homo sapiens
gattctgactgttagtttggtagtaggtgagatgttaatggtaacatgattgtatttgtttatatctttctattctcatatttctaatatgtatttaggttgtcttgtttatgttgtgcacgtttgggctgaaggtgctgttggcccggagagctgtccaggtgtttgggggaaagggcaggatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagtttt

SEQ ID NO: 632623 - DNA, 266 bp, Homo sapiens
cctcgagttcttggggcgcagagaacttaggagagaagcacggaggagcccccggcagagcacccgcccccgggcctcagccttcctcctgtgctagcagcctggggcctccactctggccggaggaaggaccgcaggcagacagcttgggcctttaacagcttttgtccgaagataaaattagtgtcctttcaattggtaaatattttatataaaataaataatatttatttatttaaatataaaattaataaaaataaaaaaaa

SEQ ID NO: 632624 - DNA, 238 bp, Homo sapiens
ggtatccccagccattgggagggcaaaaaggggaggagggttgggccccaggagtccagggttgcggtgacccaggttggccccagtgccccccagctgggacaaaaaagtgaacttctgtctcaaaaccaaccaacaccaaaaaacacttgagaaaggagagggaaattaaggggccaccagtggtagagagaaaattccctctctctctttctttatctcttcccagtttggcccg

SEQ ID NO: 632625 - DNA, 253 bp, Homo sapiens
gtggtaattttctgtgagtcacttattatgtcaaaataaaaagttaaactccacatattcaggaggcatacatactttcttctataggaaatgaccttgtttcttttagccctacttgaggcaggggaccaggaatgagggggaagggacaggatatatacacacacacacataaaattttaaagcatggcccacaacagtaattttttttattgggtttgtgtatatatcctgtcccttctgtcgtcttctc

SEQ ID NO: 632626 - DNA, 447 bp, Homo sapiens
  misc_feature (214)..(215): n is a, c, g, or t
cggcacgaggaaataatcccaaagagagaatctcctaataaaaactactgtttgggggaaaaaaagattactgaattataaacatttgaaatattaccttgagaactcagcattcactgaacagatgtattgagcagctgctgtgtgtgctggatattggggagatacatctaacagatgaaaggagacagagtaaatggtagattacagaatnntaaggactacagttgatataagtatagggatatatgggaacatagtcttggtcaagaaatagcttttaaaaattctgtgtgtaggtttaaagcagtatttttggatggagtaggattgtggaataaaaaaagtaagaaagtgccatcatatttgtgtgctatttgcaaacccatgttatttttttgttaccaccaggcaatttccccagccagaccctggtaccccatggct

SEQ ID NO: 632627 - DNA, 921 bp, Homo sapiens
accgcgattgcggggctctagtgctgcccccgtgtgacccccccccgttggtgtcagcacaagggtgtgtggcccaggtgtatccgcggcccggcttttccacgcggtgatctctccccggccaacagggggctttctcgggagagccccagcgtggctcaacgctctggatcctgtgggagccacctctttgtccgccatggccctggcttttgggagccctcttatacttggtccccccctggaacttctccacacaatgggacacatcagcggtcatgcccgttctttcggcagaagatagacccgccctgtcgggccgcacccctggtatctcaaagatcccccacggggagttttcctcccccccccatgaacccccttggctgcaaattccacatcaatcggaaagtactacaactcttttattgctcaggacccccattcgtcgaatacctgcttattagagaaaaggctccaaacccccccatttgaaaatacacaagaacttgcggagttctctacaaattgtcgagaagtcaattctaatacaataacgtagtctcactcacccccgcaagaaaagtttctaccttatcgattgacagtcaccgcccgtcacatacaaatatggacgacaaaaaagtaccaagagacttagttcaaaatcatgtccaatgcgacccccctgttcctcccatatatgaaaagacaccacccgggccacaaaacatgaatcttctgcaaacatccctaccaccgagaatactctagaaatcttggaaaatcataaatggaaaaggaaaatcactcttccgctctcccaacccaaataagagtattgttccctttaccacccgccccaaccccgggtagacaccccacctaaataaaaacaaacaaatagggcaaacaataaca

SEQ ID NO: 632628 - DNA, 192 bp, Homo sapiens
  misc_feature (21)..(21): n is a, c, g, or t
cgatctagaggatcccatgcnaataacctcctagtgattactcctcaaaagagcagccaaggtagtaatctttttttaagaactttttattttgagataattatagattcacaggaagttgcaaagacagtgcagagaggtcccgtgtacccttcgcccagtttccgccaatggttaggaggtaattggcat

SEQ ID NO: 632629 - DNA, 82 bp, Homo sapiens
  misc_feature (3)..(3): n is a, c, g, or t
acntctgtgtacttctgtgccagcagtggacaggatgaacactgaagctttctttggacaaggcaccagactcacagttgta

SEQ ID NO: 632630 - DNA, 339 bp, Homo sapiens
  misc_feature (48)..(48): n is a, c, g, or t
  misc_feature (299)..(299): n is a, c, g, or t
  misc_feature (308)..(308): n is a, c, g, or t
ggccccaacaagtgaaaaaccattcaccaatacaatttctaaatcaancttgtaactactcaaaagaatctgtgtttagacagtttagaacatctcctgcctctcacagttgggaggctctgaacaatcccatgtggccggaaaaacctattcaggcaggctagaggatttccaaaggagtttgtaggttaaacactgtcacacccaggaattattaactggaactgtaagctaactcttttttcagagagaggtagtgggggagagccccccgtaaagtcagaggtttaggtgaaagnacaagcagnaagtaggcagactctggttttgggggtatat

SEQ ID NO: 632631 - DNA, 342 bp, Homo sapiens
  misc_feature (340)..(340): n is a, c, g, or t
cggcacgaggcttgcatgaaaaaggataaaaccaattgatatggtttagttcttagtcccctcccaaatctcatgtccagttatgatcctcagtgtaggaggagggacctcgtgggaggtgattggatcgtgggggcagtttctaatgttttagcaccatcctcctagtgctgcttgtttaaaagtgtgtagcaccccaccttcctctcctgccggccatgtgaagacgtgcttgcttccctttcaccatctgccatgattgtaagtttcctgaggtctccccagaagcagaagcctgtatagcccacagaatcatgagctgattaacctcttttctttnta

SEQ ID NO: 632632 - DNA, 163 bp, Homo sapiens
gacggcagctgggactcctgttcacctggtatgactctctcaccggggttccggtcagccagcagaagctgctgctggagaagtgccagtgtcctgttcaacactgggtccctctacacccagattgggatccggtgcgatcggcagacgcaggctgggcttg

SEQ ID NO: 632633 - DNA, 89 bp, Homo sapiens
aagacagcagcatatatctctgcagcgcggtatccgggacagtgaacactgaagctttctttggacaaggcaccagactcacagttgta

SEQ ID NO: 632634 - DNA, 87 bp, Homo sapiens
agtgactctggcttctatctctgtgcctcggaggccggcgggaacactgaagctttctttggacaaggcaccagactcacagttgta

SEQ ID NO: 632635 - DNA, 84 bp, Homo sapiens
tctgtatatttctgcgccagagttacgacagggggctcgaacactgaagctttctttggacaaggcaccagactcacagttgta

SEQ ID NO: 632636 - DNA, 123 bp, Homo sapiens
ccactgtcaggcatactgtgctccagcctgggggacagagcgagactccatctcaaaaaaaaagaatcggacgaagaaccacaggatgttgaagacaacggtctgaagtattggtgacgggac

SEQ ID NO: 632637 - DNA, 377 bp, Homo sapiens
gtacggcagcagggtcacggccgggcggaggtactcctacacatccagacggggcggcgggacagaggcctccccacatctcagaacgatgggcggccgggcagagacgctcgtcacttcctagatgggatggcggcaaggcagagacgctcctcactttccagactgtgcagccaggcagaggggctcctcacatcccagacgatgggcggccaggcagagacgctcctcacttcccagacggggtggcggctgggcagaggctgcaatctcggcactttgggaggccaaggcaggcggctggaaggtggagggttgtagccagccgagatcacgccactgcactccagcctggggcaccattgagcaactgagtg

SEQ ID NO: 632638 - DNA, 84 bp, Homo sapiens
gacagcagcttctacatctgcagtgtcccacggggcatgaacactgaagctttctttggacaaggcaccagactcacagttgta

SEQ ID NO: 632639 - DNA, 1498 bp, Homo sapiens
ggctgcgaggacctggtgcggctgttggcagaagctggcctgagctggagtgtgcctgccagtgagtgagctgctgcgtggagaacctatgctgcttaatgtgatgctctgccttggctgctgtgtgcgaagaatggtgtgccccctgctggctgtgccccatgctgtgctgcctggggtgatcagtgagcctggtgccagcaccctgagcttgccttgccccctggtgctgggccccgctgacctagtgcagatgtgaatgctccagcactggcatgcgttggtgcatgtcctggatcagttgccccttgtgcctgttccccctgatgatttgaatgtgcactgcttccctcacacgcctgactgccctgccctgtgactttgctccccgatgcccctggtgacctgctgtgtgacctcgtgggaccgtggactgcctgtccttggctgctggcacgtgagggtgtgcctgcttggcacttggactaacggacaatccttgagcaccaatgacagtgccccttcgctactttgcttgggcatgtggcaggcatgtgggggactttgacatgtgctaggatggctgtgacggtgactatgactcgggggcgttctggactctgggagggctacactaaaagccccgcagagacccggggacacggcctgcgcacacacgacaacacccacgcacacgcgaagcgcgccagccaaacaccctcgccagcaaaacgaacacaagaagacacacccgaccacgaacgagcaaccacaacaacgaaccgacgaaccagacacactacacaccacccccacacacacaccatccatcacgccgacaccggcgcgaaggccgcacgcacgagcaaggcagccgagacgagacaacacgaagaagagaaaaaagaaacggaacgacagcgagccagtgagcgagcggaggacggcgccacgcaggaggagacgcaagcacgacagcatacacgacagcaaacgacggcggcagcaaacacggggagagcgcagcaacgaatacagccggcgagcagcgagcaaccagagagaaagggggagaaacccacccgaccaccaaccccagcgagcaccactgaagcggaagcaacgcagacgcagaaaaccccacccgagacttgacgagaaggacgacaccgacgagatcggctctcccaccagcacgcgcagagaccgcagcgctcgagagagccaaagacacggagcaacatcgactccgaccccacacacctgacaccgaaccaacatcaccataaggacgaagcgaacaatcgacgaaccccagcaagcacaacgtgcgagacgacgacgcaacacacgccgcccaccagaccgaagacgacacgacgccatgacagcaaagcacccacccacaccccacactcactgaccgcaacgagaccggacgacagcgcgctcggcagaccacaacacggagaggacggcgccaagaggacagatgatc

SEQ ID NO: 632640 - DNA, 778 bp, Homo sapiens
ggccagatacttctgagtcttaaaagcataataggccgggcgcggtggctcacgcctgtaatcccagcacttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacagagtaagactccgtctcaaaaaaaaaaaaaaggcataataatttattacattcccaaattttttaaaatttggagttgccttggcagtggggagggtccctaaaattggggtatagaatttagggcccagaactggtgtgtaagggtcctgaatcgtggctaaaatacaggggtgttgtctcgggaattatgaggcataaagtagccagtatctatagttagaatctacagggcctcctttgtggccgtgtagactagaatatacgctggtgatgggcgctggaagtgtatctctcacggttaaagggtgcgtgttgcaaggcccaatttcagactagggtggaaccatctctgtgttcaattttgggggctgccactgtaaatatccctacatcagtcccagcaaattagggagcctacgggacgggattgcttacaagaaagagggccagcggcaaggggcatttcacacaatcttcggcc

SEQ ID NO: 632641 - DNA, 136 bp, Homo sapiens
caaacagaaactaactgcgtctagtaaggcaatagcaaatataggtaacatcgccatcaagataaaggttagtaatactcagatatatgctaagagtatcataagcaagactatagacgactccctaactacccta

SEQ ID NO: 632642 - DNA, 176 bp, Homo sapiens
tcgaatcgacggtttctcgaagctgggccatcaccaacaagacagtgatggtgaaagcaatgatagaagaggtcgaatttagagtaaggatcaggatggaccaggtgggtacattctaacgccaaccttaaactttttagaaaactactaagggcatagattattcctggaaagac

SEQ ID NO: 632643 - DNA, 265 bp, Homo sapiens
ctgtgggcaatggtgtggctgctccctgcctcctggtgtggctggccgtggtagctgagtcctcagcgggtggtctggtggacctgctcgcgggagtgagatgaccttgacatacctggacctctaccacaatggtacgcacctgacgggtggtcacgcggttcttacttgtactgactgtcaggtgggcaatcctctccctccagtaggtggcggaaggtggcaacatctcactgctccagcctgcgtctaccacatccagcag

SEQ ID NO: 632644 - DNA, 386 bp, Homo sapiens
  misc_feature (364)..(364): n is a, c, g, or t
  misc_feature (370)..(370): n is a, c, g, or t
agctgttcctagagtatccctgcctactggcgtatggaatggcatctcacctccaggtgagcatcgacagcctggagcagcacccacacccccaggtgagcattgacagcctggaacggcaaccacacccccaggcgagcatccgacagcctggaacagcaccaataaccccaggtgagcatctgacggcctggaacatgcacccacacccccaggtgagcatctgacatcgtgcagcagcaccccaaacccacaggtgagcatctgacagcctggagcagcacccacaccccaggtgagcatctgacagcctggaacagcaccctgcacgcccaggtgagcatccgacagcctggagcaccanccaaanccccagacgagcatct

SEQ ID NO: 632645 - DNA, 475 bp, Homo sapiens
accatgttgcccaggctggtcttgagctcctgagctcaaagtatttgcttgcctcagcctcccaaagtgctggggttacaggcgtgagccaccgtgccaggcctttaattcttaattgccgccaggattgattggtaaggctgtagaagagttgctgtccattccaagtcttcccatctgaagcaaccaccatgccacagccttattctgtcccatggctgttttgtgcatctccaagtgtaccagtatgaggccctcaaacacacccatgccctctgatgaaataatgttggtcatgataaccacagggatgtcacagccgccgttccacactctaactaattcttattttgttccaacaacaacaatttgaaatgggaagaaccaccccattttagacatttcaaaacgagggcttggatagattatgtaccttgtccaaggtcacacaaccaaatggcaaggcacggactca

SEQ ID NO: 632646 - DNA, 419 bp, Homo sapiens
gtcaatacagtgggacagactatagagcaaaagcagggaataagaaaaaagcaacataaacaaaatgagacaaagggattatcaagcatcagcaaaaggtgaggctgagatacgaggcatgaacaaagacgccagggtaaaaaagcattgaaagaaaagacagggttatgccatgttggtcagagtggtcttaaactagagacagcaagggaaatgactgcataagcctagcaaagtgctggaattacaagcataagacactaagcccaatcacagtgtgtcattgtatctaaagtgagtctctctgagtctctctcactctctctctctctctctctctctctctctctctctctctctctctctctctctctctctctctctctcctcgtgccgaatcctgcagcccgggggatcca

SEQ ID NO: 632647 - DNA, 747 bp, Homo sapiens
tacccttgtggcgcccctgagggccccacccccccagccacagggttgggcccccacccacggggaggtccacgccccacaactttttgttcctctgtggcacaccttggagggaatatcttgcgtttccacaagatgaaactccgcatctttaaagatgttatttgcgccccccctcctcctcatataattgtgggaaaaatatatctggtgttggccccccacgcgctgtgtttctctctcttgtaggaagagtgatatattccacacagacacactggtcgccccccacatcctgggggatttgtgtgaccccgtgagctataggggctatatattaacacaccttttctccccccccacaacgcgaaaacttgttgggagatttttttaaaaaggagaaagggggagagaggggaaaccaccgagagaacacctctgtggttctaaccccatggggtgtggccaacttttcccacacgtctcgcttttactctgatgggtctggccgctgtggggccacgcggcctctcccccgcggcgtcctcgggatttcccctgtgatcccggcttggctggggcacctccccctaatcaactctgcgtgttggttaagcaccccggcccgaattgattggccccggaagtggagttttttttttataaagggggggggacattttccaaaaaggatttcccccaatccccctcccctttataaatccaaaaaaattttgggaacaggga

SEQ ID NO: 632648 - DNA, 216 bp, Homo sapiens
ctctccgaaaaggctccgatcccccttccccagtgtctcacgccatagccatggcatgctgcctccacccagggctctgccagcttccctccttcccctagacagctgcctagagacccttcaggaagcacgagatctgctcgtggtactgccctgtttcaccgtctaggccatgttaaggcaggttccaggtctccatagggaaggcagagaggg

SEQ ID NO: 632649 - DNA, 225 bp, Homo sapiens
ctgctggggtgactctagagaatccccaagcaggtaatacagacaccaagcgttataaagcattcctatctctccacatcctctccagcatctgttgtttcctgactttttaatgattgccattctcactggtgtgagatggtatctcattgtggtttagatttgtatttctctgatggccagtgatgatgaggcattttttcatgagtctgtattaactgcttg

SEQ ID NO: 632650 - DNA, 256 bp, Homo sapiens
tggggggggggggggggggaaggaaaaatttttttttggaaaaagggggtttggggcaataaaaacctttttgccgggggtaggccctttccctttttggtttttttttggccccccagggggcccttaaccttccctttaccctttttttttttccaatttttttttttcgggctttcctagaaatcggggggccctttatcccagcccgggtttttccccttttggggggcccctcccgggggggcccccccta

SEQ ID NO: 632651 - DNA, 347 bp, Homo sapiens
tgcacgagacctcagagtaaacacattttctgttgtatttttgctcccggacttatctccctgatgaccccagcatgatggccctgatagaggagggcgaaaggctcttccccaaacattggtcttttgttaatgactttcatcctggtcacgtggactgaagcagcagtcctccagacatttctctggtcctttgaaaacaagcaagagcctgggaagggaggagcacacacacccagccccagcccctggctccggtttaacggaggaagagaggaatggatgtgtgtggggtgccctttctcttctgttcttccttttcttcttctctttttattttttttttt

SEQ ID NO: 632652 - DNA, 172 bp, Homo sapiens
tcttttccctacaaacatgcagaaagtcatacttaaacggggcaaatactactatgtctttgatattttttatgtgtacgtattgtatagtgacgcgatagaagttacctattattttttacctataacttagactagtgcttcatatttacataaacggataaatattgat

SEQ ID NO: 632653 - DNA, 227 bp, Homo sapiens
  misc_feature (108)..(108): n is a, c, g, or t
ataggatctttatagaacagatgctcagcttgttgactccataagcaatcatccttggcccaaggtgtggtcacgaaggttgctggtgtgaatgtatatgggcacaanccccatggaaagtaattaagccacgtatttcaaaagttagaaatgcatttaccccttacccagcaattacgtgtgttaaataaaatatgcccgaggttggtcaatgcagccttgtttaa

SEQ ID NO: 632654 - DNA, 218 bp, Homo sapiens
ttggaggtgagcgggagttgtgtcccaatccaagggccattgacttaaactgtagtcatgggtagaggttatggggcaccacccgagctaatataattaggggcagtaacatatgtcttctttcctccagtcccaaggcaactctccttgggggctggcgtgcagggcatagggtccccagcttaatggggcagcagcatatctatctaggtggctta

SEQ ID NO: 632655 - DNA, 498 bp, Homo sapiens
ccagcagcagcatgacttcacactgacacagactgcagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtgcggccggccggacggacctactacgactgcgcagacggtttatgagggaccaggagaagctcagtttgatgtatgccagaaaaggcgttgctgagcaaaaacgagagaaggaaatcaagagtgagttaaaaatgaagcaggatgcccaggtcgttctgtacagaagctaccggcacggagaccttcctgacattcagatcaagcacagcagcctcatcaccccgttacaggccgtggcccagagggacccaataat

SEQ ID NO: 632656 - DNA, 393 bp, Homo sapiens
  misc_feature (386)..(386): n is a, c, g, or t
gttattactagacagaggacaaaaaaattctgataaaagttttaattcactagaaatatataacttgcttgcatttaataagtctcaaaataatgaaatttttgactgattgcaaagaggaattcatcatctgctgtttataacagaatacctgaaagtgggtaattaatgagagatgatttgacttcttatagttctggaggctgagaagtccaaggttaagggggtgcatccggtgagggccttcttgctggtggggactctctacagagtctggaggcagcacagggcatcccatagtgaggaggctgagtgtgttagctcagttctctcttcctctttttattaaaaccaccagtcccattcctgtgataaaccactaattncattaac

SEQ ID NO: 632657 - DNA, 785 bp, Homo sapiens
tgggccgtgccaaggttggctgttaccagcagcagcagcgatgcagcatgctaagcagcagtatgcatccccagatgctgatgatagtccccaccaccaatgtccacagctctggcagtgaagaaatgtgaggaccaatggaccatgccagtatggcagcagccgtgagctccatgcctcagaggtcccagccatgagccagcctcctgctgccagcttctcctgcgggtaacctgggctagagagcaacagaagaggagagctgccatgagtagcgagccgcgatggactagtggccagcaaagtccggggtggagagcggctacgttctctctggagaagaccgagacaggacttgaagtgcttgaagaacagcgagcttgccccccagaccgttctgcctgtccctaagctcccagtacccatcaagcagagggccgttcctcaaggtagcttggatggactggcgatggcggccgtgctttcgcaccaagggcaggccgccctgattgcgcgtagcgtgctgtcgaggtggggggccatctagcgatctcgtgctgcacgtagcccgcgtagggcgcggcggctgccgcccgcatgggcgtttccctcagagtgctccgggatagctacaagaacggggacaggggccccctgaggagactgtcatcccagtgacgcacattcggggagtttgcgaccccgcgttccttccgaggacctgaccatatgcccacagaccattgggaacagggaatgtccgtccgaacgtgcctccagatgag

SEQ ID NO: 632658 - DNA, 123 bp, Homo sapiens
tagcaggtggtaagatcacttaattccaggagtatgagacagcctgggatagtggcgggtgctatagttccaactacaggaggctgaggtgggaggacacctgagtctgagaggtggaggttg

SEQ ID NO: 632659 - DNA, 848 bp, Homo sapiens
gtcccccacccctcagagtggccttctgactgccaggagaatgtgctataccctctgtatgttctcccctaacaggagaggtcatgtgaacttgatggaggaggtgcacggtttggttgcccctcacccttaaagcttagagcagttgtagcgatttccagtccagcacatacagtcccagtgccccagcaagaccggaagtgtgtatactggcctcttatcttgattctttcaaatgtgcgggaacttgtgaaactgtcatctggaataggttccatctcttatgtgtgttagatcaaacaaagaagcccccagcatgcccaaaatgctgcttcaaaagcctgccttccagtccttacaaaaaccttgccaggattaaatgtgtaactttttctatttttgtacagtttctaaagtgaatttgctagtgatgtcaaaatgaatacgttatttgaggggtgtgagcacctcctccatttaaataaagtgttgacctttccttttatttttcacaaggtggaaacccgttgtgtgcctctcgattaagggtttctgatgacattattcttaagacagatgatccttatataccaatatatgtgccttgttggattgaattcagaagaaattgacctttatttgtctaccagtaatggctggtaattaagcctgggcaaaacttttgaccccttggtatttggataaggtggaccttggaatcgggcaaggcagaattaagggtattgcccaaaattggttgcgaatagttgggaagggttttgaaaacggggtttttaaagtggggagaaaaaaccagcgctaaaagagggtgttcaaaatgggggacc

SEQ ID NO: 632660 - DNA, 173 bp, Homo sapiens
cctcggctctctcgaggacaggcgtagtggacgatgagagttcgatgacgcgggctgatggggataatccaccaggaggagagggacacggtggcctcgtgtgggccgtgcctgatgcagcgtgggcccgaacacgatgcccaggaatcccggtggccgagggtaccgagctc

SEQ ID NO: 632661 - DNA, 290 bp, Homo sapiens
  misc_feature (22)..(22): n is a, c, g, or t
  misc_feature (30)..(30): n is a, c, g, or t
aggtgcggtggctcacgccctnttaatccntgcactcaaagaagccagggtgggaggatcggctttagcccaggagttcaagaccaagctgggcaacatagcaagaccccatttctacaaaacttttttaaatgaggtgtggtggtgtgcacctgtagtcccagctactcaggaggctgagatgggaggatcacctgagcccaggaggtcaaggctgcagtaagccaggattgccccactgcacactccagcctgggtgacagagccagaccccgtcttaaaattaaaaa

SEQ ID NO: 632662 - DNA, 142 bp, Homo sapiens
gacattgaggatatatgtctacgaaggcctgtacttccagctcttttcaggacagggtcacaagtaggaagggtaagccatatcaaagacttcattgaaaacgaccagaggatctcaaaagaagtcctcccctgtccctggc

SEQ ID NO: 632663 - DNA, 126 bp, Homo sapiens
cacccagaacacagtaaaactgaaagaaactcagtcagagcctgggcatgatgaacgatgatgatgagaatatcgttcctttctctctatgtccatggaggaatttatgcaacttccatcgtgaag

SEQ ID NO: 632664 - DNA, 159 bp, Homo sapiens
  misc_feature (108)..(108): n is a, c, g, or t
ccatggagaacaagactccttctttagcgtggcgacgcttatattaatgctgactcatctatagaaggatagtacactctgagagttgattgtcaccactgatgtacnagcttggtatacaacctaacaaaagaggtatataattacatataatttaag

SEQ ID NO: 632665 - DNA, 245 bp, Homo sapiens
aaatctaactatcaaaccaagggtatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctc

SEQ ID NO: 632666 - DNA, 358 bp, Homo sapiens
ctgggttgaacaaaaagaggaaatgtgtgcaatgtttacaggtaaaaagttctcgctatcactcttaaaattccataggcttagaagaaattagggtgttgctgatagaagaacagtctgtagctcttaatgtttattttatactataccctttacaacagaatttcagattattgatcggcattgcctgattccatttcattgagtcctatgagagttgaaattgcagactgagacaaactaaaagtaccaagttcatcatgtttaaaactgctttttcaggatattgctttctctatgctacttcagtgctgttcctcttccactgataggttgtaattgcaaaatggatggggga

SEQ ID NO: 632667 - DNA, 128 bp, Homo sapiens
ggaattccgggcggacccaggcgtgcagccgggcgggttcggggcgggtgttgccggctttggcaacggccgggtgggaaagcctccctctcctgagatatgggcatatggggatcaagtgagatctg

SEQ ID NO: 632668 - DNA, 323 bp, Homo sapiens
  misc_feature (221)..(221): n is a, c, g, or t
ccaaggtctgtgaccaaaggcaaggcccctacttctgctccaaatcagaagcccttgaggaaggaatttgagtggcttatcttgatcatattgtttctaaccctatggccagggcaggcgaggtactacgattgatgcctccagcaaaagttgggtaggaatggttttctaaggaaacagggacgctgcaaatattatagcatagtaaatatctacacttncatcctttggtagctcagcacgtgtgtgtactcacatttgttctcatacatacatttcaaaaatggttctgcctaatataatgcaaagatttcaccccacat

SEQ ID NO: 632669 - DNA, 354 bp, Homo sapiens
atgctggaggcatgcaacttggagcttgtggtctgggagtggctataactgggaacaggggctgggcacggtggttcacacctgtaatcccagcactttgggaggccgaggtgggcagatcatgaggtcaggagatcgagaccatcctggctaacacggtgaaaccctgtttctactaaaaataaaaaaaattagccgggcgtgttggcaggcgcctgaagtcccagctactctggaggctgaggcaagagaatggcgtgaacctgggaggcagagcttacagtgagccaagatcacaccactgcactccagcctgggcaacagagtgaggactccatctcaaaaaaacaaaaa

SEQ ID NO: 632670 - DNA, 609 bp, Homo sapiens
agcggagctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctatgggtggagttcgtccgggctgaacaagcggaattaacagataacttgcgagaggtcaaagcgtcagcatgtcacagtgtgcgtaaagccgtcacctggaatgtcttagaagccgtgaggtatggctgtatgcaatcaggtggaccttgattgtgatcgagcgttaacacgaggagacacttcaacaggcgaggctcgagcagcgtcgtactcggttagttgggccagcttcaagtgtgtcttactcagtcaactggagtgtacccaaaacaaagatctagccaagtgcaagtctctgtgctgcactggacgagactgggtgcagtgtgacccttaaggcctgaagattccaactgtcgctgctcttggaagcttgacgacaatgttactctgcgccagaccagtcaccacattatggcgtctcgtcgaaagcccgattcagaattcctga

SEQ ID NO: 632671 - DNA, 117 bp, Homo sapiens
tcgaatgtctccgccagtcgggccttttttcggcggtatagccgtgcagcgtggtgcccacgcagtcgaaccccaacctggcagcctcttgcgcttcttccacggtggcgatgtccg

SEQ ID NO: 632672 - DNA, 107 bp, Homo sapiens
ggatccttaatatgctgtctcaaaaaaaaagggaggggtgggggaggagagaaggaagggaagggacgggaaggagacggcagacggaatggagaaggacggcaagg

SEQ ID NO: 632673 - DNA, 319 bp, Homo sapiens
ccaagccgtcgtgtagccattaatgcgtaagttttcgcccgatgtaacagcgccagtacggtcgtcaccgtcaagcgcaacatacggcggtgcgttgaagtcgccaaacgcattgccgagcgcctgacacacccttttgagccgttcgtaaactcaaacaaacagcctaaatctaagtcgacgttcgttgagctaccaccaagcaacgatgagaaaaagcctttcttttgcggcgcttgtagttgattccagtttaagttaatgtgaatttcaccaagtgactgcgcgcccttcgttaagttgatcgactgcttggatt

SEQ ID NO: 632674 - DNA, 97 bp, Homo sapiens
cgtcactgagataaccagctcggctgttagcaactctgttagcaaagctgtttgtctttctcggaaacaacagtaacgataagcctctttgaatatg

SEQ ID NO: 632675 - DNA, 1079 bp, Homo sapiens
  misc_feature (628)..(628): n is a, c, g, or t
  misc_feature (714)..(714): n is a, c, g, or t
tgggtccgtagtgggtccatagtctaataccagaattactcatagctcagccacgaaggtgagtttcaactctcactttctctatattattctcctccgtggattatagtatacgcttggggtggcgtggaattccatttcatattcctacactataatgtgtatctcaagaagtgtgttacgtgaaaaactattcgagaaagctctcgtgaaacgagaagcgagaatttcatctcaaattgtctcgctcgggtaaatataaaatctctctatatagaaaagagcctttagtgtgtgtgtttgtgagggtgggtgttatatattgtgtgggtgcggaatatatattatagaaatgtgtgatctcgtgacatatgagttgtgagaaagttctcctctcaatgtgtgtggctataaatttgtgtgccacagagggggccacgcaagagttataactctcttttgcgattttctcctatatatagcccctttataattctccgtgtgtgtgccacagcgtgtgaagcggaaaagaaagagagtgtgtcaacacagaacatctcgcggtgtgtataaggttttttcacaatttttcctcctcattctcgtgtatactttctcgtgaaggcanaaatcttatttctcttctcccaacacatgtgtgtggggcccaatgtgtgggctctttattctcccatgtgtggcgctgtgagaagnccccccgggggtttctctctatagaaaggaaaaaaacctctcccctctatagagtgtgtgtatgtttagaaagaactccccaatatattctctcatcttctctatatataacgcctgtttaccgaggaaagaaaggctttcaatctcaagcgtgtggaagataccccctctattttaacccccaataacagggaggaaggaatatctctcgctccccaccgtggtttcttttttcaaccgcccaaggtcaaccctgtggcggcaaccacccttgggggagcagaaccggcacggctaacacggtgggtgttcttccccaactccaaacgaaagaggaattaccgtcgcgcgcgcatcaacctgcg

SEQ ID NO: 632676 - DNA, 303 bp, Homo sapiens
tgcctacgaaatacccataatcctccctcaccccaaatcacaaatctcctacatgtgaacatagcctgtcactcatttgccatgaggtacgtgccatctccctgcagtgctacagttctcccattgtcttcccgtctggttaacgagcagccctgtagctgggtgtgtctagttagctcttgctttttgccggagttctctcctagaggccaactactgctgctctcgtttattatgatactgacattctgggttcagcaaggtgggtgggaaaggtggtcacatgtcccatacaacctatca

SEQ ID NO: 632677 - DNA, 345 bp, Homo sapiens
ataaaaaagttacaatgtgtactcctagagaaaccaaaaatccaaatttgtatatgaaatcttaccatcttaaaagattggtagctaattattaattaaaaagctgtgccgtgtgatgtgtcgccaaacggactggctcatgggtgggcacgtctcaacctctgatctcagagcgtgcatgccttgtcctcttaagacaactcctgtggcaccgtttctccctccacagggccaaagccatagtgtccggtcccaaggacaaggctcttccagtgctaggagaggtatgagcaggctctcacctgtgagctgtgtggatcacaaggctgcctgcctcagtcttgg

SEQ ID NO: 632678 - DNA, 571 bp, Homo sapiens
  misc_feature (203)..(204): n is a, c, g, or t
  misc_feature (211)..(211): n is a, c, g, or t
  misc_feature (309)..(309): n is a, c, g, or t
  misc_feature (379)..(379): n is a, c, g, or t
  misc_feature (406)..(407): n is a, c, g, or t
  misc_feature (409)..(409): n is a, c, g, or t
  misc_feature (411)..(411): n is a, c, g, or t
  misc_feature (413)..(414): n is a, c, g, or t
  misc_feature (432)..(432): n is a, c, g, or t
  misc_feature (449)..(449): n is a, c, g, or t
  misc_feature (464)..(464): n is a, c, g, or t
  misc_feature (474)..(474): n is a, c, g, or t
  misc_feature (486)..(486): n is a, c, g, or t
  misc_feature (507)..(507): n is a, c, g, or t
  misc_feature (513)..(513): n is a, c, g, or t
  misc_feature (516)..(516): n is a, c, g, or t
  misc_feature (534)..(534): n is a, c, g, or t
  misc_feature (538)..(538): n is a, c, g, or t
  misc_feature (541)..(541): n is a, c, g, or t
  misc_feature (553)..(553): n is a, c, g, or t
  misc_feature (555)..(555): n is a, c, g, or t
agggcagagctccgccttgttatcaacaagtctcattcaaaactccgtgggaatcggcctgaaagtccagaaaagatgttgtctacctcagaaatccttagaatcaatattctccagaaaagtaagagttctcctttgctttagaagtcagactttgcctcaaacttgtaatgaaccccaagcctccaacatggcgatcgttnntgtgaanatggctctgcttcatcccctgaagccaacagtgaaaatgcttgaaagatctaaccatgtgagccggacagaagtcagcagcaaccatgtcttgatttnccttgataaggtgtcaaatcagacactgagcttgttcttcacggtttctgcaagatgcccagtagagatntaaaccagccatagtaaagctatattnntncnanncggatgagtttgaattgntagtcaatgtccttcancaaagatcttgaaancttaagaccncaaggctaaaantctttgctgagcctgtctcanagtccncanaagacacgtgtttttgtncttnaanacttgatgaatnancactttttctggtcca

SEQ ID NO: 632679 - DNA, 343 bp, Homo sapiens
ggtgcaattcctcttcttaagcaacatacccatggccgagctcctactcctcatcgtacccattctaatcgccagggcattcctaatgcgtagcgaacgaaaaatcgtcaggctatagtaccactacgcaaaggccccaacgtggtaggcccgtacgggctctgtacaaccctgtcgcggacgccataacaatcttcacgaaagagcccctaaaacgcgtcacatctaccatcgacctctacatcatcgccccgatcttagctctcaccaattcgctcattctactatgaacgcccctccacgagacccaaccgcctgttcaacctcaagctaggcctcctat

SEQ ID NO: 632680 - DNA, 136 bp, Homo sapiens
ctggatttgcggttgactcatagaggctcccgatctaacgtaacacatggctgcacagtgcagacctagacccacaggctgcacagggagacctagacccactggctgcacagagagccagacccacgtggtcttg

SEQ ID NO: 632681 - DNA, 346 bp, Homo sapiens
  misc_feature (346)..(346): n is a, c, g, or t
ggttgagaactctgtggcagatatagaggtgtatgtaaagcgaatagagaggtctctgtgggacacagctgtgcacgaagatatatgagcgcctgtaggcgcctctttctataccagataccgagggtatactgaggtggtgttttccattggcaggcctgagtaggttagcacttccacggtgggaataagaaggagctttggaatggtgagcacacacaggcgggagctatgccacagatggagccagaaccgcggaaacctgtgaaaggcagagatatgtgaaacaggatatgggcttttgggacatggagtggtcagcagaccgatggagtgagagggtttn

SEQ ID NO: 632682 - DNA, 176 bp, Homo sapiens
caggtaggcccgtgtaggcagcgacacttgttctaagcttcgggcctttcccacctgtatatggggatgatagacgcctcccttaactcacctctgcactggcaggagacaatgccagggtgtactttcccacactgaccctgacagtcgtccctggggagccgacctccagacca

SEQ ID NO: 632683 - DNA, 220 bp, Homo sapiens
aatcgagccagccatagagcagcatgtcggccagcgtggagcgcttgccgcaaatatagtttcggccatcctccatctggccgttcagccattgcaggcggttggcggcgatcatcttaagcccgggcgatgcgtcaggggcgcaagggattcgcttctcgaagaatttcaggccttcaccgaagcgaaagccgttgcccatatgctcgcagatgttgag

SEQ ID NO: 632684 - DNA, 515 bp, Homo sapiens
catatcattcaagaagaattagatacgcagcctgagcaacatggcaaaatcccatctctacaaaacatcaataaaaaaaaaattagtcgggcatgggggtgcacacccgtaatcccaggtagctgccactacaggtgctgcaccaccacgcccggctaattttggtatttttcgtagagacagggtttcaccatatttagccaggtgggtcttgaactcctgaccttgtgatccacccgcctcggcctcccaaagtgctgggattacaggcgtgagccaccttgccgggccaaaaatctcagaattcttaaagactgtttaaatggctccatcagtaatttggaagcactttcctttttttttttccccttttgggccctttccccaaggccaccattgggttggataattgttggcggggaaagagcaggggcaggaggtatgctgggataagtgacataagggcatcgcgggatgtatcggataattagatagacccggtcatctgaggcact

SEQ ID NO: 632685 - DNA, 1226 bp, Homo sapiens
  misc_feature (399)..(399): n is a, c, g, or t
  misc_feature (662)..(662): n is a, c, g, or t
  misc_feature (852)..(852): n is a, c, g, or t
  misc_feature (1125)..(1125): n is a, c, g, or t
gcgagagactgcttgctgtggcggagagcgccagtaggtgcatgctccagtcagtgatggcattgactgcgttggcggtgcgggacgtggcttgtggcgtgtgggggcgtgaggaccatgcaaggtccctgtggcttcgagtgtctgtgatcatgttcctgatgaatgtcggatcgcggggccagcgtgtgctctcgactctccgtgagaagctcggttgtgtggccttcaggtaaagaagtagatgcagaggttcgttaacatgcatagtaactgagtaattatccgggtttaccggcgtcagccgtgagtccccatccgttctcagactccttgggatcatccctagagtgggccggttccaaatcctatttagagcgtagtcgagaatcttggccncaccgctagctatctcgtaccctttggggtagcactttgcggagctgccaccaatcacacactcgagttcaaggagatcttcccctgtgggcgcgcctaataatcacgagggtatactcccttatagcacacctttggagtaggtccccggacacagttggtgcgcgagtcgttgagttacggtggctaactgccgcccaagttttatcacttagctaaccaatcaatgttgtgtcagggggcaccctcaaatagcgcgtttntcgccaaacccgggagcgagggttctaccgaagaaatcaaagccaccgcaactgggggctttcaaagagcttccctaccctttttaattccatttaaccccatttctttccccggcggttgggaaggtttccgtcacctccaggaggtccagttagcgaggaaaacaaacacccccgccaaggattatcntattcaggccaaccgaaaggtaggtctataaggagttcgcgtggaaccccaggcgccccaaagcaggattttttggcccattcccccaaggcgacttgaatattcccacctttccggggagcgcccttaaccgcgaactctatgtactagacgcccgcacatacgtaacatagcgtccagtccagttttcccataccggagccgaagagcaacatggcgcttttaagagcgttttttggcagaaaatggccgcttggcaaatgtggcagtttntcaagggggggctttttcgttcacacaggggttggttttcataagagacccccccaccggaacggttcccgggcgaaaggaaggttggaaggggaattgac

SEQ ID NO: 632686 - DNA, 678 bp, Homo sapiens
gtttaactttgtcctttttaaagcggaaaaaagggagaaaaaggtaaggccccctatcttgggcaagagacccagttgtaagtataaaaaaactggccccaatggagttctcccggcggcccattcctggtaaagcggaattgaaacagctgaaccttcggggatactgccattcccattcccagcttcttggttaaagaactcccccgtgcacaggagagtgaagatcggttgggtttagcccgggcgaaaaagactcttaacaggctcacgtccaacattggggataaaacagcacctgggagaggggatgttcattagcctccaggatgggtgaaagcttcgcccatctctgacgtggtccggtatcgggtcttgtgtcctgtaggaccttagggcctatgctgaccccaacactggcagagctgatcctcccggcgccttgatagttcgcaggagaagtcgtttcattcaagaaggggccatcatcagggtagaagagcacgtctgctcaaaccggaagcggcagcagcaggttcctgctcacgccctggacttttacaacaacctcttacaaatactgcattgtgtaaaccacaaaccccaagattagtatttgggtcttgtataacaggtttccaactggacaatggagttctagtgagttaaaacagctgc

SEQ ID NO: 632687 - DNA, 124 bp, Homo sapiens
ctgttctcatactgaactaggcggtacccagacacagtgacactcttcctccacatttactcatgatttcagaaaacaggtgaaaacaggctgagcgcagtggctcatgggtgtaatcccagca

SEQ ID NO: 632688 - DNA, 132 bp, Homo sapiens
aaccccgtcggtcgcccttgttctgggcgtgtgggtggggcgacataatctcccgttgcccatgttggagtgcagagactcgatcttgactcactgtatcctccgcctcctggcgatctcgccattctcctg

SEQ ID NO: 632689 - DNA, 216 bp, Homo sapiens
aggccgtgtcagtgctgggattacaggcgtgagccaccaagcctggcctagtttttttatttttagtagagacacggtcttgcttgtgtgctcaggctggtctcgaacgtctggcctcaagcaatctgcctgtcttagcctcctgaagtgctgggattacaggcgtgagtggcctgtattttctttcttatttattctgtggtaaaacttttataa

SEQ ID NO: 632690 - DNA, 149 bp, Homo sapiens
acggacgctgactgcctgcggtcacctcagacgactcccctttttttttcttttttgtttacgggacggcgactttacggtcggttggtcgtacggacgactggtcctgtgacggggtacccgacgctcgacacttcgtaactcacggg

SEQ ID NO: 632691 - DNA, 1011 bp, Homo sapiens
  misc_feature (1011)..(1011): n is a, c, g, or t
tgggggggccccccctttttttggggggccctctaaaggggggcgcccccgtgaaaaacccgggggagggggtcggggcccccttttttcacccgccgcggggcaccaacgacctcccgagggggctccccttcgcgggctgaagaaggaggcggagaaggaggtacgcgacgccccattataaccacgaccccgcgggttgtcgcgactccgcgggagagcggcacttcaccgggggaaacaagtgtgtattaagcccgcagatgggaaggagtggggctcccaaagaggggacgagttctcgggaaagacagcccccacaacgtggggcgggggggctccccaagattctgcccaccgagtggagggggtagggacccacaggcgggggcgggacctcagaagacaaccaataagtggggagagtgggaagatgtggcggtagaacgcaactgtggagccgcgagaaggctcgcacaacaggaggcctccccggggggagaacacctggtttgtcgaccacacaaagagcgagcggcggcgtaccccctcgctgcggaccccaagtaggaaccaagggtcgggtgagaggggagacaaccccactactgaggacaccaatattgcccccctcacacacctcgtgagacaaacacccgtgccttgtggggatccagcagcccgtatggacccccaacatattgtgttgggacgcacaagggagacgacacccatcctccaggtggtgtggctgggctggatgtccccaaaacacttattctccccgccaggagacagacgaccagcgctcaccacacgtggtgggggaccaccgactgcacgaagctatgatccagaggccaggactaatacgtcgcagcgagacacatgccggggagaagaaaagcggctaacaccaacgaagcgcagcgtgagcaacgcactagcgaacttaggtgaggcaggaccagaggtctacacagcagcagacgcacacgaggagcgatagtn

SEQ ID NO: 632692 - DNA, 849 bp, Homo sapiens
gatgactgagcgggttgtggccgggtagccgatcctcgagcagcagtcggcttctctagcgcggaaaccgggagtaggagcactcagaatacgaatctctgtctccgctccgcctgttcttgtgagattatgttgagtcgttcaggccttacattcttgcggactttgtgagaaagcttaccatcaaacaggatggtgccagcgagcagttaatccagactataagacgaggatacctcgacttgcccatgtaggactcccgtgtaattcattggcggaactctacaacatctctatgtgtgtcaagaaaaatctagaatgttgcgagggcacactgctcttaatcgcaagtatgtgccaaatagttgtgggctgcgtactgttgcataagggcattgcgcttcgttggcagtccatgttagatgaagagaaatggccgggtgtgttgtagcaggagaggatggcaggaatgattgctggccaggtattagatattaaccgggggtgcagagccaaaagtgaaccgaggaaaagcaggtgtgaaacgatctgtgagctggagatgttacggcgtcctcatttgtgactttggacgtatgactgtaacaactgggactattatggataggatagtggcaggtatacccaggagcgtgtacctcctcctcctgcctatggctcgggcttgtaggtgcccatcggaaacgtcagcgtgtatcaggaaacaccttcacgaaaggggaaaagtggttcaattctaagagtggaccagaggggatcctttccaagtctggaaaggtgaaaaggagatgaccttccagggcattaagaaggatggccagataaaca

SEQ ID NO: 632693 - DNA, 439 bp, Homo sapiens
tgctgctgcagtcgatctaaggctcccccccgtagacttcctgtactcctgagaggtgaagccagctggacttctgggtcggacttggagaacttttctgtcttacaagaggattgtaaaatgcaccacgcccggcctctgcctggcttcttatagatggtttctcttggtgtatgtttcctaggctttttgactttgtggactagaaagctctggtctccaagtccctacaaacttctggatcttctacagattaaacattttaacagtcttcataaagtgcatttgaaatctaaggtaaacattcattacctgtacaccaaccacctcaaaggttttatgaaataagatggaatatacataaaatgcatgagacaggtgtactttgctttatgtgtttgtgacacgttcacacaagtaaatttttaaatttttggta

SEQ ID NO: 632694 - DNA, 382 bp, Homo sapiens
tgcagggaggcgtcaaggactgggcaggaggtgataataaggtgaggtgcaactttttgcggcttgtagcttttccgtatgtggaattatttcgttagagaaaaactctcagaagtagaattaacagggtaaaaagaggtagaagcatttttatggtttggacacacaggcggttttagaaaggaccattctggttttcactaccatcactaactagagtccaaaaagggcacctggtctcaattggcatttctctgatactagtgaggctagaaatttttccacattggttatccagttctacttccttgttttcaggtggtcagtttattttcttggatcatcgtatcttccttttttttttttttttttcgaggggggg

SEQ ID NO: 632695 - DNA, 110 bp, Homo sapiens
gtagggctgggaatccctgagattagctaaagttaagttgttggaacaattccttcattggaaattgtacctttgtgttttgttgctctgtttcctgcaacatcactcgg

SEQ ID NO: 632696 - DNA, 125 bp, Homo sapiens
tcccctaggtggaaagcatgtcagacaccatggccactcatcagccctctgctctcccccacgggaatcatcagtgctgtaaagtccgtgcccctccagcccccggggagctggggtcttcagag

SEQ ID NO: 632697 - DNA, 149 bp, Homo sapiens
  misc_feature (75)..(75): n is a, c, g, or t
ttatttttcctgtaaccttcctcacctccaccctctgaaaggctccaagtgtttgtttccctctatgtgtccatngtgatctcatcatttagctcccacttacaagtgagaacaagtggtagctaaatgatgagagtctccgtcgaact

SEQ ID NO: 632698 - DNA, 118 bp, Homo sapiens
gccctaagggccgagaccgcggccgaaaaaaaaaaaaccccccccccccccccggaggaaagcctccgggggggggcaggggaaacccaagcctggaggttcaagggagaagggggcc

SEQ ID NO: 632699 - DNA, 794 bp, Homo sapiens
  misc_feature (447)..(447): n is a, c, g, or t
atttacaggaaaaggttgccttccacatttcgtttctcccccacatgttcaggggaatagctcactttcatcaccgtggagcactagagaaaggccattccaggggacttgaacaggagggttctggatttcaggacaccaagcatagctcagattggggatgcagtaataaagatgggattatacagagttcacataaggaagagtaggacctctaacccctttcctccagatagccacaagaatgttggccactaggctcattccctgctcagctaccaccaccatccttcccccaatgccctgacaagaactaaaggattcctctgtgtggaaactgaccagcccaggagaaaatatttttttttaatgtattttttacgcctgacctcaagtaatccgcctgcctcggcctcaaaaagtgctaggattacaggcgtgagccgntgcacccagccctatttttattttttattttatttatttatttttttgagacagagtgaaacaatgtctcaaaaaaataaaaataaactgaatggttccacagaaatactgagacttctgcttaaacaggctttcttgaacctgtacgcttccagttgggtctgctgcttccaggtcatttactaaaaatgataggaagatttaaaaaataaaaataaaaggaaggccgggcgtgagtcacgcctgtaatcccagtactttgggaggccgaggtgagcggatcacgaggtcaggagctcgagaccatcctggctaacacggtgaaaacccgtctctactaataatac

SEQ ID NO: 632700 - DNA, 174 bp, Homo sapiens
tcagggttcgattccggagagggagcctgaaattccagcttttgatgaggccattgctgaacttgatacattaagtgaggagtcatacaaagacagcacgctaataatgcattcctgagagacaacttgacattgtggacatcggatacccaaggtgacgagctgaagcaggag

SEQ ID NO: 632701 - DNA, 314 bp, Homo sapiens
gagtgctccccggacggagcacagtgctcttcatagtacaaatacacattcttctaatccaagcaataccccaagccaaacttcagatgcaccttatgattctgcagatgactggtctgcgcatcttagctacttctgggaaaacagtactactacaattggtcgacacagaagtttcacaactagcaaaacccaaaacgagtggcttgcacaagcagcaccagcagacacaaacagcacgcaaacacagcatggccagtaacacaagcttctccccaacaagcatcagggcattaccagacagcagcaggtga

SEQ ID NO: 632702 - DNA, 149 bp, Homo sapiens
cggtccttcgcatgggcgggcacttagcaggtggggagcagcagcaatctcttatcccaacatcaccatctgggtcagattgaactcttcaatctctgcactccaagctgttaagatagttaagcgtgcataagtgcccgccaatcgaa

SEQ ID NO: 632703 - DNA, 137 bp, Homo sapiens
actcagtcggtcactgataacgtgattgtgctagaagtgtaggtgggaggtctcccaaacagaggagctacgtgtccttggaacgctggttgagtgatttgattcttctttctatctatacagagtggtacatacct

SEQ ID NO: 632704 - DNA, 1304 bp, Homo sapiens
  misc_feature (632)..(632): n is a, c, g, or t
  misc_feature (720)..(720): n is a, c, g, or t
agcgggtccgctctgcagtgcgaagggctcgaagatggccggttggcaagacgctacgtgcgataaccgtgaatgctgcgagtggtctgctgccacggaggcccgctcacttgtcggctactgcgacgccacaataccgttctgggacagctcacggctctgggccgtctttcacgagcattacgccaatagaaatacgatatgattgctcagggaagaagacccgggcacatgcgtttcgtttacaccgacacggtttagacctccttggcacctggacatgacaaattgcgtccagctcgatcgcagacggataagtcatcataccgctcgaatcggtcgcactttgcggcaaattagttggaccatcccgcggacgagagaaggcagttcataggttcggcgcgacgccgatagcgatacaaacatcgttgcgcgtggtccgcgcacagcatgcctccgtgctcaggcaggctacttcgtgctctcatcacgtcccactgggggaaagaagcgcacatgcgttgtgccccacggggaagcggcacgacatattaagcgacagcacacaggcatatttgagagcgatccggcgtctatatatatccccctcgcagagcgaaacgtgctcntttgagatcgatcgctacacgacaagccctctcttcgcccctatgtcgcttaacccctaagggcgagaacccttggattattctctangtccaaatcgagaacccccgttgacacatataagttgagctccaactacgacatcgctgttacctccataaacccctatggttaaagcacgtttggggatcaggcctacagactcttgtgtccccttcttacggcgcccctatgcttttgtgtccgtcacgccttgcttgcgcagctggaagttcgtgccgccttggctttttttggccccccgagcgctgtgggtgcccgtttccccacgtgctcttggcgtacgttgggttttacagccaccccacggctttagcttgttgggcttagcaccgcccggagtccccccgtactaactccctttgggccgcagccgacgttacgtcgtttcgccacggctaggctagcaccttcgccttggagccttctcgtgaccgcttgggaccttagccgcgtcgtgcacgacgttccgggccgggcgccgcaccctgcgggcgcccccctttgcccccgactacggagttggtgcgcggccagttcgcaccgcgcctgggctcccatctagctgcccgagcatttaccctctgggcgcacctttcgtcgtggaccatcac

SEQ ID NO: 632705 - DNA, 205 bp, Homo sapiens
cctcacgcccagctagacgccgctccccgagttcacagctctggtgactcggcggccatgcaaatagaagcccatcagtgctgtgccgagctcttagctcaaagaccgcccctcctagtccacagagctctcttatactttaggagtgcccagaaagcctagcaccctgaagtcaagctatgttccctttcatactcattaggtc

SEQ ID NO: 632706 - DNA, 205 bp, Homo sapiens
tacctgaacacaccggggttttattattaacggatgccaaaagcacattttccaaaaccgggcttaaggcgggcccccaaaggcaacaggacactacagttcctttctttggggcaaaaaggagggtgcctgggaaattcaagggcttcagtggggaggcaaaggtcccaacaacattgtcaatggcaggcaacggcaggagggg

SEQ ID NO: 632707 - DNA, 207 bp, Homo sapiens
ggcagggcaagcatccaggtgaccctgcaggccgcgcgccagaggttccggcagtttccgtttataaggacatgacaggtgcccgggaggccctggtaccagcttcgagagctgtgttcaccagttggctacagcctaaggcacggtctcaaggagcagattctcgagctgctggtgcttgagcagtttctaggtgcactgtcctgt

SEQ ID NO: 632708 - DNA, 869 bp, Homo sapiens
  misc_feature (68)..(68): n is a, c, g, or t
  misc_feature (443)..(443): n is a, c, g, or t
agcgaatctgcaagggggaagaaaagcatcaacatttaatgaaggacattgggtgtaatgagaatcantgtaggctggaccaatagagatagatagagataggtatctttaaagtttgaccgtggtgtttatttagagagaagtctttaacagttggccaaaagttagtttttaccatgaagccaaaagcaaaatgatctttagtcagtggaaacctgaaggtatatatcaaaagcacatcacattttttatcatgattagaataatccataataaatatttttcccaaagagattaacagctgtgttttggtatcattcacatctttttgacattaatggagcatcctttttcaactttgatggaggaaaatcatgtgaacatgccataaaacactaaattaccatgggaccatctatttattttttaaagcatgttcttantgcagtatcttaataactagtttctccccaaagcaaaaattattgatttttactttatcaaagggagatggcttgatattatcaggaagtggtatatagccagcaattctcaaccaaaaaaagtatcgatttgaaaatagtgccctctttgcaagatgtcctacctatactgtggtgtgcacagagtgcctgagctttggtgggaccgtggtggacagtaacttacatgtttcaaaatcaacgtgtaagggtttgcaaatgttacaatatgcttctctagggtatggaaaaagggtataaaaaaggtaagggaaagggaaagaggggggattatctttcttcggtgcgtctgacatctagaccttaaccgtcaatgttcggaactgagttcctattctccacttccaaggggtggactctaaaaac

SEQ ID NO: 632709 - DNA, 156 bp, Homo sapiens
atagcagtttccttgaagtgttgaccattttagtgtgctgtcttagcaatctttgctgccttgtcataccctagtatgaggtttgtgagcttgataaccaacattagagactcattcatcagcttgttgatcctttctgtattggccttatcagag

SEQ ID NO: 632710 - DNA, 875 bp, Homo sapiens
  misc_feature (264)..(264): n is a, c, g, or t
tttactttgaagaaatcagtttctgcctcttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaatnggctatgtctctggacaagttttttttttttttttttttataaacccttttcttgaactttctcacttttttattgttttaccctcaaaaaatggtggggaggctggaaataagtgctttgtgtaaggggtctgtgccaaataggaagatggcctagtttatgggtttctacagggttgttaaggcctgtgaagatgtctaaaccctacggtggattcccaaggcttttcacccccatgggttgggccttacgtgaacaactacgccagaagtctcttttccaaattccttacgcgttctccatataaactctctgggaggttaatcttatttatctaacctaaggcttcctgtttttaccccctccgtgttttccggggatacagtataattgaccccggtcaccttaattctctagggggggccgcgaggtcccttggcggtaacggcatttcctcctttccagcagctgtgtgggtccagagctccctgatatcgcagctacttacacgtgcccccccgtggttgtccttttttgtcccgcggcgtcctcatagccccccagtggttggttccgctcttttggcccaaattgtcggcgcgcggcactg

SEQ ID NO: 632711 - DNA, 486 bp, Homo sapiens
ttcagtatgtaagaagccccagagcagggagagaagtcagaacagtaattactatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcaccgtggctcacacctgtaatcccagcagtttgggaggccgaggcaggtggatcacttgacgtcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcggcaacagagggagactccgtctcaggaac

SEQ ID NO: 632712 - DNA, 283 bp, Homo sapiens
cgatctagaggatccctgtggagacgggggtctcagagaagtaagtagtccactcgaggtcccacagactagttcaggtcggggatgtgaaggcccagcagggtggggggagtccaagagggatggatgctcctaggctgagggtgcagtgaggtcaaaggcaggaagaaagggaagagggagcgggtcgtggtggctcacacctgtaatcccagcgcttggggaggtcgaagcaggcagatcacctgagatcaggagttcaagaccagtcgggccaacatgg

SEQ ID NO: 632713 - DNA, 296 bp, Homo sapiens
tggtggagggaaaagcctgggtcctgttcttccttcattaaatgcaagaaaacagcatggccagtaaacttagccagggccttggaatcccttagaatcccacttatgttgcttatgattacgggcaagctaattaaccctgttgaatttcagattccccctttgcaaccttaggttaagaccagtactgcaggattgttgccctaaatgaaaaactgtatgtgaaggggcctggcccaagggttgtgggacattgtgtgtttaataaaaagctaacttccatgttcataagagga

SEQ ID NO: 632714 - DNA, 808 bp, Homo sapiens
  misc_feature (262)..(262): n is a, c, g, or t
  misc_feature (530)..(530): n is a, c, g, or t
gaggacagactgtggttcgggactaggcagcgtggccgcgttcgctctcgacccgctgctcgtccgtgcgccagcgcgtgtctcctcccgaccgccagtacccgggcgccgtgctcgaggggccatggcatgtcgtcttgtgacgctgcgacctagcaggcagtggtgtgtctccagggaggcatcctcccgtcgtactcatgggaagcgagccaaaagtccggcctggtggttcctgtccaggctcggcgtggtggtcttntccactattgccgtcgtgagacgtgtcagtgcagtcgcctgttagtagcccttcatattgtaccattgatggcaagacgatatggcctagaggaaaatctcccaaagatagcgtagaccttgggggtagcatgaggtatggccaagcaccgactatccattaaaagagagcacatgtcactcgcagggtttcatcaaaggaatggtcagtacttatcacctgactgggaacgaggatatgctggggacgggacagtagggtagtgacnccttggcttttagacctttttcaatcaactttcagaaaagccccccgggtgcaggtacaaagggcaattgacacttatttaaaagacctggccatgattgcggaagcggaccacgcaatttccaccttgggaacgtgggttgttgacataacttgaaataaccaaggtaccgtttgctccatagtggagaattcgccaagagcacacaagaacccataacgtattccgttatcggtcgccctttgggacccatccacggggaaaccaagaggcaaagg

SEQ ID NO: 632715 - DNA, 984 bp, Homo sapiens
ggatcaacaatcatgtggcaaatcacatatgtaaactaattaaccataatatatattagggagctgactgaaatagtatgtccataatagcagtatttaaatgccaaacacgatctcatcttaggaacttccttaagctaatcatagatgatctttcatctctaaagacattgcttcttggaagttaaggttcccaacagagtaataataatgtgatcaattaatcagagggggatagctcgatatggagagtggtgtggtgatagtgtgtatgtagttaaagcaaaagattggcgggaatatactatgttgagaattagtatgtctgccaatgggaatccagtaatatttcatatatctttccactatacagatacagggaataagaataatgttccagtaaacagagtattataactagtatggtattgatctgtacatacatggagtagtactcgtgggacatttttgtgcaatttgtctcaaacatctttgggcaacctttatgtgatggtatagttcttcatgttaagaatccactgttaccattttgacgttgggagtcgtaaaaatgtttcttaccggtggggattatgagacacgaatggagctaagcaatcacttagaattcgtcgggctctctaaaaggtggtaggattgtcataaatccgtggttcgcacttgggggaattcgaccttactagattgttctagtgtgcttgtccttcacgtcattaggtgctaatttggaatgatatgtgaagctattaggtagaggcacttaatgcttgctaagccattaaagactagatgaatcttgttcttggaaagatagttatcggggaatgatgaggttaggaaggatacttctaaaactcattgaatagaggctatggttggacaacttgttccttctataaagatcaaggggagctaaatggcagttgccattggtggttggattaggaaagtgggacatatttg

SEQ ID NO: 632716 - DNA, 569 bp, Homo sapiens
  misc_feature (218)..(218): n is a, c, g, or t
  misc_feature (349)..(349): n is a, c, g, or t
  misc_feature (384)..(384): n is a, c, g, or t
  misc_feature (386)..(386): n is a, c, g, or t
  misc_feature (392)..(392): n is a, c, g, or t
atggtcatctcctgctaaagcacagcttccatcataaggtatgctccttgctcaaagagtgtggtcccaaacagcttttgggaggtcctccttgactcatggatgaaacccagaacatcttgaggactgagttaaccacaggtccttaaataactctccacacatttttcttagtttatctctacatgcagggtgtgcagcagcctgttcaaagtcanattttctgggaaatattttcagtgtttatttgcaatttagcccactctgtgtagtcttaacttatttcttctaaactcaccattaacctaaataatagtcaaatttaggggggctgtatttgtcttactcnagtcttctaccatagttgaaactgtcgtacccaancnagttanagagaaatgccacactttgagacgaattcaggagtcctttattagctggtgactgagagacggctaacacaggaaatactctcggccctaaagaatgggctagattttcttttatacattggtttagagaggggaggggggattccagctgcaataaacttacagaagaaaaaacag

SEQ ID NO: 632717 - DNA, 323 bp, Homo sapiens
ccaaaatttgctccttggaagactcctgaatgcaggtttctgatgatgtcagaaagactgtgctgttggattagacagaaaacttctaggactctaattaaaagggctgatgtggtcataaagattgctaacccagtatgaagcaaaacaagagttaattgcatggactgagctaatagaggactgaactgattcttttgtggcttttttggtttgaaacattgctgattctttttgttgttcagtgtcaaattttttttctcttgagctatttgtagcccttaacaattgagtatactcttgtaaataaaatttaaagcaga

SEQ ID NO: 632718 - DNA, 518 bp, Homo sapiens
gctgaggagaggagcgtcaacagcagcacatggctcaacagaagaaccttgaaggctatgtgggattttgccgaatctcccaaatcaagtatacagaaaatcggtgaagagaggttttgaattcacgctctatggtagtgggtgaatctggatttgggaaagtcgcacattaatcacactcattattcctcacagatatgtattctccagagtatccaggtccttctcatagaattaacaaagactgtacaggtggaacaatccacagttttaatcacagaaggtggtgttcagttgctgctcacaatagttgataccccaggatttggagatgcacgtggctcaatcagtcatctgctggcagcctgttatctgacattgatcagtaacatcttgaggactacctcaaatgcacgaatcacgaagtgacacagacgtcagatgcctgataacacgggtgcagtgtgtttatacttcattgctccttcaggacatggaccttaaaccattggatatcg

SEQ ID NO: 632719 - DNA, 400 bp, Homo sapiens
taaattcacaatctgggaatcaaaaagcgggggattctgggcaaagggtccttgggccctcccaatctcatcccgggtctgggtcccctgtttgcctaataagcctcttaaccctgagcaccaccccaacagaatctgggggaccagccccctcgcctgcctgtgtctctccccaaaccctctttagaatggggagggaaaaggaggaaaggggaggggacctggccccctctccttcaggcaatcttgggagggccctgtgcccccagtgggcattataccctttcccgtggggggcatcatcttcccgcgacacaattgtgtcacaaatctcaacacctgtgaataaacattacaagtttaacaataagtgaacaacaaaaacaaacaagagggcggc

SEQ ID NO: 632720 - DNA, 240 bp, Homo sapiens
ccctgtttacagttgcacttgtggcccctcactgtggggattgatcattctcatgaaggagtcacagttattggaattgcagaaggctgagcctcctcatgtgctataaccccttgggacactcatccagacttctctgaatcagaatacctgagctccccactcactgccctataatttatggcaaggagcaaagtccaaagcattctctcctagggggatactctataggttgaattg

SEQ ID NO: 632721 - DNA, 1064 bp, Homo sapiens
gcctgtcggccggaaccgccatcttccagtaatccggccaaaatgacgagcattcaaagggaacgaggagaggctacccgcatatatgttctcgtagcggcctatcttagaaaacgatggtcagttgtgccttatgcgccacgatatatgcgaagtctagttaacgaaacggctggatatcgtaaacactcaaggggaactggcgatactgatacagaacaggaatgccccaagaagtgttcaccatggcaaagacttggcaatgaagtctagcataggttaccccaggcagtgcatagtccgagcactgagtgagtataatcagaaaacataggctaaacgagggcaatgatggcttgaccgggacgaatttaattgtagccgtatttgacgcaccatataaggcacgtctaaaggagctcgagagaggctatcctgaatagcgtggtgatcggaacgatgatgcacgtaagacagaaacagaaggccgaaagagacaacggtgcctgggttcaagctaaagcgccagccctgatccagcccgagagaagcagcaccgtgatgttggaggaaccagatggggaacggaggctgaagctggtggaaaactattccctatggattccatgggctaataggcgtggttaccatcggaagatactaaggggacactcctggggcttacgacaaactggttgccccctgcatgtggagtaagaaagtggtggagttcccctgccccaagagaaacagttctcacacccaagggggcgtggggggcaaaatcctcagtgacgcgccgtgcaactacccagtcaggtagtccggcggaaggaaccacgctgcttctggtcaccctatccgccaagggggggcaccttataacaggccgtgggaaaagccctcaccaacaccaccacactgggagagccgcgagaggaggtaacaggtcaccagatgacatctttttcgttacgtctagagttcatctactatctcgagtcccactctacacaagaagaatgatacacccatcgcgcacaaagagaactcggagcagaacc

SEQ ID NO: 632722 - DNA, 167 bp, Homo sapiens
  misc_feature (164)..(165): n is a, c, g, or t
gaggtggtcgacggatgcgtgcaatatacacttcgcgtctacggtgacgctgcgaagggggcgcccggcgagggaccggtggaggccggcgggcccggcacggaatggctgcgcgttcggctacgcgcgcgacggtgcccgagatcgccccggtgaccgaggcnncg

SEQ ID NO: 632723 - DNA, 400 bp, Homo sapiens
  misc_feature (36)..(36): n is a, c, g, or t
  misc_feature (46)..(46): n is a, c, g, or t
  misc_feature (49)..(49): n is a, c, g, or t
  misc_feature (52)..(52): n is a, c, g, or t
  misc_feature (163)..(163): n is a, c, g, or t
  misc_feature (299)..(299): n is a, c, g, or t
  misc_feature (326)..(326): n is a, c, g, or t
  misc_feature (355)..(355): n is a, c, g, or t
ggactacccgtgcatgacaccctatctggcccttgntttttgatgntgntgntgttctttcttttttcacgtggtttcgcacttgtcacccaggctggagtgcggtggtgtgttgtcggctcactgcaacctgtctctcgggttggagtgattctcgtgtctnagtcttccgggtggctgggattgcgggcgtgtgccaccacgcctggctgatttttgtatttttagtagggacggggcttcgctatgttggtcaggctggctcgatttcctgacctcgggtgatctgccacctcggnctccaaggtgctgatattgcaggcgtnagccaccacgcccggccgcatccggtttnattgttctcacttgccgtgggaggatgtacttatcttcagatgct

SEQ ID NO: 632724 - DNA, 245 bp, Homo sapiens
  misc_feature (84)..(84): n is a, c, g, or t
ggttagatggccagctggtatcaagagatttagcatgtgaggaggggggataactggaaccaggtcctgacatttcatatcaancaaacaaagatgctagtggtacgctattgtttcaccttcattacgcatactcctttcccgcctcaggagtgattacctattgtagcctagtgcatgttaggcactcacgcctcacgcaacagtgaggacggtgacgacacctaatcgtcattgacaactag

SEQ ID NO: 632725 - DNA, 212 bp, Homo sapiens
cccccaaaaccagcctgggcaacatagttagcccccctttttataaaaaatttaaaaatttgccaggcatggtggtgcaaacctttggtcctaactactcaggaaattaaggtgggaggttccctttagcccaaaagttttaggctgcaattaactatttttatttccctaccctttagctttagcaacaaaacaaaaccctttttttgtta

SEQ ID NO: 632726 - DNA, 150 bp, Homo sapiens
atgtaggtactctgaggatcccttcgggttggggacacatgtacaaacaccccatattaaatggtgatggaagtggggactggtggttggtggagacttcaggtgctggagaaaatagatggatgatggggtggaccaataccgtctgac

SEQ ID NO: 632727 - DNA, 269 bp, Homo sapiens
gggccgctcgttgatcctctgtgggagccgctccagcagccccacgcgacgtaccggcacaggaaggacagccactcgagcagaaagcgccgggtcttctccacgccctgctgtccgagccccagtgctccaggccgtagttggtgaagagccacggcttgagcagggcgccacgggcaatcatgatcccggtgacaccagtctgcatggcgcggttggcatctcaaatgacaagatgtcccatttccgaacaggggcatggggctggc

SEQ ID NO: 632728 - DNA, 333 bp, Homo sapiens
gagagagcagtcatcgcgagccgcaccacacaggggccagtcgcaaacagtgagcgggacttcctcccgggcgcgtcctctcccacagatgcaaccgcggctgggggtcacgacccaagtgaagccaccgctaggggcaagcccataaccagagacagaagcatcaacacagttcacttgcctccacgaaggcccatctccccgagctgcccatcatgagtgcttgtcacccactcactgcaacgccacaagaagcagaatgtgccctcagcccctctaatccagcctattccaaaagggacattggcagaatgacaccaagcttggttcacc

SEQ ID NO: 632729 - DNA, 271 bp, Homo sapiens
tggtgtgacggatacaccattatttttcaaggacacaaaatatgtggggcttggatgattactagacagatgtcctgggtgataataatcacagtacagtcccaactctacccagtacttcacaattctctcagtgctttcctactggtagtctcctgtaatgacgtatcatatccgtggcaagggggggagggcaaggctccattcgtctcattttagacatgctccatcggggacggggagagcagataaccggattggcctaaagtgg

SEQ ID NO: 632730 - DNA, 877 bp, Homo sapiens
tggcacgagggctgacacggcacgcttctactatgtgttgtggcgacccttgccccgggttccccgtggtctaccgggctgcggctgccccgcgccgcaggccgggacctggtggcctagaccccgaggacctcctgagcccgtgtgtggcagctgggaccgctggctacgcggctaagcagttcgcgcgttacggtgccgctccggggtggtccccggttcgttatggccgtcgccggagcagttgtcgggatgctggaggccgaagaacgcgaatggtacccgagccttgctgaccatgcaggagtctgcttgcgggtgaagcaggctggcgaagagcagaagcgtcggggagagggagcatgcacatcgcagagtgcattggccaagatgccacagatgattgtgaactggcagcagcagtagcgtggagaactgggagaatggcccaggctgacacagtgagaggaggtgccccgactgcagtgctgaggcccaggagctcctgggctaccagtgtggacccaaggagttgcccgcttccagtgagctgctccaggacctagaagaagaaggagcgcaagctgcctcaaggaggaaaaacagaaacggaaggaaggaggcgcgagctgtgtattggcttgcagctgttggctcaagatccagacaggctctgggggcacccatgctacatgcggcttttctccctttcacaataaacgtcgtggtacctggcagttatcccttgaaagagataaacaatgaacacagtatataaaaatcatgccgaagcccggtacgatattggaggttaaccaaaaggaggcctgatatcttatttggaacagttgtgtcaaaaatatgcgggcggaaagaa

SEQ ID NO: 632731 - DNA, 1518 bp, Homo sapiens
gctaaatagaagaaatgctatacctcattatcatgcttgttggagagagatttagtcctggagttggacaggtcaatgctccagatgaaatcaagcgagagattatccatcagattgagatatcacagcctatggctccatcagtgcaattggtcaaagtcttatcacctgcacagatgcagcaacaaggagcactggcatggcagagatgtacatcgcaagccagtttgcccatttccaagaaaaccgtggattcaaccaggcacgaagggccatgtatgcaactgaaaacccagcacatgtgccaaaagagatacaaacgtagatagtcgcataatccacatttatcacagggcagcaacagaaccaagggcagaagaaagcgcacacgagaaaaattgacaaacgacacaaagtagagaagcaatacaggcacaatccacaacatccggcagatcgcacaccaaaagacatgcgacccatccaagattacagcacaaaagccccatgagaacgaaaaccaatacactcggacacaagaatccaacgacataggattcaacagcatacagacaggacaaatcacaatgagaggcacacgcacagacaatcaaggccacaaaaggagagacactaggatagaggcaaaccaagatacacaaggaggaacatacattgacccatagggatccaagaacgagtcccaacagaagcaaggcgcgaaaaaacggacggccgaggcaaacgcaaccgtcccagcacaacctacggcgaccgacctggcgagcagaacgagacacgacgacgcaacagtgaagacgacagacacacaaccaagtacacacgagaaggcaccatggaacccaaccggtggaacagagacaccacgatggacaaagaaccacaccgacatgtcacagccactacccacgccgatcccaggacacaagcaaattccatcccacaagaacgcagaggacacgaacaagaccgggccacacacagaacacattgcaggcaccagtagggcacagtaaccataagagccgcacaaggccctgggggcacagcagcggcactcgacaggaccaagaggcacgacccgcccgataccgcacagcgcaacagatccacaaacaagagacggaagacaacttgacagaagcacgaagcgagagcaaccaccatctggacaacgcaacactattctgaaacacagtggccactgtagcaccagcacaagccacagaacgagcggagcacacacgcaccaacaccagaaagcacacagacacagaccacggaacagaacaaaacgcaaagacccaacgaacagcggcaacaccacagacacacacagaggcagacgacagccaaagaacaacgacgaagcacaacaccaatagagcaccacaacagacgatgcgacaaacgaggaagacacagacaacaacgacacaacgacaaacagcccagaatcaactcgaacacaggaggcaacacaaacaaaaccacaag

SEQ ID NO: 632732 - DNA, 211 bp, Homo sapiens
agcgttgcttagagtcatacccataatgctgtgagtgtacgggttctgttcactgtgactgtaagcatttccctttgcctgtggtcaaataagatgcagctaacaattgcaaagtttttaatgcaaatgttattagagatgcaacacttctagacactttgacattttgacattcttcatcaatgtcgacgcggccgcgaatttagtagta

SEQ ID NO: 632733 - DNA, 178 bp, Homo sapiens
ctagtagagtctgctaatcacagggagcagagggccagtcttttgtgggcattctctgacgtggtacttcatccagccactgtgtttgagatgtccaggatggcatgaccatcgccaaggagggagatcttcgggccaattatgcagatcctcgaggttcaagaccactagaggaagg

SEQ ID NO: 632734 - DNA, 1356 bp, Homo sapiens
gctaaaaggtacagtcgcactacaaaagacgttgatgacatgttgtgctaccagtcctaatgtgcctacagtgttgtcatgactgtcttgaggttgctgttctggtaaattctctgtacacagggtttctgccctttagatatactgtaattatctagtcattatcgtcatgctagcctgggtaactagcggctcgcaattgatcgtaagggtgacagagatctagccaggcaggacatcatcgggccgagtatactgcacctggactatgcagtcagagtagatcaagtcacgtgggactatggagtacatgtggaatcttgagtttcatcgttcatcgcaagctgacagcgagctccctagggtgcagcatgcagggatggacattcccatgggctcatcgtgacagtcgtcctaagacgatatcagaagatgacaataggcctcgcacaatcataacaggaaatgcccacttgtgaaattggactctcccttggatcccactgcgtacttgttcaatatgcgaatgatttcgaggggtattggcaggaaatacttcttgggcgccctttccgaaccgaaacccacgctcccacggggaacgtaagtctttgcatttgctccctgttgcgtgcttttacgtcgctttgctagggcacgtttaagcacctaagcctggagattatacttatgttatctctttagacgtcctttgcagtgtgaactggcatatgaaaaactatcacttatttcatttgcaaaaccctagggtgcgacgcggaggtcaccgtgaatatgatagcccatgttgtgcaaacgggtggcagtccgatggatcttgcatacacgagcaatccatgtggcccccaggtggcatgagtcaagagaaggcaataccaataaaggccaaggaacgtgtgccaagtccggctgtcttaagtatgcccttgcgaccacacacagtgtgacggccacacgaacaaccgacacgtgctggtagaacaacttgggtgatagttaacggaaaacgggtgatgcaacttcttgtagtaaaatggaacatctgaagagctgtcatgaacgaacactcggaataggtaacagaacgtggtggacttgcttcaccgcaacgagcacctgcgtaagctatctgggagagacagacgtcgatactgatgcgcccagaccggagatacgcaggatgtgtacaagcacaagataacccctacagtaggaggcgaacacccacagacactcaggataacagcaagttctgtcagatacaatgttcctcaactcgacagagaagctatcgtgacacggctagcgcctaatactccaccatgtgaccataat

SEQ ID NO: 632735 - DNA, 633 bp, Homo sapiens
  misc_feature (4)..(4): n is a, c, g, or t
  misc_feature (8)..(8): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (159)..(159): n is a, c, g, or t
  misc_feature (554)..(554): n is a, c, g, or t
  misc_feature (587)..(587): n is a, c, g, or t
  misc_feature (615)..(615): n is a, c, g, or t
cggnggangggcccgctgaccgctctccgcgcctgggtaagtatcgggcagggcacgcggagtgaggaccggagacgcagcccccagccccagtgcccctctcctccacctgcctggcccagggcctctgccccgccgcatgagngntgnggccggggngagggcgcactgtggataggggtcccgccccgttaccctgggtgtgagctgatggatgggaaaaggggacaagccgggcgccaggctactcagggtgtgggaagcgggatggcactgaagatgagcaaggatagcacaggcagggtggacaggaggggggcagccaagacgctggacaccccagcttcagtttgtccactcgccttggcaggctgcagggagcagagactgaaacgagaaggttcccgcttcgtgcatccactttggtgtggttggggtgacgggggagttggggggggggcacacaacatggcgggaagaaattcataggggcgtaagaatgggagaggaattatagagagagacgcagtttgcgttctatgggggttttagcnaaaaagtgcagttcgggaatttcagcccaaggncaacgactttaaagaacggggttgcaanaccgaacttctatttgcg

SEQ ID NO: 632736 - DNA, 442 bp, Homo sapiens
cggtcatggaccaatacaattaaaatgtgtattagaacagtagggacgtggttcatctgttaaccagcagatcatagccagatgtgtgtccgtaaatctttggttggaccagattgtgtgaaatacttgggggaaagcagagactcttaattccccctggtgaagtataagaaatatactgaggcctgagctccacccccaggaatttttattccgtgggtctgggtattacagcgcattttccccctagtttacctatgtggttttcgtgtgcatctggtgggacccactgtcagagtgggagctgacttgtttcttcctcctggagtagggcagaggagagtgtggggcttgggaagggtgagggagcatctcccaggccctttaagggtgagccccctatattctgaagccgagacagcaaaacaaggtatgggatccc

SEQ ID NO: 632737 - DNA, 1491 bp, Homo sapiens
  misc_feature (456)..(456): n is a, c, g, or t
tggggaaagcactatctatgctcctagaaggaaatggacagctgtctgctagacatcttgttatggaataacatatagtgatgaggaacatttcgagagactgagtcagtatgacacgaacgggtgtatttctagcgatgtagtggcgaagttatgttatctcaactaattggtgattgtcagagtaggtagagccagtttgaatgaatcgacctaacatttctatagttagtgtcgccctctcgtccgtgttaccatggcgtagtctcttcgtacgaagcaataagcgacagtatggaggctcactactcatgggcgtaggccctatgatgctgtcgtctcattatgcggatctctagcatggcgatagtcaggattctgtgcgagggctctcgtggctcgtccggtgttgtgacctagtattagcgcgagatattagtacatgcgacaccactncgcatacaatgttggtactatcatatacgcacttttgttatccctacaataatagtagtagcaacaagacctggcttccataaatgctaaccaagactttataatgcatatggtattatcactaattgtcaattctcacacaacagttgcagttgttaatgtgaacgacacgagtacattttgaagagtgacttgtctgtccatttctttagagcttttatatgtgcatgaatgtattcacttgttatcgagaagctggatgttcgtccaattttacctgtacattgcgtataaactggatgtatgtggtcatacccctttttgaacactcctgtagccttatttgtgctatcctttgacggcgaaaagcttggttctcgagctaaaacctggtctgaacgacgtggtccggctggtacctgtactggtcgcgcgtatactaccgcgccgccgacttctacaataacaccaaacctaaaatcgctttaaataggtcccacggaccaaggcccccctatggtatcccaggtaccacacggcgctgtgtaacctccccttacgttcagcacactctaataggtgcgcgccgcggttgcctcgacgcgctccccggcttaagacggaaccgcctgtgagaacccctctcgaccgaaacccgggcggcctttgtcggccagggcgaccaccgccgcaaggatttctcccgccagaagcatcctccccgagacagagtgtgcccccccatccgcaaccggggccataccccgccgccagccggagcatcagacagccagcacgccctcagtcagcgtcttccaatcacaaaccaacacagaacgggcgccgccgccaagaaagaacacaccgagggagagcgaccgatgctcctacgccacgctatccaataaggcacgccccctacgcgcgccaaatcatcgcaagcccgccgcggcacgcaaccgcacgtcgcagagccccgccaggtcaagaacacctccttcgtgccagacgcaactcccaagatccgcgcgagca

SEQ ID NO: 632738 - DNA, 363 bp, Homo sapiens
  misc_feature (70)..(70): n is a, c, g, or t
  misc_feature (79)..(79): n is a, c, g, or t
  misc_feature (95)..(95): n is a, c, g, or t
  misc_feature (97)..(97): n is a, c, g, or t
  misc_feature (125)..(125): n is a, c, g, or t
  misc_feature (195)..(196): n is a, c, g, or t
  misc_feature (263)..(263): n is a, c, g, or t
  misc_feature (345)..(345): n is a, c, g, or t
gcctgcgcgctcgcagcaggaaccaggccccaggcgccggcgccggggccgcggggaggaggcgacttcnctccctgcngcgggcgcggcccggncncccgaacctcctcggcctttgaaaacancggcggcggcggcaccccgggcgcggcaatacttatatatttttttttttttcaaaagtctcctggcaannctaattaggaattctgtctggccccgatcaaaatactggagacgaaaccacgagattgatgagtttnccttgggagtcggtaagaaggtgaagccaggggcgaacatgggtcaaaaggtcactggagggatcaaaactgtggacattanggaccccacgtaaaggcc

SEQ ID NO: 632739 - DNA, 97 bp, Homo sapiens
tggttttggttacagaatgaaagtgcgtagtatttccatttggtttattttggccttatacttttagcaagccctcaataaataattattagatatg

SEQ ID NO: 632740 - DNA, 516 bp, Homo sapiens
cttcagcaaaggtcccagtagcctgtcctttccagctgagggggtgcgaatctcgtgacacaaaaggttgcttgatgacgtcccatcagtggaacctctgtctgtatgtcatagacgaccaattataatggtgacacactgaagtccacagatagagattcctgtttggacttcacctgtcggcggaacctaatgtatactgatcagttgcagcctatggggtccaacccaggttcccaaaaatgtcctgtgccactattggatctctggttgacatccagagtggggtccgctaaaggcaaacatcctgatgaacaacgcctgggctaatgcttccagattggccaccttgttacccattgcgggacttggctaaagcaagctcctgcggtaccttacctctgttgaacaccaacctcaaggttattcttttcccccccagtcattagtaactcattggattcttctccaagaatatttttttccacggcctggacactgatgatcaggagtatg

SEQ ID NO: 632741 - DNA, 998 bp, Homo sapiens
ctgctgcagtctgcagtgactgagccgtgcaccctgtgaggagacccccggaggaggcgactaaacgttctgcagtgcctgtgaaccaaccccagaccctgggtagcctgcagcatggccagctgttcctgcccctgctggcagacctggtcctggcccaggctcctgcagcgttatagcagatgttcttggaaggagacagctcagagtgacctgcagcgttttctgctgtgctgcatctgctggtgctgactggctgccactgacagggctgttgctctgagctgtgcagcccctcacacatcgccttagccacgttccacataccttgccggccaacctgcctgaccgccatgccctgtggccttgttgcattgcggctcctcactgctgtggttcaacggtgcgcacctttccgtggtacccggtggagcccgggcgacgtggcaagagggtgcttgcttgtgcttgcgcctgcttggcggacgcttgctgccagtccacacgtgtttgaacctgaatggggcccgtaacacctggagataatcacgagatagtatgacgaccatctttgcccttagccgcatcacccccaaagaccggatccagggctacaacacgtgaaccacgctcgtacaccctatgcgcacgacatttgaagactagagtgacttgataggcaacccacaaagagcaccatacaaagttgaaattcgtagtacggcacattggactttgaaagtgtatcacccaagagactacccggcgccactttcagaaactttgccaccatgcacaatctcggaacacgaccacgattggccaaattcgtgttccacacgggcttaccagaaaaagaggatcacgcatccagagtcctcatgtccgtatacataagcaccgtagacacaagcgcgtagctaccttgcccccaggctcttcaattagcctttatacagctccccatattatcatcatatgggacgatacccaccaaa

SEQ ID NO: 632742 - DNA, 360 bp, Homo sapiens
tctcattagcaaatcatctgaggtcaggagtttgagaccagcatggccaacgtggtgaaaccccgtgcctgctgaaaatacaaaaattagctgggcatggtggctcatgcctgtaattccagctactcaggaggctgagacaggagaatcgcttgaacctaggagacggaggttgcggtgagccgatatcatgccactgcactctagcgtgggcgacaagagcgagactccgtctcaaaaaattaaaaaaggaaagaaagaaaataccatatacactttttaaaatttttgttaaagtcgtgtaagcttctgtggcaaagggagggttttgttttgaacttttgtaaggtgtcatgtatt

SEQ ID NO: 632743 - DNA, 281 bp, Homo sapiens
tcttaccgccgcctgtctaccatagaacatatctctagcattaccagtattagaggcaccgccagcgcagtgacacatgtataaaggccgcagtacacctaaccgtgcaaaggtagacatagtcacttgtagattaagtaggtacctgtatgaatggctccacgagggttcagctgtctcttacttttaaccagtgaaattgacctgcccgtgacgaggctggcatgacacagcaagacgagaagaccctatgaagcttcaatttattagattcatacatt

SEQ ID NO: 632744 - DNA, 374 bp, Homo sapiens
ggaccctgtacacgtatcctgaaaactggagggccttcaaggctctcatcgctgctcagtacagcggggctcaggtccgcgtgctctccgcaccaccccacttcccatttttggccaaaccaaccgaacccctgaatttcctccgcaaatttcctgccggccaggtccctagcattttagggatgatgttggatcctgtgtgtttgagagcacgccatttcctactatgtgagcatggggagctgcggggaagtactctagagcagcagcctaggtggtgcagtagggtgagctctgctgattccgatatagtcccccagccagtacctgggtgtccccactgggtcatcatgcacacatcaaagaggccactg

SEQ ID NO: 632745 - DNA, 511 bp, Homo sapiens
  misc_feature (50)..(50): n is a, c, g, or t
cggggggggggcaaccaaaattaaagacttgggctaattgtaaaaccccnggcctacccctctacagcacaggggttaaaaagtgcgggtgtggaattcccctttggggagggcgtttatctttcggggcccaggggtttggtgtttatacaaaccccctttcgttgattaccccaaagtgccctacagagtcaaaacccaccccttcaggggccaaaaatggggatatccggggtcccgggaccaggaggctccaaaccataaaattgttttcctttccaaaacttagtaaccttgaggtataaaccctcggcgggcagaattttttatttctgaaaaagcggcctccgattggtttttggaacccagtgagcaaggtccttgggcagagaccgaatggccccccggcctcctgtaagtgagagcagctccagccacacacaggggagaaacatctccccatgcactgcagcgcatcctctttagagagagaccgcctgcaggtttcggc

SEQ ID NO: 632746 - DNA, 179 bp, Homo sapiens
cgagaattctggatcctcaattcacatttctccacgggccacactcctactcatctttcagtggcaacaggggaatgtttggtggctcccaatgtgatgtccaaacccttgtaaaaccaaaaattaccgggtgtccccaaaaacttttaaatctcacttatgtttttttaataaatatt

SEQ ID NO: 632747 - DNA, 645 bp, Homo sapiens
ggtagtaattgagcctctgcgattgccgtactgcttcctgtgaaagtcctttccgtgcggccactgtagtccttgagtgggcctttgagctggtgactttcagctggaacttgaagggaccccaaacctgagacactatggctcctgacctcagagctggggaacacagataaaagctgaaacgaggtggagcgggagcctcctgcttagcctgaactgtggacacaacgtggatgcctagatctcgatgagcttctgagggccaaaccaggatgatctccttcctatctgcatcctaccctaaagcagggacacacggtgttattcaggaattggtgggttatcattgaagctaggaatggggacgtggagaagtgcctagcgatgccatcatccaacagccggcatcctttcagttgaggtgggctcggtgacctcaatcttctggtgtggaaaaagccaaagcaagtgccctctccattggatactgaagagtcactctttcgcactcagctgttgcaccgttgtctggggaaacaacatgctgtgttccttttatgtagctcgaagtgctagaactgtatggtgttctactacatttccataggatgtgcctccatggttctgaccctggtactgggaaaa

SEQ ID NO: 632748 - DNA, 166 bp, Homo sapiens
ccttatcccccttagaatgtgtcttcaacactataaagcatttgtattgtgcattgattaagtatatatttggttgttctcaatgaagagcgacattaatatatatgtgtccttggtaattccggtagctataaaatattccatacttctaatggtagaaccgact

SEQ ID NO: 632749 - DNA, 1006 bp, Homo sapiens
tattgctccagagcgagagtgaacagatgtaattagtctagcgacaacacaaatgtctcctcgccttcactccagggcagcgtctaaccagtatgtgtataaaaagggtgtcatctatgactctgatattgggatacatcatagaatggaaagaggctgtctatttcagtttgcctggagagagtagtttcgagtagattgtgagacgatgtgagtttggtcctagccaacttgaaatagcccgaaggaagatatgcttttaactttccacatgtctacttcactacaaaacgtgtctaacaaaaccgtactcacctagggtacaatggtcttcgaaagcataaccgagattctacactaacctatctttgcatgaaccagcgctaccaaggacctctatcgagactcgaatatgattctgagctatatgaatgggcatgtcatgacccgctgttgccaatgatgaacccaccgacatttgcatcgcatgactgaatcccttagaattaacagcgaaagtcgaggagatcggctgtccagagattgacctacccctggtctgtctaatcctgaacgaaagttacctctggtccctgttcggatcctagtttcttgaagtatgtccgagccgagatgatggactcgccaaacctcaacctgccaagttctcataaaagtccctggcgtgccaaagactgaaacccgttccaacttttctacgcccatccccagaaactaggcactggtaactaccaggagtgtgatgccaacgaacaacccccggctacacgcttacaagacacatttatttccagaccagtcgcagacaagggaatctttcctaatgattgccccaggctggatattcaaacattcctggtgccgtaaggcgaatttttgccggccatcccaaaaagcgttggcgatccatccggtgtagaaaccactgtcggctgggccccaacgttttcttaaatccatttgatacattggattgggcaactta

SEQ ID NO: 632750 - DNA, 240 bp, Homo sapiens
gcgtcgacaatcaatattgatttcttaatttttataattgtggttatgaaagagaatatccttgtttttagaaaatatacactggcggggcgtggtggctcactcctgtaatcccagcactttgggaggccgaggcgggcagatcacgaggtcaggagtttgagaccagcctggccaacatggtgaaaccctgtctctactaaaaatacaaaattagctgggcatggtggcatatgcatg

SEQ ID NO: 632751 - DNA, 190 bp, Homo sapiens
  misc_feature (190)..(190): n is a, c, g, or t
tcctctcaggacttatgctcagatgcttgctagggagaaacaactggtatcccaatgtcctgtacctggcagactatgtccaaaagcaaggaaaactaaactagaacttacccagtttgcaaagaggctttcttgcagagggggtgagtctgaaaaagccaatcacattgagacacattgaatgttgagn

SEQ ID NO: 632752 - DNA, 426 bp, Homo sapiens
ggcccaggtccactgttcccgccgccttcgaaggagctggcccttaacgatttggttacctgacgtgcttggcacgcggtttcagcccaaaggacgttttggttctctggctgcaggggtcacaggaactgccccgcaaaaagttcttttcttgggcatcccggcaggagcccagccagggccccccacttttttttgttccagctattttgggggtggcagccgaggattggaaaaagggggcccccttttcttgcttggtgggccacaaggccctgccgttggcttttacacaaaagaccttcgcccgcttggcgggtaaacccccccatttcaattttttttttttcatggcggaggtgggcggcccctgttttttagccgcccccctttcccccccctttatttaattccttttttccccca

SEQ ID NO: 632753 - DNA, 237 bp, Homo sapiens
gaagtatgctgaccaaacagacccgtatataatgttaacactcttgcaggatgagacagccaagtggagataatatgctgatgaacttgcaatacgtggagctgaaatggacaagaacaagttaaaattgctgaagatgtaaaacttgaactagctttaagtacaggaccaattatacaagaacttaaacaggagtctcagaaaatccagcagcaaatggaaaatggaatggtcaga

SEQ ID NO: 632754 - DNA, 129 bp, Homo sapiens
ctcactcgcccgtttcatactctggtccaggaactgcagaaagcggcggggagccggagcctcggcgcggaagcaggtccgggagagggtgagggtaccttgaagtagccgccttcgtagagggtgtgg

SEQ ID NO: 632755 - DNA, 181 bp, Homo sapiens
gggcggctttagctcgggtacccgaagccagtctctccgcgcatacccgaacaacgtccgcgagctcctatgcgtaggtgcctcggggtctcgcacacgagacgcgcggtgcatcgtccgttcggctattggtcggcagccatagaaataccgcctgtagcgtttgcgccgcgcaattcgt

SEQ ID NO: 632756 - DNA, 1592 bp, Homo sapiens
  misc_feature (794)..(794): n is a, c, g, or t
  misc_feature (809)..(809): n is a, c, g, or t
  misc_feature (811)..(811): n is a, c, g, or t
  misc_feature (814)..(814): n is a, c, g, or t
  misc_feature (818)..(818): n is a, c, g, or t
  misc_feature (822)..(822): n is a, c, g, or t
  misc_feature (825)..(825): n is a, c, g, or t
  misc_feature (847)..(847): n is a, c, g, or t
  misc_feature (996)..(996): n is a, c, g, or t
  misc_feature (1261)..(1261): n is a, c, g, or t
  misc_feature (1394)..(1394): n is a, c, g, or t
  misc_feature (1443)..(1443): n is a, c, g, or t
attgtgcgcccgctcagtgtgctcctccgtgggtgcacccgctcgtgtcgccgccgcgtgttgtttgtgcgcccccgcctgatggtgtggagagcaccccccgggggtgtcgctgcaccgccgcgcctcttccgggagctttcttttagcccctatggcccccccgggggcgcggggttatccgccaagtgtgctgaccccgccgcggggagaccccggcttgttggtgacccgcacctttagcgacgccttatttttttaagggggtggacccacacctgcattttgagagaccacaacaagcgtgttttgttcgagccgcatcacgtgaaatgcgtgagggtccgttgtgggggtatcgccgcggtgttcgccgggagagatttctcccccccgcgggggaattataattcccgttcgcggagacccccccaccgggcggtttctcccgcggtgataacgcccgttttgtggggttggggaagcggaaccaatataaggaaaaaaggggccccacactttaaggaccggcattaggtgtggtttgaaaataaagccctgtgtcccaccaaaagaggttgtcttgtgacacccaaacggggggtattatcaaagccggttgccttgtgttgtatacccgccgcggagggggttggggagggccccccacccccagggaagaaatttggaggaactttttattgcccccctcacccaccggaggtgccacaccacgtgtcacattatatgggggagagaagagaacccacatgggtccccctcgtgaagactcntgtagacacaccgtnanatnggcntatnatntataaagagagaagtttttgtnctcgagaggggacacatcttttgagaaaggctatatttttccccccgcgcgcgcacacttcgggccacagaagaaaaacttctctcgggagagtttatataaggggcccacacatggagagagtaaaatgtctctctataaacactctntatattgcccaccagtgatgacactctcacacgagaagggagacattatataaaacacgctctgggagatttatagaagatatattgagagggcctcgagaaggtgtccccctcgcgctcggtataaagaggagaacactcgcgctcgggagaagagactcggcgtgatattttctatagagatatactctatgaacctcggggagaaaaatatattggggggctcatattcacacaacactctgcgtacacttaaatgtcctgnccagatctcacctgtgtacactctgagagagagtgggatactcagagatctcactctcactgggccacacaacacccagacctgtgtgtggccccacagcctctccacagatgtgggatagaagaaaaaactngggagtgagtgagcccaaaatgagttgaaaattggcgttaaatttttanctgtaaggtgaaggcctgtaatttgtaagtatgtactccagaatccccctgaatgttttctttatattcttcccttaaaattaaagagagttatattttgtgtttgtatttttggctggatgttataataaacatattgttactgtcca

SEQ ID NO: 632757 - DNA, 333 bp, Homo sapiens
acatgtaatgcagcacacacaatccctatgtgtcatgcgagtcacccggtagtagttaatggaatcatgggggcaggtttttcccatactgttctcgtgatagtgaatacatttcactaaatctgatggtttttataaagggcagtttcattgcacgtgctctcttgcctgctgccatggaagacatacctttttgctccttctttgccttccaccatgattctgaggcctctccagccttgtggaactgtgagtacattaaacctctttttctttataaattacccagtttccaggatttcttcatagcagtatgaaaagtaactaatacac

SEQ ID NO: 632758 - DNA, 670 bp, Homo sapiens
  misc_feature (295)..(295): n is a, c, g, or t
  misc_feature (375)..(375): n is a, c, g, or t
  misc_feature (407)..(407): n is a, c, g, or t
gatatttttaaagacctgtcttcaagttctgaaaagattttttttggagacagggacgcattgtcactcaggctggagtgcagtggcacgatcacaattcactgcaccctcagcctcacaggttcaagcaatcctaccacttcagcctcctgcgtagctgcgactacaggcatgcaccaccatgcccagccttatttttttttttgtaaaggcagggctccactatgttgcccatgtaactcctggactcaagcgatctgcttgtttcagcctcccaaaatgctggaattacagncatgaaccactgctcccaacccgaggtctgaaattctttcttctgctttatcatctaagttatcggtgaagcagtcactngcctttcttatttcattcactaaagtcttcangtctaggaaaattagatggctcttttttatgccatcacttttggggaattctcgatcatattctaaactgttgttccgagtcttttggggaggtaatccggttaccatgcctataaattaacccttttagaattaaggatttgaatttcaaggcgaacataaaattttgactggacgccgtatttgagaaataatggggtttttagagagaccaaaaataccttgcctttattgttccatgaggccttttggtgataaacgga

SEQ ID NO: 632759 - DNA, 153 bp, Homo sapiens
ctagggtcttgagctgaggcacttgatgatctcggtggtgtagcgcagcttccagcccggctgtccccgatcatctgtgaagaacagagatccacagcattgctgctggtgtcgaggtcggggggcctatgcttcccacagaactcgccaatg

SEQ ID NO: 632760 - DNA, 230 bp, Homo sapiens
  misc_feature (32)..(32): n is a, c, g, or t
tatgatcctgaccctggttaggcctagctaantgtgcgtgtccgtttttaacaaaaaagcttaaaaagtaaaaaaaaaaaatttaaaaatagaaaaaagctatagaataaagataataaaaagcatttttgtacatctatcaaatgcgtttgttttgagctaagtgttattacaaaaggaatcaaaaattaaaaaaataaaagtttattaaaggtaaaagttattaataa

SEQ ID NO: 632761 - DNA, 435 bp, Homo sapiens
agcacggaaacttaagatcaccaaaggagcacaatgatgctctagtaactgaccctaaagaaatggaaacatatagttgcctaaaaaggaattcaaataacaattctaaggaaacttagtgagatgcaagggaatacaggtagacaattcaatgaaatcagcaaacaatacttccatggcctgcacatgagcaaattcccacaaggagcacaaatctacaaaaagcaaccaaacagaccatcttcagcaactgcaagaactcaatgaatgcacataaaactcataccagggcagcttcaacctcgagcactagaatcaacacagcaaaaacatttctgaactttgaagacatctcttttgaaatcaacagaggaaccctggggcacagaacgcaatggcaccgaaccaataagatatacgcaccgatggggtacc

SEQ ID NO: 632762 - DNA, 325 bp, Homo sapiens
gaagttgcagtgagccgagatcgtgcctctgcactccagcctggcagaaagagcaagactctgtctcagaaaaaaaaaaaggaaaaatatattgcaaaaagatggtagtaaaaatgctgctaaagtttataaatgtgtcagtatgaataaaaagtggtggctgttttggtagaaccatcaaaagaaataaccaggctgttcccagcctggttatttcttttgatggttctaccaaaaggaaataaccaggctgggaacagtgcttcacgcctgtgatcccagcactttgggaagctaagataggtagatcgcttaagcccagaag

SEQ ID NO: 632763 - DNA, 307 bp, Homo sapiens
tttgcatgcagcggttccttaacagtcgatgtcaaggtccgaactggatctaccctcatcccagactggattcatggctgtcatcagcattgacacgacgggagagcctttccgtctgatctatgacaccaagggtcgctttgctgtacatcgtcttacaccttaggaggccaagtccaagtagtgcaaagtgagacagatcttggtgggcacaaaaggaatcccgtcatctggtgactcatgatgcccgcaaccgtccgctaacccgatcccctcatcaaggtagaatgataccattcagattgat

SEQ ID NO: 632764 - DNA, 322 bp, Homo sapiens
tcttaggcctcaatgtcatccaccgtcagcctggctttgtcatgtctgccgagcgatagacctcgacttgtaattcatatgctttagcagtcaggcactcttgtcccggattctcttccatggtcttgtagttagcggactgtagtcccgctcagggctagctgggctctgcttcaggtgccaatcgcggatcttcacctcccggtcagcgtttgcctcctccagggcgcgcaccttctccaggttcgaagccaggcagtctttgcggttctgcatggtcctcctctcattgccagttaggaagccgtcatcacgagcacca

SEQ ID NO: 632765 - DNA, 383 bp, Homo sapiens
  misc_feature (18)..(18): n is a, c, g, or t
  misc_feature (34)..(34): n is a, c, g, or t
cgaaaaaagctttaaaancaaacctaaagaaaanagatttcccaactacaacgttatgacccaagacacaccatccatctcttgaaagcttctactccgaccattcgcatgaaagaaatggatttccagtgtgtccgtacatccacaaaaagacttttttgcctgaaatctaatttgcgaaaagtaaagatgtataggcatctggtgtttcagcatacataactgaagcatgtgaaacagtatcatcctcgttagtagaggaaaaccaaaaccccttttttccgtcaaaattggatttgtaattaaattgtaagcctcgtaggatgtatgttggaattttaagtctttcctttggttctatgcaaataaaaaaataactgatt

SEQ ID NO: 632766 - DNA, 297 bp, Homo sapiens
ggggcagtatctctcacccagtctggagtgcaacagcgtggtctccgctcactgcaacctccacctcccagattcaaatgattctcgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtattctcgccgccgtata

SEQ ID NO: 632767 - DNA, 862 bp, Homo sapiens
  misc_feature (860)..(860): n is a, c, g, or t
gctacctcctcataaccataagataattaaaacttggcggggggggggggcgggttaaaaaaatctttttttatcagccagaggataagtgcagggtgtttaacagagtgcttcactattaaaatattttccccccaagttctcaaattattggaagaatctctaaccgagggacaccagtccctacgaagaccttgggcgatttggaaggtgcgggcacctcgattccccgaatctgtagggtggcgggtatcggtgtcccccggggttttaactagccggttggagggcacagatcattcagggggaagtataaccggaaaccagtcctctccaccggccgggggatctccacgtgttcgggagtctacagatgtgggctggtgactccaagaaagacaaactggcagatagggccaggtgccttcaaactggttttttcactgggttgaagaaactcacccaaggaaaatatatgggcggatctggtatatggggaccctataagctggctggggattttgaatcctaggcataaaatataagaatctttataactgggatatggttcctaaatgattgttaggtgtaccactgtggtccaaaaggcatggacttgcaggagggtaaggggataaaaagattctagagaggttggggactctgattgttgcaaagtggaaagttttgcggagaaaatggcgtaacggtaacgggtaatacagaaggctgaatttcgaatttggtcacattgtgggcggcgattggtaggaggagggggtatccggcacaaaaaaaaatggggggcgaattaaatgggggagaaaaattatctatggaaagggcattgttcttctctngc

SEQ ID NO: 632768 - DNA, 99 bp, Homo sapiens
  misc_feature (55)..(55): n is a, c, g, or t
gctgcgacttgttaatcaaccggtcaggctggacgtgcacgcagcccggcggagngataaagaccaccacggtctcctgacaaacacagcccctgaggg

SEQ ID NO: 632769 - DNA, 308 bp, Homo sapiens
aagtatcccaccttccaggcagatggccggccaccctcatcgcatgccacccttatagagtaaacgccgtccactatcattatctatacattaaccgtccctctacacttttcatcttcacgatccttacttccaagctgcattgctggcttccttggcgctctctccgtgtgtgtaattcttcgtaaactctatcgcatctcttacgatccagtgatccagtgatcaccttcccacattctcgtgcactcgaaacccctctcaggttttggaaagcagggttcctctgcctgcaatcaagcctggaa

SEQ ID NO: 632770 - DNA, 1651 bp, Homo sapiens
gtccttctgtagtttggtgagttggcgctcatcgcggtgcggtcgacactacatctaggtctccgtcttcccgccatgtgtgttgttggctgggcttgccccaccgcctcctcgtgttggtgcctgccactacggaccgtcggggagcacacgatctattgctcctcacagtgtgggacttgtgtctgttcgtctcccagcatccatcggtgcttcgactcgtcgtgtgtccggccatacgtcttgggataggtagttatttattcgtcgccagacatgcatcaccactgtgggggctgacatccttctacacccacaggggtcctcttacgtggcctcacctgtggtggagcggggctgcgtcggtcgttctgttctgagctagttcgtgtttttgttggagtgcagctcctttctccccaacaccgcctttgtgtgtctccccacttgtggtccctcacatttgggggagattaagagtggcgtcttattattgttgacccacgcggtgctcaccccctccctaccggggtgtggtttgttccctccccctgttggctgttccccgcctcaactgtgaagttgggggtgggggaccacccacaccgtcctcgggaggtgttttgcgctgactaggtctgttgtgcgttgctgtcttacaatacataacctacctgttcttgcggccaagcgcctcttttcccccttctgggggtgggttgagttgctccccgtggcggcgcccccgttggttgtgttctctgcctcgggggggtatgatagaacctttttgggacccccctgtgttggggcgcccttctcgcgaaagatgtggtggtggcaattggtgttctcgttgggagttctccccctcggatgagttctgttgggcgcttttcccacatggacgcaaccgctttatgtgtggagcaccacgcttgcgctattccgggccctttccccggtgttctcggtagctttttctctttccacggggcgcctgggtgcgccccccccccaggaggtctttccgcttttgggagaccccccctcttggggagcccccacattgggggagccccaggctcccacctctcgcgtgactctttacccccacgaccacttctgtcccccccccacggggtttttcgagtggaacacaggaaccctcgtgaaggccctccccagagatggtaaacacttccccacggtctttcgcctcccactttgctccactgggaggtcttgccccaccccttggtccccactcacgcaaaaccactgtttcttgcacggctcgtggggacaacagggaattttggctcaatggtgtgttgcagaaccggctcgggaaatacctctcccacccccttattcacgagtaccacagaacaccctggtgcacgcctgtctccaccctagctgcacgagtaagcttccaccaaagaggagaatcacgtggtggtgtcttctttcacccatcaagcttcctgcccctgtttcaccacaccacgcttccttctgccacactgttcccaaagggaggagcttccggcaacacttcagccacatatatcctcgaccccaccccagtgttataagaacagaacgcattttggatgttattattaagaacccaatgtccaatacc

SEQ ID NO: 632771 - DNA, 1197 bp, Homo sapiens
ggtggcctgcctgtgactccctgtggctgcctgctgctgcctgctccgcaagctgccctgctgctgctgctgcccatcccctgtgagccctgcctgctcccctgctgtgcttgctgctgtgtgccttgtctgtccccctgtgaccctctgcgctggctgtgctgcgacctgcctgtgctggtcccctggtgcccccccacggcctggccctggccggagtgcgctttactaccccggaagccattactgcctttgtacccacactctgtggcgcattgggactccaccggttatcactcgtgagtgcaacgcttgccatacaaccacctataccccatgatgtgccccatggaacaccccctttctgctgacatcgccatggccacccgatgcagatgaggacggagacacgcctctccatattgctgtggtgcagtgataacctgccagctgtgcaccggctggtcaacctacttccagcagggtgggccgggagctcgacatctacaacaacctacggcagacaccgctccacctggctgtgatcaccacattaccgtctgtggtccggctcctgggtgacagctggtgccaagacccatggacgctggagctgacatggcaagacggccagtcacatgggaggtgcgaggcaccgcagcccgcactgccttggcgagccctgcttgacagggcagatccggggcacggtttggacctggagggccgcgaattaattgactgggtcaccaggccttgcacgttgcagtgaacaccgagttgcaagacatcgtgcaggctcttgtaaacacgcggtggcggacatcgacgcagcggcaccattacacaggcggccgttcccaggtcatcagcgccgtggaaacacacgcctcgcttggtgacggtagtagatgcagcaaggggccaacggtaaacgggaaccagtactactccggcgaggagcggccccttacctacagcactctggcgaggggcctcaccgctggtagcacccgattgctcacgaccagagcagagagctaaacacggccaagagcagagcatatgtgtgccgccacaggctaaaactcatgggtagcgagcagtaactcaggagacactaaactagcaactcagctaaagagaccagaagctagaagaagacacagtaaaagagcagacaagacaactcagaag

SEQ ID NO: 632772 - DNA, 766 bp, Homo sapiens
agtgaagccgccgtgacctccggtgccgcagtatgatggtatgggaactgggaacggccgatgagcaggtgagagcgattgcgagaatgaggaggacgaacagctacaagcggggtgcgttgagtccatgccaatgacactggagccaaaaatgaggatgaaaagagaaacaaaaaaagaagaaagaagaatggcagtgagacagattcagcccaggatcaggcctgtgaacgatgaactctttgccagcagagaggatccaggaaatacaagaaggccattgagctgttctcagtgggtcagggaccttgccaaaaccatggatggagtgcatagcaaggcgaagcatagcaggattcgtggggatactgcatgcctggtccccaaagcttgtggcgaatgttggtttagaacagctcccattggcccctgtggatgcctgaacctagtgggacaattaatcctgccaggtaggcccttaaaaacctgccccaggggttcactcttggagatgcatgtgtggcactttggggcacgaatcgtgggtagtgctaagaagaaatggtacaacccctccgtgactgaagaacgtatgttggaaggattgacttacccaacagtgttgccgattgtgcattatcgcgcggagttacctatggtgtgggctcttccgagcaccgggttgtctcccccgaagtgcaatgtgaggaccgagtggcgtcagggtcggaaatggtgggccatagcgcgaccagaaaaatcatat

SEQ ID NO: 632773 - DNA, 129 bp, Homo sapiens
ggatcccccagtgtcctagccgcgccaggtggagcctgtgtgtgggggatttggggtgctgtgggcctggttatgcgctggcgaggctatgaccgctggcgaggctaggacgctggcgaggctaggacg

SEQ ID NO: 632774 - DNA, 616 bp, Homo sapiens
gctgaggcagacgaatcacttcagcccaggagtttgagaccagcttggactacatggcaaaaccctgaatctctatttaaaataaaaaaaaaataagccaggcatggttttgtctcaccgcctgtggcaaccccaaacaacgttttgtggaagaccagattgctcgtgtggactcacgtgggaccccgcaaggatggatcgaaaggattggtgaggatgaaactagtgtgcattcgaagcggagatgtcgcggcgcaagcccatgatgatggagaacaggctattgaaccactggtcttccaaacaactccgcgtggagacggaaaccgtagggcggttcctgagctcaagccgtcctgctattttccatcagaaagggttgccacaaggcggggaggcctttggaaaagcagtcagcttccgacgggccaaagagacgctatgtcctaacaatgctggggcccctccccttggcttcaaaatcactgattcattctctttcaaacgctacgtgcgatacgcgccccgatagcggaaggccacattggcactggtcacagccgagaacttcctaaaggcctgggtgagactatccaccgtctaaccgcctcaatgt

SEQ ID NO: 632775 - DNA, 246 bp, Homo sapiens
taccgatcgctcgtgagtcccctcaacctgctttttgattcctagtatcaacgtttcacggctgagaagcgtgaacagatcaaggatcctcaacaacagagtgttgcctccttcatcgacaaggtgcggttcctgcgagcagcataacaatggttctggaaacaaagtggaccctgctgcaagagctgtctagcaagactgtgaggcagacctctggagcctgttgttcgagcatgtacatcaata

SEQ ID NO: 632776 - DNA, 740 bp, Homo sapiens
gcagagactcgcgcgtggagcgtggtggggtcggctcccaaaaacccaccttctggcatggcagtgtcagcatcttccggcagttatatagccccagacttctcgggtgtgcgtggttcgagttggacagatgggagacgatgacatggacccaggtccgaccccggactgcacgcgggaacccgaatgatgcttgcactaacgccctagtctggaccctggtcacgggccttcgtgtagcatggtaagctggcacctcctgcaggggcagggctcccactcggttatgtgcacaagggagcacgtttgggctcgagctaggaaggacgcagcaggcttcgttgggtggcgaagccagcccaggatccattaccatggaaggttatctgtaccttgagagcctgaatcagaggccgtcgggaactgccctccctgcatgttgatgaagagccactttcctgccagcacatgttctgggtcttggaggtcaccccacaccccggcggatcacagctcaagccacgcggcgcacacccctcctgtcgttgtcatctgcacctaacttgttcccaccttgggagaggacgatgacttgggaggggacgcgtgaaggggagaagggggataccgtccacagtgacggggatggagggaatggacgtgggaagcgtggcacgagacgggaagcaggcgagaccgggctgaacgtgggggtcccagggatccagaatggtaccaaa

SEQ ID NO: 632777 - DNA, 1080 bp, Homo sapiens
  misc_feature (1080)..(1080): n is a, c, g, or t
gtgatgaactgttcatccttcttcaagaataagctggccaggacgggctacgtgtggctcacctgcctaataatcccagcactttgggaggccgaggcagggcggatcacaaggtcagggaattcgagacagcctgaccaaatggtgaaaccccatctctactaaaaatactaacaagttagccaggcatggtggtgcatgcctgtaatcccagctatcctcagatgctgaggctaggagaatagcttgaacctgggaggcagagggtgcagtgagccgagatcgtgccattgcactccagtctgggtcgacattctgtctcataaccaaaaaaaagaaagttggccatacatggacttgggcccaaaaatgggcggtggatcctccaatcatacctttgtgacctcgtgttttcccccaaaacaagccgggggtccacccgagatctcttcacaaaacctaaaaataccagagaggcgggggaccgcaacaaaaaattacctccctctgggggcgaccagaatttatgtggcgcccccacgaattctctgtgggaacgaccggggcccccctaatagaggaggcgcgaattaataacgaagaggacaggtgcccagctccgttaaaaaccaaaggtccgccgtgggaaaaacaccggggaactcttggggaatccgtggtcaacggaccctaactccttggtgcgggggtgcgcccttggctgcgacaacctttcctccccgagagttttacagcgcctcagcgcggaatatatgaaacttcaagggggtgcaggggtgcaagcccaccgcgcattatgctgaccgcgtagaaaagctcccgacccggggtagcgtgtcggagacattcttcccacggcctatgccgtcataccctactatccatcactcggccaacagacaaactcgggcaacactccctgaagcctccacatgctaccagatacacgccctacggccaattagccatacctggaccccacacggtcataatccgacactacacagcgtcgaaccacagcaccaaatagcccacgtctatgctacacgactcgcagan

SEQ ID NO: 632778 - DNA, 1427 bp, Homo sapiens
  misc_feature (180)..(180): n is a, c, g, or t
  misc_feature (465)..(465): n is a, c, g, or t
gaatgggtgcgcaccaggaagacaggggctgtgtcaatccctcgccccctctatacttaattccccgtgccctaaaggtttacaccgagatcctctgtgtgggcccacaatattcccgcaccacccagagatgctgccactgccccaatgtattccccagagaaaggggagaaaattctnttgtccggctgagaggggtcaatttctttatcaaaaatcgctgtggaagcgtgaaaaaggggaaggttgtttctttaactttccgggagaagcttgggtgtctgtaaagagagaggggcataatctttctggggaacttttgagagagtatgtccggaaagtgtaacacacgcccgcaatcccagcggtcatccacgcgagattccgatgtattattacgtttagtgcccccccccgcgagggaccaccccacagcgagagtaggtgttttcctactgtgtgganaagaataaagggctccccgcccgcgaatttctttcgcgcgggaaacctcgggagcgtcggcccctcgtggagggtttcccaacgcaaaagagacgggttttttgggccttcttttcccccacgagagggcgaacacactgttataggggcgctttttattatgccctggagaaatatagggtgggccccccacctaaggagagggtttctcgtgtggtgcccacactgtggggccccacggcccacgaggggtgtctctctgggcgcggttagcacacaactctcctatgcgaaggggcctcctttcttgttgcgcgaagggcctcgtcctatatggtgatgctcccggtttcactccacatcggaagaagtggggccccacaaggctcgtcgcaaggttttggtttttctcggggaaaaactcccgcaaggaccacacgagggtctataaatcccactgagaagtgtttgttgtgagtgggctcctcgagtgagatcccctcgccgcgaggagcccctcggtttatagactatactaacgctgtgagacacctcggctctgtggcgcccacacgctggtttggctctcacagacacacgcggttgtttttctcgggccactcacaacagagtgtaaagaatcactgtctgagccctcgggagaccccacactcggtataagagattggcgcctatagagagcccctcgtcctgagaccaccctgaggcacattgtggaaaccccaaagaatgaagaatatctgcccacccaccccccactttcacgaaccacaaaaggggtgggaaaccacgaagccccctgccacatgccccacgccacgtccccaccacgcattaccacgggtctccttggcacgctgtattttctggaggttctggaatgttgctcttttaagaccctttaattaaattttgtaccaagactacaaaaaagaaaaaaa

SEQ ID NO: 632779 - DNA, 530 bp, Homo sapiens
gatcttgagtggggccccagcaattcggttgagccttctccctccactcgcttccgccggccgggcgtgccgaagaagagaaaaaacagagaaagaaaataaaaaaaaataagaacatggacaagaaaagcaaggagtacagctgtaaggcggcggccaccatcagacgagagaacacatagagcagagcgacacaaaacaaacacacagaaagaacaaagaacagacagaaggagaagaaaaaacaaaaaaagaaaacaaaagcaaaaagaccacaaaagaacacaaacaaatcagacgcacaaagagcaaacacaaaaaagcaagcaacagaactcaacagaagaaacgcgaacaacacaggcagcagagaacaaaacacaaaagacagaagaaacaaggcgagaaacaacaagagagaacacagaaatgagaacaaaagaacgagagaaaccccaccaacaaaaccaaaccacacacaaaacaaggcactaatgacatagcgaacgaaatacaagaccaaataacaa

SEQ ID NO: 632780 - DNA, 138 bp, Homo sapiens
gtatactaggcagattcagggagttatacatgtatatgatcccaatgtggtcatcagatataatattcttcaaatatacttcccttaccaaaatcaaagaattttcacattagctcacatcaaagcaaaatttttctt

SEQ ID NO: 632781 - DNA, 1755 bp, Homo sapiens
tccatcacttctgcaatcactcccacaaatacagtgacttctatgacaactatgacctctcctcctacaaccaccaattgttttacatcactgagcagtaagattctgtcttccacacctgtcccaagcacagaagcaatcatcagtggcaccacaaacacaatccctccgtctaccttggtgaccacactccctactccaaatgcctcgtctatgactacgtctgagaccacctatcctaattctccgactggtcctgttacaaactccatgagcaagatctcctatcccgccagtatgacacagacatcatccactgcaacctctcttccccccaactctccctggggctcaaccacagaaatagccaaaagtcctaccacaaacttggtaacaaatgccatcaaggccacctcacatactaccaccacctacacttcttcaaccatctacttcacagccagcacatacacaagtgccatgacctcagtttccttgggtactatggtgacttctacatccatgaccccatctactgtgagtacgagtatccctacctcacaaccaaaaaccgtcaattcctcatctgggggcatcactggttcattacctatgatgacagaccttacctcagggtacaccgtctccagtatgtctgcaattcccacaactgtcattcctacatctctcactgtccagaatacagaaacctcaatctttgtcagcatgacctctgccaccactcccagtgggagaccaactttcacaagtactgtgaacactcccacaaggtccctcctgacaagctttccaacgacacatttattctcttcttccatgtctgaaagcagtgctgggaccactcacacagagagtatctcctcacctccagccaccaccagtacactccacacaacagctgaatccaccccgtcgtgcactaccaccacgtcattcatcacatccacaactatggaaccactttcaaccattgtagcaacgacaggcacagttaagaccaccgtcaccagctccacagccacattccgggagaccaccacactgacttctacaactgacatctccacagaatctctcatgacagcaatgacttctactacccgactcacttctgcaatcacttccaagactacattgacttctttgaagactactgcctcccggcccacagccaatagtacgttatcatcactcaccagtagcattttgtcttccacacttgtccccagcacagacatgatcactagtcataccacaaaccttacccgttcatctcccttgcttgccacactccctactaccatcaccaggtctacacctacatctgagaccacataccctacttctcctaccagcacagtgaaaggctccacgaccagcatcaggtattccacaagtatgacaggtacattgtctatggagacttctctcccacccacctcttcctctctcccaaccacagaaacagccacgactcctaccacaaatttggtaaccactgagataacatcccacagtactcccagcttctcttcttcaaccatccactccacagtcagcacacccacaactgtcgtctcctcaggtccccctacctcaggtaccatagtgacttccataaccgtgactccatcttctctgagtacagacatccctttgacaacaccaacaactatcactcaccattccgtcggctctactgaatccttgcttacagcaactgacctcacatca

SEQ ID NO: 632782 - DNA, 308 bp, Homo sapiens
  misc_feature (78)..(78): n is a, c, g, or t
ggggggggggggggggggggggggaggaaataatttttgttgggtaaaaaaggaaaaacccagggggttttgcccctnggggggcccccccggtaaaaggttttcccttttgggccatttggggggggaaagtcctcccccccagggggcttttttgggccgggttttttttctaggggggcctttcggggcccgttttttcccttcgggggccttttgggcttttattttttttttttttggggaaaaaaccccaaaaaattaattttgggaaatttccccccctttggaaaattttttttggggga

SEQ ID NO: 632783 - DNA, 853 bp, Homo sapiens
gtggtgtgctttatgggagggcccagcttatgtcggctgctatgggccccgacctggagacggggactcgggcagcggtagtacctggcgctgcctccgcgcttcctgctcccggctcccactgcatctccggttctgtgctttgttgaacgcgtgagcttcgggcaagcgctggagccgcttcagtcgtgagctcgcaaggaccactggactggagttccactggctgctggtcccccatctgtgaggcgccccggcggctgaggcgtgtgaaccaggcgagtgcatgtcgaggagtagcacccacgagttgcgcggctgtcgaactgatccagagacgagatacctgtaagcgggaggatgcctgtcacataccaagacgaggcgaatgtgtagtccgaggcttgtcagattccagggatcaacccgtgcatgaaagtcactttgttaagatcatctggcgggcattagcgcccaagtgagcaatctggagggcaagaaagtgtgcttgattaaaaaataaactgttgaggcaccacaagtcgcgccttcgtccttgagggaattcgggacgccccaagcgcgctggtggacccttcttattgggaagccgatggtcccccaaagtgggccttttggagaggagagcccggggggaattcccccgggggagaggcctcttagaatgcccctgggagccctggtgtggctcagatggcctcataccccatagggtcatagttacgaagaaaagacaacgtacaaggtgagaccattgaaacactatggagagtatagaccctaacggccgaggcccggtcccttagactcagactaggccagaatattcacg

SEQ ID NO: 632784 - DNA, 314 bp, Homo sapiens
acggattgagcttgcatccgtattgggctgagccacagtacggcccatggctgttacccatgattttagatcctgagcactgatgtcaaggaaaatctgggtgttgaatcccagttccatcatctgcccttagggaagtgacttcaccattccgagcctctgtttccccatctgtaagtgggttaaccattgctgtgagctcatggggttactgtgaaggtttcataagctaatgtaaagcttcataccattcaaggcatgaaggaaactctccataagttataactacattgatgtcatcacagactcattat

SEQ ID NO: 632785 - DNA, 956 bp, Homo sapiens
gggcggcggggatagtggcttctcgcaaactccgtgacctacgtgagcccggcgatctgacaggctccaactacccgggactcaatattagccttcatctcgactggctcctctgcacaagagggaggcttccggagtagtccctcgggtgagaggccccatgaccgacaggctatgaaggtcccttcgatgtgacgtctgcggcagaagacatggttctgcgaatggtccagcgtcaatcggcccaacaagaggaactgcccatgaaacaaggtctatctgagagtaggacgatcggtgatgatgctgcgttcaacctaacgatctatcgagacgcactgcttgacctgtcaggcgtccgcgtgtggtgcactcctcatggctcgcagggatacaacatgttcactgcaaggtattgaccctgatggacatggcttcgtgagatcctgctaggccaaacggagatgaacgtggcccggtactcagagctgggtatcctaccgtgaaacatcactcactcgataccatggagacctatcaaacgtcaatcgagaggtgccccaaggcccgtgatcgctgccgtccatgggggctgcacttggcggaggtgtggaccttgtcaccggctgtgacatccggtactgtgcccaggatgctttcttccaggtgaaaggcggtggaccgtgggtataggatggcctgatgtagggaacagctgcatgcgcctgcgcaaggtcatcggtgaaccatgagcctggtcaacgagctggccttcaccgaccggcaagatgatggctgacagaagcgccctgggatagtgggtctggtcagcaggggtgttcccaagaacaaacgaggtcatgctggatgcttgcctttaagcgctgggcgggctgagatttccaagcaagagccccgtggcggtgcacaaacacaaaggtcacctggtgtattcc

SEQ ID NO: 632786 - DNA, 167 bp, Homo sapiens
tttttttgagacggagtttgtcacttgtcacccaggctggcatggaatggtgcgatcctgggtactgcaacccccacttcccaggttcaggatattctcttgctcagcctccctccggggtggctggaataacaggaccaacaacaaggagggttaatttttggtcg

SEQ ID NO: 632787 - DNA, 441 bp, Homo sapiens
cacttatttatataaacattaaaggtaaaaccatttacaaatgtaaaaatcaatcttagcttggaaataaaggaagctggctgggtttggcccatgggtcttagtttgctgagccctggactaccatctttttgctgacagaaacaatattttggatataattgaagccctcattatacccctccctgatctcatttctcttcctcactcgtcaaaggtaattattgtcctaaagttactgtgtatcattcccacttttcaaacatgtctatgtccctaagcaatatatagcgtaattttggttgtttaaacatgtttaaataagtataattattctatgcatagtaatcctttttttcttttttttttcccaccccgcttctgcataataattttatttacttctttatttgttttgagacagaatctcaaaaaaaaaaa

SEQ ID NO: 632788 - DNA, 204 bp, Homo sapiens
ctctcggggacctttaactgagacaaggactgggagactcggtcacgacgtaaatatcggaatagtttgacttcatcttgaacttcccgttcaaccccccactagacaactctgacatactcgagtagatccgagaggacttctgacaaagggtttcatcataaagacatattgactatacggtaccgaatcctccttccttaa

SEQ ID NO: 632789 - DNA, 99 bp, Homo sapiens
ttcccctggtaatccccagcccatacacagtgggcttcttggtggaggctggcacttggtcccaaaggcccctgggttcacccttaacaaacaaccaag

SEQ ID NO: 632790 - DNA, 473 bp, Homo sapiens
aatacctattgaaaaagatatacattatacatagtacagatacagtaaagtaaaagttttgagtttgctaagtcagatctaatatcttgacttgtagcatcaataaaattcagtactgatcccataacaagtacaggcacgggtcaacaattcagtgccctgcaatacagctgtccctgcaatgtcaatggataggattttctaatgacctgatcacattaccaaaccatgattcaggggcaagagaaggtgtgtatgtgatgactgagacagagtatactatatacagcagtgctcttctatataatgtactgagagggccaaggcagaaggatcgcttgaggcctggaggtccggaccagcctaaacagacaaggccacgaatctcaatctccactaaaattgtaaatgagatatagtaaaattttaagctgagcttagtgtgagtggcactgggtccgacgttttacgct

SEQ ID NO: 632791 - DNA, 119 bp, Homo sapiens
atgcatgatacccaggagagggacatggtgaaccagaggaaaacacaataggtatcaacttagagactttgggtaagcctccattgaccttctcccctccaaccccaataccaggaaca

SEQ ID NO: 632792 - DNA, 167 bp, Homo sapiens
acagtagccctggcgtacgcttaagcgctaacattacgcaggccacctactcatgcagctaattggaagtgccaccctagcaatatcaagctattaacctaccctctacacttatcatcttcacaattctaattctactgactatccttgaaatggtcgccaatccg

SEQ ID NO: 632793 - DNA, 160 bp, Homo sapiens
aaaagaaaaaagggaatatctggatttcctgggcgaggaggagcgagtcttctcgggagctgttccagcagagcgattttttaaatactgctttctacggcctatacaaacttggcttcacaaaacctttacactaactcttatatgatttttaaaaaac

SEQ ID NO: 632794 - DNA, 585 bp, Homo sapiens
ttttgagacagaatctcactgtgtcgcccaggctggagtgcagtggcataatctcggcttgctgcaacctccacctcctgggttcaagtaattcttgtgcctcagcctcccaagtagctgggattacaggcgtgcgccaccagcccagctaatttttgtatttttagtagagatggggtttcaccatattggccaggctggtctcgaactcccgacctcaggtgatccgcccagcttggcctcccaaagtgctgggattataggcatgagccactatgcccagcctaaatatggattgatattatctatcaatattactttggggtgttttaacggtattgaacttatgcagaatgtctttgtttcttaggaaatacgtgctgaaatacttagggtaaagtatcacagtatcaacaacttcctatcaaaatagttctgtaaaaacgtaaacagcaaaagttaaaaattggtgaatgtaagtaaaacttatgagtaattatgtactactcgttcaacttctgtcttttgaaatttctcaaaacaagctgagggaaaaaaaaggaaatgcaactatttcaacgtcga

SEQ ID NO: 632795 - DNA, 971 bp, Homo sapiens
gaacatgcctaatctgtatcaagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcaagtatggatgaggagtgaagagattgcaacactccacagcaacccctcccaaaaaggagaccaaggcagagaccaaatggaagaagatcttccagagaataagaagcaggcactgaaagaaaaaagagctggggaacagaatgctaccaagaagaaagacaagacacagacttgaagcctaacgacaacagccaaggagctggacccaataacatgactaacataaacaatacaagcagaggaatactttgaaaagggcgacatacaactaaagtgccgggaagcaagagtgacgaaggacacagaaagatggggagagaaaacacgggaaagaatatacgacagaatgacaacagcaacatgctacgaataggcagaaccaactagcaaagaaaaaaaaggtacaaggaatgcacatccaagaatgtaacaaagtctacggacagagcaccgaaacccaagatatgagacaagaaatggcgagcaggaagagaaacacccgaaggaggacagacgggacggacgtacataaacccgacaggagtcggccgagagaacaaagggaaaacggaacagaaagggaacacaggcagaaaagaacgaagcccacaagaaccggaagaagcacaacacgacgaaacgaggacgaagcgaggcagaggacaagaaggaaagacagcgaccaaaagaacgaaacgacaaaaggaaccggagacaggaaacacaaagcagagaatagaaaacaaaaagccgacggacgaaaacacacacaggccgggcaagacaac

SEQ ID NO: 632796 - DNA, 195 bp, Homo sapiens
gcccagaggattcgtctgtctgctgagattatgatggtagttctggttttgtagagaatctatagtcagagaagcaggtcctgagtctaattatgatcttgtttttggtataccttatgtttaaaagccaagcaaattaaggatgtgagcaggaagtatgaaaaagccattccatcttttctccccgggatacag

SEQ ID NO: 632797 - DNA, 252 bp, Homo sapiens
atcgccatcatgaacgacaccgtgactatccgcactaggaagttcatgaccaaccgactacttcagaggtaacaaatggtcattgatgtccttcacccgggaggcgacaattcctgagacaggaattcggggaaaactaagcccaaaatgtaccaaaaccacaccgatgtccatcttgtaatttgggattcagacctcatttggtggtggcaagcaactggctttggcatgatttatgattccctggattat

SEQ ID NO: 632798 - DNA, 581 bp, Homo sapiens
  misc_feature (533)..(533): n is a, c, g, or t
tttttttgcttcagagacggatctaattgatttgtaacttataaaatctcaattcggactggattcagacttaaaagttaaagcttgcaaagaggaaagtctgcgtcttttcgcaattggatcctggcgcttttccttagcctccttcattctctgggccaaaagtttaacatattctgcagcctctgctttattttccttggtacgctgcttcttcagagcaatacgccgccgtttgtgctgcatgacacggggagaaacaagacgctgaatcttgggagcttgggtcctaggttttttaccttctttattcaagggctttcttacaacatactggagacataattttctttagagagattgaaaaggtggcggattatgctagctcttttggggcccaggcgccgaggcactgtcctataaatcagaccaggaatatccgtaactgctttttttacaataaccaaggtgagaacgctaagatttgcttccacaatgcaccacgaactgattttcgttttctttctccaganctccttggaatgcaacaggaatgccccttctcagaatcaggcggacac

SEQ ID NO: 632799 - DNA, 994 bp, Homo sapiens
  misc_feature (720)..(720): n is a, c, g, or t
ggagagaactagtctcgagttttttgggggtttttttggctggtctagtcatcctcgtgggtcttctgcttctgggtttcgacttcgtcttcctcatcatcttcagctgcccgtttgcccgtagtctgactcagccttcctcatcttcatctccatcctctttcctcaccatcaccttcttcttcctcctccttttcctccccacctttcttcctcttcttcgtctacctcattgtcagcctcctgtggctccccattttcctcattagcatttcccgttagcaggggcgtctcttccattttctgcctcttccacaatttccttcgttctccttaaagtcctggggggggattccggagcgtgggtgtcatacggctgcgtctgacattgggggggcacgccggttgatccgagtgcaggggatttaacaaacgaaagcgaaagttcagggactcgggcgaataaagctgccggagttccgcggcggcggaggaggcgcgcggaggaggcaactgcggcgggcaaggaggcggggaggggtgaataggctcacgggggccataccgggggcagtgccacccggagatgacacggcgctctcaagcaccgaagcaaaaccttgagattttgcacacgggggagggaaaaaagaaccaaaatttccaagggccctgcttttgtccttaaaagtcctttaaaacggacactcggtggacttncaattaccctctaatatctgggacatatggtagcgtcagccattttaaggacctcggatgaccaaccacgctcggagggtactctgaccaaacttctggatttactgtgtggtgttgacgcctgttcattaatatctccagagggagaaaaaactttttgtaaaaaggcaaattgtgcaaggaaaaacagttttttccagagatcccaggactttcggggattgactagatggccaaaagaagggctcgttaaacttgtgaacgggcacatata

SEQ ID NO: 632800 - DNA, 710 bp, Homo sapiens
gcttcgttgcgacagtgccagtgatagtggcttttattcatgttgagagcatatttcctccaaacctcacagcaactcaaacacactggaatctgaaggcaggagtccaattttcactcatcttgtcacaagcttaaagaggactatggacacttcgtgccttcggacggcagccttacatttgaaactctgttccacaaaagctctgaatttacgatactggccaaacgtgggttctgtgtacctggtcaacactgcgctggttccaaatgagaatagaacatgatttctgtcatctctcttcattgcttgttaccttcatttccattgtaacaacaggagcaaggagaaggaagagttggtaattatgctgatcattctagagcatgaaagtattcattgagtcacattggcaagtggcgctcgtacagaccgtccaggcactacgatgtggatagcttgatgcgagtctgtgagccgagtctttaagttcattgacatgccaacagaaggtaaatctaccgaagtgcaagcaaaccatagcgagaatgagccaagtctcgagaagttaatgattattgagaattcacacgtgaagaaagatgacatctggccctcagggggccaaatgactgtcaaagatctcacaggaaaatacacagaaggtggaaatgccatattagagaacatttccttctcaataagtccgg

SEQ ID NO: 632801 - DNA, 409 bp, Homo sapiens
  misc_feature (307)..(307): n is a, c, g, or t
  misc_feature (340)..(340): n is a, c, g, or t
  misc_feature (372)..(372): n is a, c, g, or t
  misc_feature (406)..(406): n is a, c, g, or t
cggagtttcgctcttgttgcccaggctggagtgcaatggtgcgatctcggctcaccgcaacctccgcctcccaggttcaagcgattcttctacctcagcctccctagtagctgggattacaggcatgtgccaccacgcctagctgattttgtatttttagtagagacagggtttctccatgtttgtcaggctggtcttgaactcccgacctcaggtgatccacccgcctcggcctcccaaagtgctgggattacaggaatgagccactgcacccggccagttctggcatttcttaagagaatctttntgagaagatgtagatattggcttcataataatnaaagtgaatttgtggtattaaattaaatgganaaaaagacaaacggtacaaattaaaagtttcttnagt

SEQ ID NO: 632802 - DNA, 244 bp, Homo sapiens
cggttcttgaatgagtcagtctccagcttaatttttccctttggcctagatgaatttgggggccctgcaaattgtattattctttcacaatggtatggcggggtttcaacatgttggctaggctgatctcaaactcctgacctcaggtgatcctcttgctttgacctcccaaggtgctggtattacaggtgtgagccaatgcgcccagccaaaaaagacattttcttacacaaccacaatacca

SEQ ID NO: 632803 - DNA, 716 bp, Homo sapiens
caatgggtcccgagggcccccagcaaactcgcaagcatcctaccggagacacagctgtacatgagtcacgagagccgctgtcacgcaagaagccagtctgagcctcggactccctagcgcactgggagagggcacgcgggaacgaggagccctggggtcccattcgggaaggacctccacgccctcactgctgaggcctctgacggctgccttggaccgtccacttcaccagactgcaagtccctgagcgagcttcagaatccaacgagtgccatggtgagcgactagtcccgagggcagcccagcactgagccccagctgaggaacagcatgggcagtgccagccccacctgccaggggccactggacaccgtgccacctttcttcaacaagagtcccgccaatccaggctacctttaccagagaacgcgtacccacccagccagggttgctctcggggaagatctcgtcgtgctcacccttagctttctgaccttggcagcacgggctgcggaagaaagcacgtctgggcacaggaggcagcgggtgcccaagcacacagggagcccctggggaagcatgctccattcttctggtgaccttaggcgctccttcactcatctcgcctgccccctcaggaactggtggcccagcttccacacccccacctcccagtctctagcctctccatctgtttacatcggcggcagtactcc

SEQ ID NO: 632804 - DNA, 637 bp, Homo sapiens
aggcagggtctcactctgtggttcaggctggaatgtagtggcatgatcacagatcactgcagccttgaactcatgggctcaagtgatcctcctgcctcagccttctgagtagctgggactttaggtgcacaccaccaggtctggctaatttttttttttttttaagagatggagtctcactatgttgcccaggctggtctcaaactcctgggctcaagtgatcctcccgcctaggcctctcaatgtattgagattacagatgtaagccaccttgcccagccctaaattttttttcttatgttaaaatacacaaaaatgtaccatcctaaccatgtttaagtgtgcaattcagtggtgtgaagtacattcacattgttatgtagccatcactactatccatcccctgaacttttaaaaaagtcatcccaaacagaaagtctatacccattaaacactaactctctattctcccctaccaccagcccctggaaactactttctgtctccatgaatttacctattctaggttcttcacatacatggaatcatatatttgtgcttctgtgactggcttatttcacttagtataaaggttctcaagggtcatctatgttggaccatatttaagaattgccct

SEQ ID NO: 632805 - DNA, 529 bp, Homo sapiens
  misc_feature (36)..(36): n is a, c, g, or t
  misc_feature (289)..(289): n is a, c, g, or t
  misc_feature (309)..(309): n is a, c, g, or t
  misc_feature (323)..(323): n is a, c, g, or t
  misc_feature (338)..(338): n is a, c, g, or t
  misc_feature (401)..(401): n is a, c, g, or t
  misc_feature (440)..(440): n is a, c, g, or t
  misc_feature (477)..(477): n is a, c, g, or t
  misc_feature (485)..(485): n is a, c, g, or t
  misc_feature (502)..(502): n is a, c, g, or t
atatggcagaaaagcaaaagagaaggaacccattcntgcaagccctttttataatggcattaatccattaaacatccccattaggctccacctcccagtaacattgtactgggcactaagtgtcaacatcaaatttagagaagacaaaagcactcaaaccacagcgactgtacacctgaaaactactaaagagtatatctgaaacattttcaccacaagaaagtgatgagtagatgaagtgatgaatatgtaaattagcttgatttaatcattccctcatgcatacatntatcaaacatcccatttggnctcataaatttccncaatttttatcttgncacctaaaaggaaggtaaaaaggttttttttccaaaaaagaaagaagaatggtaagaatggcnagtttggctggggttccagtgagaatgtcataggaccgngaggggcattttgactggcccttagtttgggaagagnaacccatnggggaatttaaagcaanaaaagggggcccgattttacttttttt

SEQ ID NO: 632806 - DNA, 337 bp, Homo sapiens
gaggatcccttcagcacataaggtctaaggggactcatctcatccccttatccttctccctcgaattttctccctctttcttcccaggaggccaaagccaagggcagcagatcagtaaagaaggtggtcagagtagaacccctgaagtatcttataatcctacctcaaaatttaacagttacctgagagatttaccatgatctagtgcatggaatcatggtatgtgggcatggctaggtagcacaccttggaatgcgctttctagaggaaatcaaatgactggaggacctttccaaagagcactttactggtgttatatagccaatataactatgtc

SEQ ID NO: 632807 - DNA, 358 bp, Homo sapiens
  misc_feature (6)..(6): n is a, c, g, or t
catggnggttctggagcatgacaggatgaggaatactgggacaggtagagtagcaactctgtgtagagtgattttatgttaatccagtcacagccactcaagtagacagaggaaggagagaacgtggctaggtaagaattgaggttatgaggggtcactgttcaggaagctgtggatctcagatccagtgtgcagtctgaacagtgagtgttgagtgtgaggggtctgtttatccaaaagtactagtactgaatctatggaactgagattcacagtctctgaatgaaggagggatactgaatatagtttttataaggcaatataaaaaggtgtacaatattgaagtttgtattgcttc

SEQ ID NO: 632808 - DNA, 165 bp, Homo sapiens
ctaatactgcacaaacactggtgtacaaatatcactttgagtccctgctttcaattcttttgggtatattcctagaagtggaactgcgggatcatatgataactaagtttttgaggaaccaccacattgttttcaacaggtggtatagggtggtatagggtggta

SEQ ID NO: 632809 - DNA, 242 bp, Homo sapiens
cgcgtaatagtagctagtgatatgtatccagataaccagatgtatttctgcaaatgagcatataatattcgtcatgtcgattagctgtactatctacatacacattgtatactactatatctgatagatgattctagaggttaacattgagaaccatctcaaaaataattacaaagttttagatacggttaacaactgtctatctacaacaatgtaatctaaaaaataatatgcgtacagat

SEQ ID NO: 632810 - DNA, 339 bp, Homo sapiens
ggtaatagtcttcgatctccgcccttcagttaacaattcatggactcattgcactagctatctactaatttcagtacatccttcccaaatgcttgtacataagtccccatattagtccatgcagcacaagctagtactcgcatctgtgtgtatcctcatctccgagcaatgtggtcaatgaaaggacagaataaattctactctgggttgtaccagtatcagatccgggtgtacgtgctcctgatccccctttaatccctggacgattccagtataggcttccaagcagctttcccttagctcattcagataatccaccatgtcatagtctgacttgtc

SEQ ID NO: 632811 - DNA, 357 bp, Homo sapiens
  misc_feature (292)..(292): n is a, c, g, or t
  misc_feature (294)..(294): n is a, c, g, or t
cggagtctcactctgttgcccaggctggagtgcagtggcatgatctcggctcactgcaacctccgcttcctgagttcaagcaattctccttcctcagcctcccaagtaggtgggattacaggcatgcgccaccatgcctggctaatttttgtatatttagtagaggcggggtttcaccatgttggccaggctggtctcgaacttctggcatcaagtgatccacctgcctccgcctcccaaagtgctgggattacaggcatgagccaccgtgtccagccaacaactaaatagnanttaagttgtatttatactcaggttctcttcgtccttctttcatcccttcaatatgtatcacag

SEQ ID NO: 632812 - DNA, 239 bp, Homo sapiens
tatttgttgcccccaggggtccaaaatagggttggaaaaaaagcccgtgttttttttggcatttttcccccccctaaaccctccggggtttttttaaaacggtttttcagccaggggtttttaagggggtgggacccctttactttttcaggtagggggggactcagcccatgctgcccccttacattttttttggaacggggggggggttaattattaaattttttttattttgccga

SEQ ID NO: 632813 - DNA, 965 bp, Homo sapiens
tcaggaggtcttcaagaccatcctaacagtgaaaccccatctctactaaatactacataaaagttagctgggcgtggtggcgggcgcctgtagtccaggtacttgggaggctgaggcaggagaatcacttgggcccaggaggtggagcttgcgtgagccaagatcggccacatgcactccagccgtggacaaacggggggtgacgacatccgtctcaaaacaaaaagacaaagaaaaagacacaatacttcaaacaatataaggtccacataggacaaaaaaatacataatcataagcacatacaaggaaaaccgggcgagcccaaggcacagggaccaccccaacggacagggaagggaaagggcgaaacgaggaggcaccatcagggcaccccctggcaaacaatccgaggagacataagagcacgaaccctcacggtgaccaacagcaaggcccgacagtgacaggatggcacctggacaacatgaacacgacgcgggtggcagacacacaccaacaccgggcgcaaacacatcagggacacttaaaccacggacgaagtggcgagctcaccaaccaaactgatgggacccagggcccggcgatccaacaagaacaagccagggggcacacaacacgaaagatcgacgcgccaaaccctacaaggacatatcaccgacaaaaggacagacaagcgcactggaccacacttcggacagacacaacaaagcagcgtcacacacagggtcgaccacacgcgaggacaccggcaacaaagccttgaaacaacgaagcgacctggggtaaaaaggaccaaccaccccactaccaagaaagcaggcgacgggcgatagccactcacacacactaggagacaccacgcagcacacccatgcagaaccagcggccacaccacggcgaacacaacggagacgggaacaaaccacagagcagaaagcccacg

SEQ ID NO: 632814 - DNA, 261 bp, Homo sapiens
tcgctctagaggatacaacttatgccctgacccacccggtagtgtctgtcatttcgcgctgcttagaaaagtacttgagctccactccgcagcgtctgaaggtgctggtcgcgaacctgcagtatatactgctgaccggcgcgctacagttcggttactgtctcctcgtggagaccttccccttcaactcttttctctcgggcttcatctcttgtgaggggagattcatcctagcggtaacacaggctctggaaaggtgat

SEQ ID NO: 632815 - DNA, 142 bp, Homo sapiens
gattagcatcggtcatggcgcaccgcgactatcatgcgagaacctgatctggctgccccagcgcgacggcgccgcccgcgtcggcatgatcgacttccaggacgcggtgcgcgcccacccgtcgtgggatttgcattccctg

SEQ ID NO: 632816 - DNA, 280 bp, Homo sapiens
catataactgagttttgatgataatgatagcgaacaattggaagatcatgattcataatcaaattagactgcaaaaccgaaagtggaaatgtactctgggagtgatgatgatgatgattataacaaacttcctataaaagctaatgggaaagctcatacatcaaatatgaagtgggatgggtcagaggaggatgaggataacagtctaaaaattagagagcgttcaagagtaaatacttctggtgaaagtggtgatgaatcagatgaatttttgccatct

SEQ ID NO: 632817 - DNA, 499 bp, Homo sapiens
gccatgcagattccagaccggctactgcaacggattccctgccggagttctaggtcaccaacaggccgtcgcaataacgacccctgaatacttctacattcccctgcgcctggggctcacggacatcaacgaggcctacgtggagacgctgaagcactgcttcaatgatgccccagtccctgggcgtcatcggagggaagcccaacagcgcccactacttcatcggctacgttggtgaggagctcatctacctggaaccccacaccaggcagccagccgtggagcccactgatggcttgcttcatcccggacgagagcttcccactgccagcacccgaccgtgccgcatgagcatcggcggagcttgacccgtccatcgctgtggggttttactgtaagactgaagatgacttcaatgattggtgccagcaagtcaaaaagctgtctctgcttggaggtgccctgccattttgagctggtgagcagcgccttcacatct

SEQ ID NO: 632818 - DNA, 138 bp, Homo sapiens
ccctaattacgcatggtgtaggtggcagatagtctggatcctcgttgctgtggctgtggtgtaggctgtcaactgcagctccgattggactcctagccttggagcatccctatgctgagggtgcagctctaaaaaggc

SEQ ID NO: 632819 - DNA, 654 bp, Homo sapiens
tcttatgggaaaaggacccaattgcaagggctagtctttactgggaaagaaaaaattttacagcacatttggagtaatttagtgcaggtgctcaagtgtgccagctgctggggccccagcttgtaaggggctccacagcgggggcatcgcggggcctcgccttggtgcagccaaaaccagacgacgctggtatggtcctcttcacagatgcacgcctactattctcttgttgggacgatgcgaggtggactaaattagggtcttccctggtgcctgaagctcccttgtggggccagtcgggaccgagtgagacctagatggctgctcgcgggctgcatcgcgggggtattggccaacggggccgccacccgagctacccgtgccccaccgtgtgtggccggcgtgtgggcagctcgcggaagcaggtgcgctggagacgccagtccggaactacctctcccagcctcgcctcacattacaagacagtatcgtggagtccacgggtgcccagtagatgactctacaaactcagtgtcaagttccccagggtatcgctgaaaatggctccattggcaccttaccggagtggcccacaagagaagttgggcaagtttcttggcaacgttacggggccccaaccgccagatagcctca

SEQ ID NO: 632820 - DNA, 786 bp, Homo sapiens
  misc_feature (239)..(239): n is a, c, g, or t
  misc_feature (535)..(535): n is a, c, g, or t
  misc_feature (651)..(651): n is a, c, g, or t
aactcgatgctggccacgtgggaggcgggacttctctcgcactattacgcctcactttattttttctcatgatccatgctctgacaaaccctgttatgttatgatgatcgctaaattctgatatgtctttatctgtaacacgtcacgacacgcactgactaatatccactgcctttccacactaaacgaggggaacagcgagaagcaacgcatcctaatcggaatgatggcgagcgccnatcagtattgcactgtccatttgcactacgtcatcgtacttagttagttggaccttcatttccagctcgtttacactttagatatgaatgcaggagcacgcgtttggatcacatgttcaatatcgacgtgacgcctgcacctattgtcacgatcacgcatcctagtgctaatcctagtcgtagcgtctcggcgagcggtatagagcatatgcaacgttagctatcgtcctcgcgagatagagagcgcacagcagtgtcgttggtaaagtatgttgacagtcgacgatcgaccgtgntgtagcatccttattagatgccatacccacacgactagttcaccgaatggttagaactctggcacggccatgttacctcgcgaacttttaattacacgcagaagcgcagtcttttnatttgtgttgtctacaagatgcgtggtgtaaatcaccttgcgggactgacacgacttctttatttaattagtgcagactacacacagtgttatcatccgtccatccgggcctagaaattaacttcccccttaaac

SEQ ID NO: 632821 - DNA, 260 bp, Homo sapiens
ctactacaactttcgctgtgccacgaatgactgccaggtagtggcgccagcgcgttgacgctggttgatcagcgtggagcaccgcgacggttccagctcctaaaacagcttggaatctcgcatgcagggtgatgacgtcgtcaaccgtcgggcaacacaccaccgcactgcgtcctgacgtcaacgtggcacagactgcttgcagcaaaccgttgcaccaatctccgaggtgatcatcatctcccggaccacaaactgga

SEQ ID NO: 632822 - DNA, 414 bp, Homo sapiens
cccctggctaatttttgtaatttttcgtagagagggggtttcaacatgttggccaggctggtcttgaactcctgaccttaagtgatcagcccgcctcggcctcccaaagtgctgggattacaggcgtgagccaccacgcccggtgcattgggtgttatttttctcgcttcctatctatgctaacttcatgtctgtgaaagagcaacttaatgattcccttttgcatttttgatggctaggaaagtggaactattttccatttattaaaattaaccagctgcaattctttttgtgtgaaacgtctgtctgtattatctgttcatgcatctgctggagagggtaccctcttgcctggggagctagctgcagatactgttctcaatccgtttcctttttattttaggttttttctct

SEQ ID NO: 632823 - DNA, 331 bp, Homo sapiens
  misc_feature (6)..(6): n is a, c, g, or t
  misc_feature (46)..(46): n is a, c, g, or t
tgaagntgtccatttgaaccaggaggcacagtaatgtcatggaagngggcccaagcctcagattcaaatacacatggttttagtcatggctctagcacttgctaggtgtgtgccctgggtcttgactttgcctctctgaacctcaattttctgggctgtataatgaagataataccttgcttacaggataggtataagtgttaaatgagataatagatatcacattcctagcacttagtaggtactcagtgaatgaacactatcagaagaactgagatctgcagttgtgctcagaaccttgagcattttctctggttgtcttaacaaaagt

SEQ ID NO: 632824 - DNA, 197 bp, Homo sapiens
ggaatcaacataaacccaccatcacaaaaaaaaaaattttgcagcgacgagaactgacgcaaacctgaagaaaaaacaaaacgcgggaaacaacgacccatacaaatttttccccccacacttacccgagggtggcatttgccccgccggtttttttgcgaccaattcaaaccaagaggctttaaacattacccgag

SEQ ID NO: 632825 - DNA, 384 bp, Homo sapiens
tgatctagaggatctccgctctcacccacccactgtgctctttgaagcacgtgctccctcgcctccatacatgagggacgacgcaggggagaacagagaagtgcttggcctaggattgaggcactttgttcctagcccgctggttagggctggtgcagcgaagcaatgttgaggatgctttaagcactaacaagccgaatccgggaactctgttaacaggttgtccaaccagcagaatgaggctaactgtataaagcatgggaccccggatgaggataaggaaaggacagcggctttccctgggcagtacaatggcttgaaggccaaaagggataaagtgacagccgactgtgactcttgtgaggaggggtgggtggagagcgg

SEQ ID NO: 632826 - DNA, 145 bp, Homo sapiens
cctagaggacccatggtttacaaggggcttcctccactttgctcagcacttctccttcctgcccgccatgtgaagaacatgtctgcttccccttctgccatgattataagcttcctgaggcttccccagccctgcgaacctatga

SEQ ID NO: 632827 - DNA, 486 bp, Homo sapiens
gaaagaaaatctacaacacatagaagatgatgatgttagatgcccatcgtgatgcagaagtggtttattcattatgtaaagcacccgttgaattaaaagaatgtgttttgtacaacctcttcctgaggcccaagagcatatgggcaattcggatttcctgctggaccacaaggttctgttgatattacatagaacgggtattccagacacttcttatgatgaaagtccaaaagtggcatccaatataaggccccatctttcgttgccattcttcattcatacaaagagacgaacttggattacatcaacttaggacccattggttttgtcgctgtcgtcaactgacagtgattcatcactggtgatgatcaaaatgatggaagaagagttgacagtcacttttttctttggcctgtccccatctttctgtgacatcacaatgggtctgatctgcatttcacttccagctgctggtaggtctttagc

SEQ ID NO: 632828 - DNA, 878 bp, Homo sapiens
tcgaccagcagtatatcttctctgcgtcgccagcgagccacatcgctcagacaccatggggaaggtgaaggtcggagtcaacggattgggtcgtatgggcgcctggtcaccaggctgcttataactctggtacagtggatattgttgccatcaatgaccccttcattgacctccaaactacatggtttacatgttaccaagtatgattccacccatggcaaattccatggcagcgtcaaggctgataacgggaagcttgtcatcaatggaaatcccatcaccatcttccaggagcgagatccctccaaaatcaatgtggaggcgatgctggcgctgagtacgtcgttggtagttccactggccgtccttcaccaccatggagaaggctggggctcatttagcaaggggggagccaaaagggtctactcatcatctgccccctctgctgatgcccccatgttcgtcatgggtgtgaactcatgagaagtatgacaacagtttcaagatcatcagcaatggctcctggcaacaggcaactgcttagctaccctggtgcaaggtcagtccatgacaacttgggtatcgtggaaggactcatgaccacgagtccatgccatcactggcagccagaagactgtggtattgcgcccctccgggtaaaactgtggcgtgatggccgcggggctctcccagaactatcatccccttgtcctctgacttggggggctggccaaggcagtgcgaccaaggtcttcccctgagccttggaacgggaatctcactggcattggcccttccgtgtacccactgccaacgtgtcacgcggtggaccgagctggcgtttagaaaacctggcaatatgcggctccacaaggttg

SEQ ID NO: 632829 - DNA, 453 bp, Homo sapiens
ggatcacctccataatgtgtgccaggagagtggctgtttggacagcagcattagctgataggttatggtgggcatgaaggaaagagagaagtcagggatgacccctaggtatttgctagagaacccaacaggtattttgctccatcacctgcctatgatcgagctggagagggcagtagggaagaggttggggtacagaaggtcacaggtgcagtggtggtgtgggaagcccctggagacaccactaggtctcccagtgaatgtagaggtctggaggacagagagggatcgggctggaggtgtggacctgaggtgtttccatacttggggaggcatttaagccactggtttggatgagacagtcggaggttaagtgcacacaaaaaggaaagggtgtctggatcgtgccctggggcatgcttgtgttctgaggtcaggaaggtaagagaggca

SEQ ID NO: 632830 - DNA, 317 bp, Homo sapiens
  misc_feature (235)..(235): n is a, c, g, or t
  misc_feature (302)..(302): n is a, c, g, or t
gaggcggctttactctgtcacctcggctgagtgcagtggcatgatcacggcccattgtagccccgacctcctggtttcaaatgaccctcccaccttagcctcctgagtagctacgactacagccatgtgccaccttgcacgcataattttttttaagttttttgtagagacgaggtcttgccatggttcccgggctgtctgggaactcctgggagtcaagcaatcctcctgcctncagcctcccaaagttttggggattgttaaagggatttgttgagggtactgagcctgggcctcttganttgaatttttaactg

SEQ ID NO: 632831 - DNA, 528 bp, Homo sapiens
  misc_feature (68)..(68): n is a, c, g, or t
gaggtggctcacgccctgattagatcccaatactttgggagaccgagaggggcagatcacctggaaangggtttccaagggcggaacgctttcggcaggggcaagggtccaggagttcaagctggtcagcctggccaacatggtgaaaccttgtctagaaagagatttgtttataaagcgaagagagagagaaaagaataaaacaaaaaaagaaaaaaaatttttggggggcctgggcccagtctagttgcagggaagaatcaaaaaagagagggggccctacttacgtacctgatgataacggacacccaaatctcagagttgtgggcgagcggggggacccccaagcgagaacagagggataaacagcgtgtggccggactaaacatgaatgaacccgacggtcccggctgcggacgcatcgctcctgcgcacgagagggagaaaaaccgcggggacacggaaaaagcgggcgcgctggagaaagaaataattcagacagccccacacacacgcaagtcacaacac

SEQ ID NO: 632832 - DNA, 116 bp, Homo sapiens
aatactcaatccatcatcatccttttgctgcttaccttgttttaaattgtactaccgaaaaacatcagaaggaatatgtaattgaaatgagctagatttataactggtctgtatcc

SEQ ID NO: 632833 - DNA, 147 bp, Homo sapiens
cttaaggcctgctgagtggaattactggtataatatagatgaaagggatcactatggcttgcggtatggagagaagactatacttggtagtatgtcaaagtgtggcccagggacactagaaatccctcgagaccctttcaggggtcc

SEQ ID NO: 632834 - DNA, 857 bp, Homo sapiens
  misc_feature (7)..(8): n is a, c, g, or t
cccgctnnagggaagtatcgcatgcaagcgagtgagggacagagcagcgcgtaatgcaccctgctatctagagcaatggacgttgcgctggtccagttggctctatgtaccaggctctctgtatcttacccaggctcttctcgcaggggactgtgttccgctggtacaccaccgcgggggttcccctccgacgtgtagtgccagcccgccttgactttggcactccagcacggttacaggcccggaaaagtgccgaccggtccgtccactcagcaaccccccccattttctgctaacgcccttaatatccctctactgccccatggatctccggaacaaatgctctcaataaaatcattgcttcttcccccttctcaccgcacacatttgaacatttatagtctcaattccatcataatgtccccgccagtcccctcgttcgtatttatatatatcacccgtctcccattatggccagataacccaagacctccctgccgctaccccaggtcggaaatgctcttatatcctgctacgcgctggcataccccaaaatggtgtgccaacaaggcgtcaggtcacaagtttaacaaaacccgaccctcagtactcaccgttctgctcgggcacaaccccctgcaggtacagttgcactcttacctcccccaccccctgtttagtttccgctccaacaactaggcaccgcaccactccacttttaagatttttacacgtgaatcccccagcaatgctagactcttccagcaagatttacaaggaccagtatagtatgtggaacccacggcgccccgccaggggcagaaaccaaggcaaaaaccggatctgcgccaacatga

SEQ ID NO: 632835 - DNA, 326 bp, Homo sapiens
ccgcagttaaagcccccaagaagaaaccatctgtgctgccagtcacccgaaggtgccactcaacgagccctgttggcactttgccaagtggttaaggcagccccttgttttttgaaacgtgaagaagcgatatttggaccacctttcgtcacgagcagtttaaatgccagcagttttagaaccgggttttccccttttaggcaagttaggttcttgcggaggaatccagttagtaagatttttaagggggtttccctccaacccttaattagtttggttttaatggtatttaactttccattcctgtttttggggtttggtttttt

SEQ ID NO: 632836 - DNA, 610 bp, Homo sapiens
  misc_feature (36)..(36): n is a, c, g, or t
  misc_feature (67)..(68): n is a, c, g, or t
  misc_feature (73)..(73): n is a, c, g, or t
  misc_feature (82)..(82): n is a, c, g, or t
  misc_feature (99)..(99): n is a, c, g, or t
  misc_feature (102)..(102): n is a, c, g, or t
  misc_feature (110)..(110): n is a, c, g, or t
  misc_feature (112)..(112): n is a, c, g, or t
  misc_feature (117)..(117): n is a, c, g, or t
  misc_feature (119)..(119): n is a, c, g, or t
  misc_feature (127)..(127): n is a, c, g, or t
  misc_feature (148)..(148): n is a, c, g, or t
  misc_feature (151)..(151): n is a, c, g, or t
  misc_feature (162)..(162): n is a, c, g, or t
  misc_feature (179)..(179): n is a, c, g, or t
  misc_feature (182)..(182): n is a, c, g, or t
  misc_feature (200)..(200): n is a, c, g, or t
  misc_feature (216)..(216): n is a, c, g, or t
  misc_feature (225)..(225): n is a, c, g, or t
  misc_feature (229)..(229): n is a, c, g, or t
  misc_feature (238)..(238): n is a, c, g, or t
  misc_feature (245)..(245): n is a, c, g, or t
  misc_feature (266)..(266): n is a, c, g, or t
  misc_feature (348)..(348): n is a, c, g, or t
  misc_feature (364)..(364): n is a, c, g, or t
  misc_feature (394)..(394): n is a, c, g, or t
  misc_feature (479)..(479): n is a, c, g, or t
  misc_feature (522)..(522): n is a, c, g, or t
  misc_feature (545)..(545): n is a, c, g, or t
  misc_feature (607)..(607): n is a, c, g, or t
tattgttccgtcttgcactttatcggtttggggcangaagacaatggtatcctctgtttagccctgnnccttncagaaggcngtgaatttctccttttnctnagctctgngngtctngnttcggctntggagggtggtccatgcggangtnctcgccagggnccttgctgccctggctnttnagcagcgcgttctggtcntagtcggtctccaccnctgacacgnagtnggtgctgcnccagtgnggactccggtagctgttgganccgagggaccccgcgggctgcagctgcatggttcgggtctcacactggtttttcctgaggaaggtggaggtcatggttgagnccaccatccgtggcangggccaccacagacttgcacatggacaacnccgccttcttctcccggagccagctcgagtcggaggcgagggccgcgctgaaccagcgccccaggaacttgttctgctggaagtngggctgcacggagacctgggcctccggtgctgcctgctggtcncccagcacccccagcagggccanttccatccacagcgtgtgatgagtagccattctcctgcagcagagcgggtgttcggggcctngtg

SEQ ID NO: 632837 - DNA, 270 bp, Homo sapiens
  misc_feature (136)..(136): n is a, c, g, or t
ataagcggatgagggctcagctgtctcttactttaaccagtgaaattgacctggccgtgaagaggcgggcatgacacagccagacgagaagacctatggagctttaatttattaatggcaacagtacctaacaaanccacaggttctaaactaccaaacctggattaaaaatttcggttggggcgacctcggagcagaatccaaactccgagcagtacattctaagacttcaccagtccaagcgaactactatactccattgatcccatg

SEQ ID NO: 632838 - DNA, 446 bp, Homo sapiens
ccctctcaccttcttccacccccatctctgggtctctatctccatcttcctgtgtgtctgcctcttttgggttcagtctctgtttctttttcatctcttggccttcgtctctgatacccggcaccaatgacgtgtccccgtgactaggctacagtccccagttattgaatgaaaccatgactcagcggctgctacgaaggggctttgtagatgtcaagtccacaatcagctgatttccaggaaaagagattggactggagaatgtgggtgggccttatctaatcagtcaaaggtctaaagggggtgggcctcatctaatcagttgaaggtctgaagaggggtgggcctcatctaatcagttgaaggtctaaagggggtggaccttgtctaattaataagctgaaggtctaaaggggaaggggggaagggtgggcttcatctaatga

SEQ ID NO: 632839 - DNA, 373 bp, Homo sapiens
acctccattggactggagtggacttctgggcatgggcaccaggctgacgcttcctgggaagcggatggtccaagtgtgtcccgaattggtgggttcttggtctcactaacttcaagaatgaagccccggaccctcacggtgagtgttacagcttttcaggtggcccgtctggagtctgtccctcctgatgttcagatgtattcggagtttttttccttctggtgggtttgtggtctccctggctcaggagtgaagctgcagaccttcgcggtgagtgttatagctctataaggtagcacttcgggagttgtttgttctttccagtgggctcgtggtctcaggagtgaagctgcagatcttccctgtggaaaag

SEQ ID NO: 632840 - DNA, 215 bp, Homo sapiens
gattcagtgtcagtctccaaaagcaattgcagcaaaaacatgaaataggtaagtgggacctaattaaatgtaaaaatgcttctgcacagacaaaaaaaaaaaaaaaaaaaaaaaaccttcaaaaaaccaaccgcctcaaaaattgggaaaagttttcccaaggctttgtttcaacaagggccaatttcccagaacttcctcaaaaacggtttaac

SEQ ID NO: 632841 - DNA, 100 bp, Homo sapiens
  misc_feature (79)..(79): n is a, c, g, or t
cgggcggccagtgcagggccgggccgaggtccctccgccgctcctcctcgcggtagctcaccgggccgccgctcccggnccagagccaccctcccagctg

SEQ ID NO: 632842 - DNA, 127 bp, Homo sapiens
gtgcccacagaaccctctaaaatccccttgtaaatttaacctgttagtccaaagaggacaagctctttggacaactaggaaaaacctgtaagagagagaaaaaaatttaacacccatagtaggccta

SEQ ID NO: 632843 - DNA, 1318 bp, Homo sapiens
  misc_feature (744)..(744): n is a, c, g, or t
  misc_feature (866)..(866): n is a, c, g, or t
ggagaagagagagaactatgctcgagtgagcgatgccgattctgatttcctgggggctgtcggcgccacattctggatggatcccagccgcctgaggcggaggtgtgggcacggacccaatgacatataaagaaggccgggggcatggacaggctgactttactcaagagaaggcccgaatgggagcgtctgcgcgggttgactcaatagtgtccatggtgatgcacgatgcgtgactactatgcgagctggcacaaggcgtggtcggcgtatgatatgctcgagagagccccctaatgttaccatgacatgcatatccttacgatgtgtggcagctggtgctcactcaggaaatcaagagggctgatcaaaatggaagatgagaccacaaggtgcctatgcagagaaggctgcatctgcacgttcttcattgcaaactctccgttcggagtttgaccctgcagtacctctatgataggcaacgatccaaaaagatcgccttgccgcactcaaacaagtagcgtcctcgagcttcgatccaaggctctctcctaatctgcccataggagaggcttcaccgctggtacatggaagctaggcgtatgagtgagacatgactgcgtaccaaaggccagtgggctgaaggtgtgcacacacagtgcgaagtgatagcaagcagcggagactctcagcgttgtctccgaggattgactctttacaaagctccctttgactttgcgactncagatgtgtgctcaaagggccaccgtttagccccccgaaatgaatactctggtaataaggacggggactctccttttacttaaccagtagactgacttcgtgagtcactcttcgagtaagcnggacaccacaccgcgttgttgtcacaaagcggcaacgagtctggagaattaggagcgtttcagggtgaattggaaggctccttttcccccttgtgttggagtcccatgtcactccccaaagagacaggaaatagggggcgacagttggcaacaccggctgggtgcccgaaagcaccaagccgggccatttgtcctatcgagtcaccgaaaaagggcggcttggttgcacccaagttggcttgcccccgtaccaagggtggggaaatgggggatttgggacgggacctcttggtcgccgggaggaagcggccttatttccccttaaaccaagagataccctaattatactcttttgttgggagagtggaaccacaaaaccccgaagatagagaccctccattgggcttcccttccaatagacgggtggctccccgagccggaagcgtgttagg

SEQ ID NO: 632844 - DNA, 452 bp, Homo sapiens
  misc_feature (291)..(291): n is a, c, g, or t
  misc_feature (400)..(400): n is a, c, g, or t
  misc_feature (428)..(428): n is a, c, g, or t
ctctagatagatatccagtagtgtaattgctggatcaatggtagatctacttttagttctctgaggaatctccacactgttttccatagtggttgtactagtttacattcccaacagcagtgtagaagtgttcactgttcaatgcatccacaccaacatctatctttttttaattttttgattatggtctttcttggtcgtttgaaagaagaggaaaaaaggagtggattgttgtcttctgctctcctgccatatgaagacaccagagttcatctcgtttgccttctttcntctggcatgtgaggatgcacaagaaggggcccaaccagatgccagtggctggaacaatggatcctagacttcctaccactcaccctagcattacttagatggataaggncccatacccattacaatctccagcaatncccctcaaacctaaaaaaaagaaa

SEQ ID NO: 632845 - DNA, 187 bp, Homo sapiens
acggtatggattcccatgcggggaagaggtggttatgacagaatgcctcctggtcggggtgtgcgtccatgcctccatcatagaagagattatgatgatatgagccctcgatgaggacccacctccccctcctcccggacgacgcggccggggtggtagcaaagctcggaatctatccatctacctc

SEQ ID NO: 632846 - DNA, 194 bp, Homo sapiens
acaagcatgacatctttgatagctccaagtataaactacaaattcaaatccagacgatggtactatagcatgactcaatatgtgtcattattgcgtgcctgtagtcccagctaccaaggaggctgaggcaggagtaatcgcttgaacttggaagatggaggtttacagtgagccaagatcgtgccattgcactc

SEQ ID NO: 632847 - DNA, 205 bp, Homo sapiens
  misc_feature (44)..(45): n is a, c, g, or t
  misc_feature (73)..(73): n is a, c, g, or t
  misc_feature (92)..(92): n is a, c, g, or t
cagctaattttgcatttgtgtaagatggggtttcaccatgttgnncaggttggtctggaactcctgacctcangtgatctgcccgcctcggnctcccaaaatgctaggattacaggcgtgagccacggcacccggccagtgacttttaacttcagtgatgaattcaaaatctcttacagagctctcttacgctctggtgcgtgac

SEQ ID NO: 632848 - DNA, 1024 bp, Homo sapiens
  misc_feature (176)..(176): n is a, c, g, or t
tcttgcgtccgggcgcggcggagatgttcgttatttttcccaaaagtggtccccctcgtgtgttcttttgtcccctctggcccccccccgaatttgtcgccgccgggtttccccctctaggtgtctccagtcttctcttacagtgtgttcccgttcacgcgcccttagggcggccntgttgtccttgatactgggacccgtaccagtgttgtgtggcccagctgacccttccttgggggtcctggcccgtcactactgatggtacgccccacccgccccgcgcctgattgttagtgatagcctgtgcccgggccactccccctatgggcgggcgccctgatttattagggtcttttctgttctcaagaggttgagaaatggccgctggcccccctttttgccccccagggcagaaccccttatcaccccctctatgttcccccctaactagttatttatttggaacccctcagcctattctcatttgcgacccatgatggccccggcccgctatacgtccttaccgcgcttacacttttctgcacgggccaccctatgctcatggcaccctctatttgggtagggcgcccacccctctgcccgttttctctacccttaacctttcccctcttaccacattatctatcttttcccccaagttattaatttgttcctgagctatctcctagaaattctccttgttcgccctttatctccaaacctaccgtttttctaccacatttttaataaaccctcttaccctgcgacacgaccccaacaccatttaaaaaaaaaaaaaaaagggaggcccgcttctgcgattcttagaacttagtcttgacatctttataatactgcctctatcttgatttataagccaaacctggaaaacctaccaaataagtgttgtggtttatttagaaaaatatgggaaatattgctgttatttttggtgaagaaaatccattttgtatagtttatttccatcttaattaaatgtgaattttgtttaaagcttaggcca

SEQ ID NO: 632849 - DNA, 350 bp, Homo sapiens
  misc_feature (5)..(5): n is a, c, g, or t
  misc_feature (32)..(33): n is a, c, g, or t
  misc_feature (42)..(42): n is a, c, g, or t
  misc_feature (47)..(47): n is a, c, g, or t
  misc_feature (81)..(82): n is a, c, g, or t
  misc_feature (86)..(86): n is a, c, g, or t
  misc_feature (98)..(98): n is a, c, g, or t
  misc_feature (101)..(101): n is a, c, g, or t
  misc_feature (111)..(111): n is a, c, g, or t
  misc_feature (123)..(123): n is a, c, g, or t
  misc_feature (130)..(130): n is a, c, g, or t
  misc_feature (179)..(179): n is a, c, g, or t
  misc_feature (193)..(194): n is a, c, g, or t
  misc_feature (213)..(213): n is a, c, g, or t
  misc_feature (224)..(224): n is a, c, g, or t
  misc_feature (226)..(226): n is a, c, g, or t
  misc_feature (231)..(231): n is a, c, g, or t
  misc_feature (241)..(241): n is a, c, g, or t
  misc_feature (258)..(258): n is a, c, g, or t
  misc_feature (264)..(265): n is a, c, g, or t
  misc_feature (268)..(269): n is a, c, g, or t
  misc_feature (299)..(299): n is a, c, g, or t
  misc_feature (303)..(303): n is a, c, g, or t
  misc_feature (322)..(322): n is a, c, g, or t
  misc_feature (328)..(328): n is a, c, g, or t
  misc_feature (350)..(350): n is a, c, g, or t
actcngggctgtccaagcctctgtgcacctgnngtctctttncaccngcacttccctgctttgctaccatcgcggaagaanngacnggcgggggaganggngggtgggctnagggagaacggncagagtngccagaagatgcagagagaagccccacccggatctgagtattccccacnggcactcagccacnnggatgaactagtgtttgtngtatcctcgcngntatgngacttaacgngactcagagatatctangtacgnngcnnactccgccggcaatgaagtaaatatatcanttcnccgaagctcgtgtgtcttntctaangataaaccatacgttccttagn

SEQ ID NO: 632850 - DNA, 114 bp, Homo sapiens
tgggcgcatgcaggtcagcgcagctcgagggcacgaggcgcaggtgtcaaggccaagttcaagaatgggacgatgtgtgacggtggactacacacgcaatgcggaggccgtgct

SEQ ID NO: 632851 - DNA, 135 bp, Homo sapiens
  misc_feature (66)..(66): n is a, c, g, or t
gcacatgcctatcaatatagtaaaaccagcccatgaaccctaacaaggggcctctcagcctctatnctccggcttagccatgtgatttcaatttcactccataacggtctcatacttaggcctacttaaccaaca

SEQ ID NO: 632852 - DNA, 372 bp, Homo sapiens
tacacgatcttcccgggggggcgccgggggcctcccactgtgttctacatcttcgtgatgtctctgtcgagcgtgctcagacttgagtcaagctcaatagggtgttctttccccgactgtttgcggcccgctccgtttcccttggttgtgattgcgatggctctggcgtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgcgtcaacacccgccgcgggccttcgcgatgctttgttttaatt

SEQ ID NO: 632853 - DNA, 119 bp, Homo sapiens
tgtcatactcagcatgatcattgcattgattgtcacagcaagatcaaataacaaaacgaagcatattgccgaagagaacttgattgacgcagcatttcaaaatctaaaactgcggtcga

SEQ ID NO: 632854 - DNA, 709 bp, Homo sapiens
  misc_feature (582)..(582): n is a, c, g, or t
tcgaggttgctgatcccccctagccacttctgatgatgcctatggaagtcaggcagcaggagggagcttcgccctgagcctcatcgcgtcatgaatgcttccccagcccctggaacaacagcagaagaggccatgtcccgaggttcacctcctgctcctgaggggggctcccggtatgaacaggatggacgcttcaactgatacacacaccttgggcatgtgcagtctccccaaaatgggtccctagtctatccacgcaggcatattcagagccagcgggacaggtgaaatcgccagacccctctgtgagttatgcctacctcaggtggtatgtctgccatgagaacgctgagacgatgccggtttagggtgcccagatgcttctctcagatgctgtccagccggggcacgctaaggcagtcggatcgtctgcccctgagaagccccgagagcctgtagccgtggacctggaggcaccagaggttcaggagagctacaggcagcagctccggtctgatatacaaaaacgactgcaggaagaccccaactacagtccccagcgcttcccaatgccagcgggcntttgctgatgatccttagctctttgctctatggcccttcctcatcaggggaccgtttcccccctcttccttcacagtatttaagaaataaaagtcggatttttaaaaaaaaaaacacacaaaaaaaa

SEQ ID NO: 632855 - DNA, 176 bp, Homo sapiens
atgttggcatgctacctcatcatcttactcatcttaagcccgaggcattgatcaactaggagcccatataaatgaggctcagtagggctgacataatctccaaagaattctttattcagtgtttcgcttgtgtaagcatgttgctatgatggacaggtccccctcctccatactag

SEQ ID NO: 632856 - DNA, 305 bp, Homo sapiens
accgttttagcacgtggtactaatctttctttcgttttaatcccttcttttcgggaaacaatctctcgtgctgtctcccgggctgagtgcagtgtgcagatctcggtaacatgcaaccatcggcctcccaggttctcgagattctcctgcctcagcctcctgagtagctaggattacaggtgcacaccaccacacccagctgatttttggtatttttatgtagacttggggtgttccatgtattgttgggccagactgggtctcaaacctcctcaccttgactctcattgatccattccaccttt

SEQ ID NO: 632857 - DNA, 196 bp, Homo sapiens
ctgacgatacccacacagtgggcaggagctggcgatacccaccaggcatgggtgctggacgctggcgatacccccaaagtggcaggagctgcgatacccaaagtggcagagctgcgatacccaacaggggcagagctaacgatcccccaacatgtgaggtaggagggtccgagtcgaatcgtaacatggtcatgct

SEQ ID NO: 632858 - DNA, 331 bp, Homo sapiens
  misc_feature (256)..(256): n is a, c, g, or t
  misc_feature (286)..(287): n is a, c, g, or t
gatgtgtagagagaagggaaatagagagcgagtgtaaactggtatgtagtttctatggagtgataaaaatgttctggaatttgccaggcatggtggctcacacctgtaatcatagcactttgggaggccaaggcaggtggactgcttgagctcaggagtttgagaccagcctgggcagcatagagagacctttgtctctacaaaaaaaaattctttttaattggctgggcatggtggcatgcagctgtcatcccangccatttgagaaggctaaacgtgggagganntcccttaagcccaggaagttcaacggcgtgccgttgcagctttg

SEQ ID NO: 632859 - DNA, 1297 bp, Homo sapiens
ggcctgtcgccgactccttgccttggagctcggtgatgtatcgagggactgcggccacacggcacggaatggctgctcctctcgctgccccggccgacagctcgcggccaggccgctatctgcgcctgacctgtttccatcatgagctgccccctggaccctgccgtgccgaccggacgtcgaccccggcagtccggactaaataacaccggaaacaccgggactcggcgacaggccgcggccgggggacggacggacgggcgaccccggcccggcgaccatcgacgacgcctcatcggacccggcctcgcgctgcactccagacccgtggaagcccactgacccttcggcatagagccccacgcgccaaggaatccggcgtccctcgcggtgccacaccgacgccgcaaccccgacgggccctcccgagcaaacgcacgcacggaccacatgcgcaacccggtgccgccgcgcctgggccgacgcgccgcgctcggcccccgagccacagccacggccgaccgaggcaacgaaaacgcccgccaacaaccgcccggccccacccgacctgcatggcaaggcaaccgaacccaacccaccgccaccgcgccccacctcccccagctgtgcccaacccgcccccgccctgcagccccctgcactgcccccgcggcaacgctggcaacccttcgcctcggccgcccctcccccccgtaccccccgccgcacggcgcctccaccccccctccacctccctcggcggcccctcgacccctgtcccccacctctcactgtctcggcccctctcaaccccgtcgtgcgcttgcccccgcactccgctccccacctcgcaccccacctcggccgccgccgccagccccgccccccgccccccgtaaccgaacttccccctccgtgccgacccccctgcaccccctccgcccacacccgtgcccgcgcccccgcccctggacacaccactgggcctcaccctccacgcgcaacacccctccccctcaactggcccctgcccactgtcccacggccacactgcttctccttccctcccgccattgacctcttcccgcccctgctccaccaccgtccccaccgttggcccaccccgcccccgcccccccccccacgcctgaccaccgtgccgggcccctctcgcgccctcggcctgctctcgccctggctcaccccttcccgcctgcgccctcccctccccacgcgggcctactcccccctcgccacaccgcctctcgcccatctgctctgccccctcttcgctcag

SEQ ID NO: 632860 - DNA, 204 bp, Homo sapiens
agatatggaccgacatcataccacgcagggatgtggaacgttcagccctccttggcttactcggagagatgatacctaagctgaattttaaggagacatgaggagttcacttcgtagcacagtggttaatgaatccgactaggagccatgaggttgcgggttagatccctggcctcgctcagtgggttaaggatccggcgttgc

SEQ ID NO: 632861 - DNA, 181 bp, Homo sapiens
atttttacaaattcgttttacagctaacatcatcttcctccttgataactacactgcatgacaatgactttgaatgttgcatcatgtattcctaagataaactccatttgtttagtcagtcctaatttgaaaatgagaatttgttccaatgggattgatacattacggaacaatagcagag

SEQ ID NO: 632862 - DNA, 813 bp, Homo sapiens
  misc_feature (725)..(726): n is a, c, g, or t
aaagccatctatgcatttgtgcctcgaatacgcctccttgactcagccgatggcgactccgtcgcgcgcctcctccggcgccggggactccgtgaagcttgatacgccagagtcccgtgaagctctgcgtcgtttcatttttaatcccctgacatcgggatcaccggtcgtgccccaccagtgtcaggacgcagccgtagacaccagctccgaagatcaccaccaaggactgagaggagaagaaggaagtagtggaagaggcagaagaatggtaagagacgcccctggctaccggcgaatgcctaatgcaggaaaatggaggagcaggcaggctgcacaaatgcaggtcagcacggcaggaacacaagcgacgcaagggtgcgcgcgcaggaagcagcgcagcgcacggaaagaagcacacgtgaatgggtgcaggcaacgacgcgactggaggatcgcaccatggacggacagctcgaggtcaagcttacggggcacagctgggcaagcatgacaggatgatgcacggcatgaccgcatgctcgatacgcaaggacaggcaggaaggaccggacccagggatgactagacagcccccaccagggacgagtttaccacgtagacaaaacaccagagcagggcccgacccgtgcacccatatttccacgccgatgccaagtatacaaggattataaaaaaataaaaaaaaagagggaaaaaagaanngggagggggaggaggagtagagaggaaggggagaggggggggagaaggagggaggggaggagggggaagagggagggagaaagacgt

SEQ ID NO: 632863 - DNA, 84 bp, Homo sapiens
gacagcagcttctacatctgcagtgctagcccggggggcgggtcctatgagcagttcttcgggccagggacacggctcaccgtg

SEQ ID NO: 632864 - DNA, 962 bp, Homo sapiens
ctgctacacgcctgtgtgggcagcatgtctggcaacaagcggctgctcgtaagctggggaaatgccgtgctctgtggtgcctggtggcttggctgctggggtgcctggcaatgcgcgctggcgaaatgtgcctgactctgctggttgtgacagtggtgcaaatccaattgtgtggctggcaagatgaatgatgtgagatctccagctgactctgagagcgagagcctagctccaatggaatgccctgacgtgaaggagggatgtgatgggagtgatgcttgtgatgtgaaacttgccacagtgaaaatgaaagcttgctgcttgtgccaaatgctctacctagagcatgctcctgtcatgcaatgagtgatggacgaagtgcttgagcgccctgtgcatttgatctgatgtgaccatgtgtgggctggggctgccttgaaggcgatgggattgtcggcttgagccatgatgtggtgcctgtgcttgcaataaatggttggtaggccaaaatgacgatccagtgccccatgcctcatgctgacaattactgctgttttactggggggcaaccagcatctcctatcaacattgttttggtcgtcacaccccgattgactcaggccatcttctcttgcttgcaaaagacttgcagacatcattaagtggatgcgtggagagttggacggaatggctgcatgtgattcctcgagccaagaagcgcgtgccgagggaaagccccctgtgccacatgcagcaacgtcctctgacatggccatctccttcctgacggaagtacctttgcctctggtaaacgcagcaacgctcattctcatttgggaggccagaagcttgccagacttgtacaccttccacaggacaccgggatgcggtgtcggtcttggcataccgagagcaccacaagatctaatcacataccaagaactcgtcgtgaacgcgtagca

SEQ ID NO: 632865 - DNA, 220 bp, Homo sapiens
ggagggcttgatcacatggtcagtgtctcacacggcctaatgcacaggtgaggaggcgcagggtcggatctaaatccttgtggactctgagcacacattcaatctcacaggagataagggacttctcaggtagaagcagcgagaatttatccttggacacagctcaaagatgatcccaaaaaatgctaccctaaccccagtattatgcaccgattactgg

SEQ ID NO: 632866 - DNA, 195 bp, Homo sapiens
cgagccttaatgttatcaccaacacctcccctttgttatattgtcttaagtggatcagcacatagtcatgcacacagatatgatgtctaacccagtaactgttatggtatttatttgtatacaatacaagggtcatgacacattcttgtgttggtggataacaatcacggggtaccgagactcgacattcggtaa

SEQ ID NO: 632867 - DNA, 185 bp, Homo sapiens
gatctcatacaggatccccttcgtcgaagaacaacggcatttacaatcgaacacagactactgccctcagttagaaatgaataaacaatttttttagtgctttatttttaactgacagcaaattgaattccttttatgagatctgtggctatttgactgtattatattttagctctataaaggta

SEQ ID NO: 632868 - DNA, 810 bp, Homo sapiens
  misc_feature (765)..(765): n is a, c, g, or t
ggacgcgtgggctttccaaaaaacacataatttgaatcaagcacaagcacccgacagactaattattagcatcatccctctactattttttaaccaaatcagacagaacaatcctatttagcatgttccccaaccttttcctccgacccccttaatcaagccccccgtcccgtaagttactaactacctgactcctacccctcacaatcatggtcaagccaacgccacttatccagattgaaaccaatatcacgaaaaaaactctatctctctatatctaagtctccctacaaatcttccttaattataacattcagcagtcactgaactaatcatattttatatcctcttcgaaaatcacacttatccccagcctggactatcatcacccgtatgaggcaaccagccagaacgcctgaacgcaggcatcatacttcctgatgtctactacctctaagtgaggctcccttccgcgctggactcattcgatactaattgtactactcacaactaccctaggctcactaagacattgctactgactcactctcactgcccaagaactatcaaactcctgagccaagaacttaatatgactagcttacacaatagcttttatagtaaagatacctctttacggactccacttatgatccctaaagcccatgtcgaagcccccatcgctgggtcaatagtagcttgccgagtactcttgaaactaggcggtatggtataatacgcctcacactcattctcaacccctgnaaaaacaatagctaccccttcttgtatatcctatgaagctcacat

SEQ ID NO: 632869 - DNA, 296 bp, Homo sapiens
atagctactccagcctgggcataatgagctactccagcctgggcataagagctagactccgtctcaaagaagaaaaattcccactgaaggcgggttgcggcagctcaacgtctgtgatcctatctcctttgggaggctgcgtgtgagaggactgcttgaggccaggagttctagaccacctgagcaacatgacaagatgcaccatctctaaaaaaaataaaaataaaaattcccactgatcttagccctctaacaagctcttattggccaggagctcttattgcccaggctggagt

SEQ ID NO: 632870 - DNA, 301 bp, Homo sapiens
ctcttagatccccttcgacgggtgtgctgacactttttaaaaatacggaaaaacctttgtacgggtagtgtatctagagcaggcaagggagcatgtcttacctggtgttgaccaaaagggcacccatcagagagacagttgcaatttcagaagaaaacaggattctaggcaaaactaactggtccacaggagaaaatgagagattcgatttggttgccaggcacacttaagccctggcaagctatgtggcaggaacacaagaggtctctggggaatggggaggaactgcggtctcgctgaa

SEQ ID NO: 632871 - DNA, 404 bp, Homo sapiens
  misc_feature (10)..(10): n is a, c, g, or t
  misc_feature (33)..(33): n is a, c, g, or t
  misc_feature (84)..(84): n is a, c, g, or t
  misc_feature (106)..(107): n is a, c, g, or t
aaaaggcctntatgtccaggacaaccgggaganttgaaaagaccggcaggccaatgagaaaaccccgcgcccaaagctttcccncggccaaagagggacagggccnngggtgacagggacagagagggcttctggaggaaaaaagaaaaaaaaaaagatccaaagctccagctgaccgggccacatcggcctggaagccgggcccataatgtcctctcggcctcagatgtaccgtgccaccggtgacagggacaagagggcttctggaagaaaaaatttaaaaaaaaataagatccaaagctccagctgaccgggccacatcggattggaagccgggcccataatgtcctctccgcctcagatgtacagtgccaccggtgacggggacaagagggcttctggaa

SEQ ID NO: 632872 - DNA, 195 bp, Homo sapiens
  misc_feature (64)..(64): n is a, c, g, or t
cgctccgcttcatacctgcccatggctagatcactccgcttcgggtcttgagctgtgctactgncttcgccctattcggactcgctttcgctacggcgttccccactcgggttaacctcgcaacacaccgcaaactcgcaggctcattcttcaaaaggcacgcagtcacgagagtggagcaagctccactccgac

SEQ ID NO: 632873 - DNA, 602 bp, Homo sapiens
  misc_feature (48)..(48): n is a, c, g, or t
  misc_feature (305)..(306): n is a, c, g, or t
gagcccgccccgcaacatactcaacatgaggcacgagagtgagaggcngcaagtcggaacttttggcccactggctgaaataactggaggggcaacccaaaaactcttggaaattttcaaaaagggggggacccaaccccctgttttaaaaacttggggtttgggggttaacaacattttcaaaaagtgggggccgcgaggaatatataaaaccccaacggaagaagagggggtgtgggggggaaaaaaaaaccctttgggggaaaaaaaaaaaaagggggggggggggttttaaaaaaaaaaanncctctccccccccagggagggtttttttttggggaaaccccccccccgccctggggagggaggggggccccccacaaagaaaatttttttttttaaataaaacccccccccctttaaaaaaaagaggagagagttttttttttcctcccccccccctttgggggggggggagacgcccccccccccccctccttttttttttttaaaaggagggggggggaacaaaaaaaaacccggggggggggggtttttttttttttttatgggggttttttctcccccacccgcgttgtttt

SEQ ID NO: 632874 - DNA, 173 bp, Homo sapiens
aatgcgcacgccagggcacagcaccttaccttgaactaggctatggcgcacagatctgtgcacgcgtgttcgcgataacccgcgctccaccattaccgtatagtcgtgcccacatccctctctccgacatggtagagatagtgctcgatacatacagagagacccgggcggcg

SEQ ID NO: 632875 - DNA, 322 bp, Homo sapiens
  misc_feature (268)..(268): n is a, c, g, or t
tatctctaacattatgatatcataatggcatttcactcattttccttttaagggaaataaatacagttaagatatcataaagtttgggatgctagaaacctatctgcaacaccgaagagagtctctaactctttagattaagtttcatttcagagggagtttcttgaagacaattagatgcaaatagccttctcacaattacaacctcattgtaatttctggactttgattccagtgtttgggatggtttgggcccctgggatggggntgatggtgcatagggagagaatttgttttgttcatttcattaatgtagagaata

SEQ ID NO: 632876 - DNA, 191 bp, Homo sapiens
tatctcaaaggtactggctgggactatgcatagagcagtccggtccaaaaaacatctgtgtatggtttcatctaaaaagacacgcagtataggaaacactaaaaacgtgttaaactttgtcgtgatattgcattcctgtacttgacacactgtcatcacagcaaaaagtttaagattaggtaatgaaatat

SEQ ID NO: 632877 - DNA, 138 bp, Homo sapiens
agggaggcagaggctgtagtgagccaagatcacaccatcgcccgtatttacttttctttctttctttttattttttttttggaaacaggttctaactcaatcgccggtactggaagtgggatctcctctaaaattcac

SEQ ID NO: 632878 - DNA, 357 bp, Homo sapiens
ggcacagaatctacaatgccccaggatcgaagttgcctctagttgccctgttctatctctccaccttgtttggagtaaccagttccttcctgctttggaatggggcaatacttcttactctacactacgccacaggaagtgtctctggcaccacataccactggactctgctctcttctcagggtgcaacatattaatatgcctgctacccgctgggcttctgtgtctgaacggaccgcttatccagaaaccgtctcaaatggtcaaggatttcatggcaattgctatcgccaggtgagtggcacagccaggttgtaacacttttcattcatctctttagcctacatcttccttaca

SEQ ID NO: 632879 - DNA, 396 bp, Homo sapiens
tgggcacaggaggatgttattttaaggtgtgcaccggctgagtggattcaaatccaaaaagctgagcattaaacaaagacagagcagggtttttataagtggacttacaaaagtaaaacaaaagcagttaatcatatagtgcataacttgtggccttgcatagctggtggccttggagctgtgtcaaaagaaaatcaagaactggctaaatacagacatttgtaaaacataatcatgcttaagaagccagggaaaggagtaacagtaaaggaatttgtcttcttcttttttttttttttttcccttacaaccttgtcctagaggggagggattgtctgggaacccattctttgggactgggtttctcaaacaactatatcttcctgtgcgcaagct

SEQ ID NO: 632880 - DNA, 352 bp, Homo sapiens
aatttggcactgaggggtggttgttatttccgaagtgggggctgatcttgcactatggaccttggcagtgttacacaagatttgttgactcaaggctgagttatctaagtgtgtccttcaattggtgttgcataagtagattaaccagactgaattatagatcgaatgacatcattccctgctcaggaaactgcccctggtttttcacttccatattgtggccctgtcctaccattctagcctcccacttttttcccctaaaggaactatgttgacatttgggaagagtgtggggcaagaagcctggcactgcagaacgtctcctttctcccttccttctttctctttcttt

SEQ ID NO: 632881 - DNA, 161 bp, Homo sapiens
gtctcccacttaaggcatccgtggttgtttttaagccacataaaagccacacccaagatcacctgacacccaccctgtcaagtgtccatgatgctgggccctgaggagggtgaaggctttgtggtaaagctccgtggcctgccctggtgcctgctcttgtt

SEQ ID NO: 632882 - DNA, 744 bp, Homo sapiens
  misc_feature (584)..(584): n is a, c, g, or t
gaggcatctcgtgaagatgaaccacttgcttattacgacgcagagcgcaactgagatgaatgacatcagggaaccacagctgtgggaacaatggagtaacttacctgctaccttgtttagtatagaagcgagcatactcgatgtggtcttgagacagcatacagacgctattactgtagttgtgccgtagtaactgtcctcctgatcagaaatgactactcgcacttgtgtgtacaccccagagataattctcgtacacagaaagtggtcatctatgtgcagagacaagtataaaattgccaggtatctgaacatgaggtgcccatagatcaggttgtctgtgacatgtgtgaacctgtttgtaagcactcgtatggggtggcagactctgtgtataagaacactatgaggacttctggctgcgctctctatctgagctctgatggagagaacacgtctgaagagggacaccaacacacgtgctagcacaagggagcgtgcccatatataagatcgtgttctgtggaaagggccacacaggcgtatctgtagatttaacattcccacgcacaggtgcacatatntgctggaatatcgctcctgtggaaaaatttcacgtgatgccacggcccaggtcattctatgagcagagtgggcggaccaaacatttaattattgaatatggccgacaatgtgcacctgctgctggacatatagtaacaagttgttgaggggtcctctctt

SEQ ID NO: 632883 - DNA, 456 bp, Homo sapiens
tagaggatccccattggatagcggatagggcgcagtatgctcatcttcttgataatgcaaaagcttgggacccctcgctggttgaaagaagcattcttgccctctctatcagtgttgcatcattcggggtgtcaccttgaacagactgaactacctaaagaatggtgtgctaaagtctgccttaaaatcttgcatggcccatgaccccatctccccagtgctctctgatcctcatcttggacgccgtggaccagcgggtcctgaagtgtcctggccaccgtgaagcagtgcaccgacccagtttgggcatggacacagtaactggtggaaggacaggatgcctcgtctcacacttgtaattctcgacacaaaataagtgaacattctttttacaaagatagagaaacagcacaatcaattccaaatggtatgagatggattgggagtggacagcag

SEQ ID NO: 632884 - DNA, 113 bp, Homo sapiens
gatccacgtttaatactgcttgtctcggctggatgatccactttaatactagctatgtctcggctggatagatccactattaatactgcttgtctggctaggataatccactt

SEQ ID NO: 632885 - DNA, 377 bp, Homo sapiens
cgttcaggtgacacgatggtgtataacattcctacgcccaggaatgatttcaaacagcatgaaaacattattttccttatgctttacaaagacttactctgaatcacctgatgtcaggagtacgagacatgcctggtcaacatggccaaatcccatctacattataaacacaaaaattagccaggcttggtggtgcatgcctgtagtcccagctacttgggaggctgaggcaggagaatcacttgaacccaggaggtagagggtagtagtgaacccagatttgcaccacttgcacatacccagcctgtggctgacaggagactactgtatcaaaaaaactacactaaagacttactactacacctgacgctagtaaa

SEQ ID NO: 632886 - DNA, 570 bp, Homo sapiens
gtagcccatcaaagagctacagcatgcagtttgtttaaagtgattgtctctacggagaatctgatcgagctatacgaaaatctgtactagttattatactgaagctagtattgagctgcactttaatacacattcttagcaaaactattgcctgatcacacatacacattccatacgcattattaaaggatagccatttatcttcatcttcatcctcttcctcctcatcttcatcttcttcttcctcctcctcctcctcatcttctggttcgtgcttcttctttgagcctgttggcctgccagggcccttcttttcctgtattcacttttgcacttggcacgatatgcagcaatatccttttcatatttctccttaaccttaactgcttactgtacatatggtcggtggatctattggctgaacgctcagaccacatttcacccaatgactttgcagtatccccaatggataggccagggtgttcactttggatctttgggcgatgttcagagcacaacaggaagaaggcagatggtgcctttaagagcatggggtctttttcttccctt

SEQ ID NO: 632887 - DNA, 272 bp, Homo sapiens
aagggaagtcatcaagtatctgtgctgaccaggatcccggtggacatgggggctagcatgccacttgaggggtcagagagtcttaacagagtgctttaggggattagccgctgacatagcacaggctaaggtggcttaggaagcattatgcaagactacgcccaggacgccaagcttcggtattcattgcgggtgtatgtttacataaatgtgcctgtatatcgtcagtttatctttccaacacaggtgggaggcaacaagagattctcctt

SEQ ID NO: 632888 - DNA, 163 bp, Homo sapiens
ccacctcatctgcatctcgtagctgttactccgaagttccctcaggatagctggcgctctcgtgaacccagggcacccgcgctacgaagttgtatccggtaaagcgaatgattagagtgtcttggggccgaaacgatctcacctattctcaaactttaaatgg

SEQ ID NO: 632889 - DNA, 1017 bp, Homo sapiens
ttatttcgcccaccggtagtcaaggatctcataggtttacgctgccaccagttttcacgcttacgcgcggcctccagggtcatcattgaggagggctgacggcttctccatcgctatattaggcctcatctgggcccaaccacgtgaaaagcttgcaattatcatggcttgggtctccaagcaacttctctacctgaccctcgctcctgggacagcctttcgggaggttttcttggcctcactagagagggatgtggaagtctgctgtacccccgtactaaggtagaaggtattctacagcctggatggagggagttgacggcaaacatgcacatccagtgcaccaagcggtgacaccgtaggcatctgctctgaaggactctcctgtggctctggctgccgtatattcgtagagaagtttgccacctggaccaatacaggaattctcgatacctggaggatgtgaggctctggaaaggaagttctctctggacagacctgcttgacctaacgtcatgcgtctactggacttacaggcgaccaatcatctcctcccagcgcttctacaaggagaacctgggacagggctggatgacccagaagcatgatgcggatgaaggtctatgtgcaccactggcttctctgccttccctctttgagatattgcacacgctctgaaaagtgggtgaggttcaagtacccaaagctcatctcctattcctacatggttcgtgggggccactttgcggcctttagaggagccggagctgctcgcccaggacatccgcaagttcctgtcggtgctggagacggcaatgacccacccctctccccccgcctgccacctcccgcccacaagtgccctccaggcttttcttggggaagataccaccttttctgaggaatgagttgcctccgtcacctgccatgtggagcaaacgctaccccctcaccccttaaagctcagtcccaacccccactccgttagccacggcatgcttaacgtttctccggctc

SEQ ID NO: 632890 - DNA, 902 bp, Homo sapiens
gaaagaggcgagtaacctgatgcaaaggtggctctgcagcataattgaggcattgtatgagctgtggttgtaacgactctacaagatgggtttccggaagccgtcagttcttgtagaactcatcaagttgaagctgtaccaacactagctctgcaaagtgatggattgaaagcaaaatctggttgtttaaggagatggacgaagaacacttgaagaggagggtgaaccagttggtgaagaagatgtgggggtatttttgggcttcgaggtgaaagatggccctgggggtaaagagggcaactgggtgggtggatgtttaagaatggtcatatgatctgtggcttcctatcgtcagataagaagggtgactgtccagatcacatatggctgactcagacttccgtgggatatgtatgagcctggctaaaatgaatcgctcagtcggtcttctttcaaggcaaattcgaaaatgcactgtgcaacactgggtgctcggcgtatgatagttacccaatctgcagtgttcaagcatgcaaagtgaagctctggaagaactcgcttgggtacttttgacccatccggatgcagattgtagaactctatccatacttctgttgtccgagtttagactgaaactaaacatggcaatacggggataatcgctcttacgcgggtgacaaccggataccatgcctggtgaaaaaaccggaggttacacggcgcggatgcctcacggcttcaaatcatgcggacaaggcgggcgaagagccagaaacacgagagcgaccacagtttcacaacgtgttggcaacaagaaccgcgacacaaaacggggaaacaacaggatgacacaacacactaaagaaacagaccaaacagaaagcctgtccgacacacttcgg

SEQ ID NO: 632891 - DNA, 391 bp, Homo sapiens
  misc_feature (65)..(65): n is a, c, g, or t
  misc_feature (67)..(67): n is a, c, g, or t
  misc_feature (79)..(79): n is a, c, g, or t
  misc_feature (84)..(88): n is a, c, g, or t
  misc_feature (92)..(93): n is a, c, g, or t
  misc_feature (99)..(100): n is a, c, g, or t
  misc_feature (102)..(103): n is a, c, g, or t
  misc_feature (130)..(133): n is a, c, g, or t
  misc_feature (136)..(137): n is a, c, g, or t
  misc_feature (149)..(149): n is a, c, g, or t
  misc_feature (164)..(164): n is a, c, g, or t
  misc_feature (357)..(357): n is a, c, g, or t
gtttgcgaactgcgggtggactgtgtagtgaccggcgtccgctgtctcgccccgtggcgggtgancnagggtgcgtggngcgcnnnnncggnnaacganngnngtgcgggcggggcgcccgccgcagggnnnntgnnctcctgcgcgancatcgacatcgaggncgccacgcagcacctgcgggacatcctcaagctggaccggcccgcgggcggccccagtgcagagagcccacggtcatccagtgcctacaatggggacctcaatggacttctggtcccagacccgctctgctcaggtgatagttcctcagctaacaagactggtctttggaccatgccacccattaacctgctngagaagcaggtcatctgtcttttcggagatgata

SEQ ID NO: 632892 - DNA, 566 bp, Homo sapiens
cccaggaaacagtatgactattatgcacagaacagcaaaaagaacaagaaaacataaagtcaaatgttcaacaaaatacacctattaccccagacaccagccctgccatgcagaggcacggttgctccaggcttagctagtctcagagtgggttatgttacaggagaccttacccctgtattgctttacttatatacagaaaaggtgagtgtgaggcagggaccattagaccaaccagccagtaggaggtttatcactggagagtggttttgctggagaagcacccttctggggcccatttgcttaggaagtccatatactagctccagtgtcagctggaaaccttgtagcctgtccactaagctagctcagtcctggcaagctgcctccttgaaaagcttaccacaagggtgtgggggaatatgagactcaccaggacaagccagcagagggtttgtctctgcatagagtctctaatgtaatgctctgtccatttgaatataggtattatagtatccctgtacaagagaaatcctagaaatgaaagcaatgcttttaattctaac

SEQ ID NO: 632893 - DNA, 172 bp, Homo sapiens
gatgaaggccctctgtgttgcgaacgcacgtgtacatcctgaaatccttccggtgccaggactcaccctgacggctgtacaggggattgttgttcttctccatttcatcaggggccaccagggcccatggccagagacgggggctgactgaggacctcacatgggcgtctgc

SEQ ID NO: 632894 - DNA, 848 bp, Homo sapiens
  misc_feature (227)..(227): n is a, c, g, or t
  misc_feature (230)..(230): n is a, c, g, or t
  misc_feature (239)..(239): n is a, c, g, or t
  misc_feature (251)..(251): n is a, c, g, or t
  misc_feature (261)..(261): n is a, c, g, or t
  misc_feature (266)..(266): n is a, c, g, or t
  misc_feature (284)..(284): n is a, c, g, or t
  misc_feature (317)..(317): n is a, c, g, or t
  misc_feature (322)..(322): n is a, c, g, or t
  misc_feature (324)..(325): n is a, c, g, or t
  misc_feature (338)..(338): n is a, c, g, or t
  misc_feature (391)..(392): n is a, c, g, or t
  misc_feature (394)..(394): n is a, c, g, or t
  misc_feature (398)..(398): n is a, c, g, or t
  misc_feature (403)..(403): n is a, c, g, or t
  misc_feature (406)..(407): n is a, c, g, or t
  misc_feature (625)..(625): n is a, c, g, or t
  misc_feature (630)..(630): n is a, c, g, or t
  misc_feature (688)..(688): n is a, c, g, or t
  misc_feature (722)..(722): n is a, c, g, or t
  misc_feature (727)..(727): n is a, c, g, or t
  misc_feature (766)..(766): n is a, c, g, or t
  misc_feature (771)..(771): n is a, c, g, or t
  misc_feature (781)..(781): n is a, c, g, or t
  misc_feature (785)..(787): n is a, c, g, or t
  misc_feature (795)..(796): n is a, c, g, or t
  misc_feature (820)..(820): n is a, c, g, or t
gactcagcatacattttccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaatataagcnatntacataatntggaaaaatctnggatttctgntgccnaagggttaaagcttcttnggatttcatttcattgatatacagccactattntattntnngatcagtggcctntggccactgttcagggtactgaccatcagtgtcagcattagggtttggttatnntncttngggtnttnntttttggcacatgtgaatcttgtttgtgtaaaatgaaattactttctcttgttctctgatgatgggtttaaaattaaaagagcatccggtttggtatggggatgatccaggattatgttgtgactgatacatattagttacttgtgcttttatattatgtattggaatcttggcaagggcaaaactacaagtaacgagtttatataataattaaattngtacnggtttcatgtcaggataaaccatacttccaccttgggtgaaaacctgtgcaacagttntattaatgaggtgactttcaccttaggacaacgntggcnatgccaagtttttggtgtgtgtgaaacattcaaaactgntttanaagatgtaantttnnnaatgggtnngtatctaatatgccccaggttcgntaaataaacaattctttctacaacaaag

SEQ ID NO: 632895 - DNA, 717 bp, Homo sapiens
gcgcagctcatcgactccatggccaactccttcgtgggcacaaggtcctacatgtcgccagaaagactccagggactcattactctgtgcagtcagacatctggagcatgggactgtctctggtagagatggcggttggagaggtatcccatccctcctccagatgccaatggagctggagctgatgtttgggtgccaggtggaaggagatgcggttgagagcccacccaggccagggaccccgggtggagggccccttagctcatacggaatggacagccgacctcccatggcaatattgggagtatgtgggatcaccataggtcaaagcgagcctcgttccaaaaaattggccagtggagtggtcagtccgtgggaatttcaagaattgtggtgaataaagtggttattaaaaaagagccgcgccagagagagcagattgggaagcaattcatgggttcagtgcttttatcaagagatcgtgatgctgaggaaggtggattttgcaggtgtggtctgttccaacaatcgggcttaaccaggcccagtacaacaaccaatgctgatggcgtctaaagtgttagggaagcaacaaagagcgagtcccttgccgggtggttttgcatgtcgctttgggggctccttcccatgctggtctctgttccagatggtggattccacctgtgcacaaggttggaggacacacagatgtgcaga

SEQ ID NO: 632896 - DNA, 736 bp, Homo sapiens
taaattaaaccaaaaaatttttttttaacctttttcggaatttcccttaaaaacaaaaagggaatccccctccccccaaaataaaaaccctttccctcacaatatccatcccagttatgaactttcacagatattttctagagggagaatttgcggcaacattttattccaagtggtagtttcccccaccggtgtactctccgtgaattatgaggttggaacattatgtgcaaaagagccacctcttaccttctcttttattcacggtgggcttgtttctcctcctctacagagaagttttataaaagtgtacacagatattggacattggtaaaaagtaagagggtttctcccacaacccacgggggtgtgtgatacccaccttggcctaacaatattgtaaattttctcgtagatcttctccaaagggtggatctcacctttgttgataaaagcttataccccttgtggcacagtgcttttcttgtcccgggtttggacaaatatgtgcgaaaaagtggggcgataattcctcgggctttctccccaactctagtgggaatattgttatttctttcccgtggtaggagaatttacccaccccgttaaaagaaaggggactctccttaccaatattgagggctctctcccaacactttccccaatagtgtgaaaaaacttttctcacaaaaatattggatttcccccctttgctatgtgtggaaaaaacataaag

SEQ ID NO: 632897 - DNA, 703 bp, Homo sapiens
atacagaagcagaaaagcgagacccccaggaactcgtggcctccttttctgaaagagttcggaacatgtcgcctgatgaaatcaagatcccgccagaaccccctggcagatgttcaaatcacttgcaagacaagatccagaagctttatgaacgaaagataaaggagggaatggactatgaactacattatccaaaggaagaaagaatttcggaaccctagcatctacgagaagctgatccagttctgtgccattgacgagctggcaccaactacccaaaggatatgtttgatccccatggctggctctgaggactcctactatgaggcattagccaaggacccagacaacctctgaccatggacaaattggcacacggccaaaccagcgaagcgaacaaacaattgacgtaccgcgacggcgcaccaccaaaaaggcaccacgaccaacggccacgtccaccaccataccactgccagacacagctgcttgccagatgctcagaagagaaagagcaagctgggacaacggctacttcccagtgaccaaacgatagcccagcccaccatccaacaccaccacacacccaccctgcccagcttgtcgaaacaggacaccacccacgcccacgggctcaagacaccgtatctcgtgtcggccacagcgaagacagcacacgcgacctagggcaccctaaactgcc

SEQ ID NO: 632898 - DNA, 257 bp, Homo sapiens
  misc_feature (19)..(19): n is a, c, g, or t
  misc_feature (230)..(230): n is a, c, g, or t
  misc_feature (233)..(233): n is a, c, g, or t
atctttaaacatgactganggaatttcacgaaatgcccactctcttggaacttgaggagaaacggttggccacccatatgtcacctagcgctatattctttcaggctgagattcttcttctggaaaattgaggagcagaactggccacccttggctgctcaagaggcattttagagtaggagatgcagttggatggtggggaggggaaggaaatagttattaaataatgnaanatggaataaagttatcttggatgg

SEQ ID NO: 632899 - DNA, 155 bp, Homo sapiens
gtccttcaaggatttttaataggttagggccctaaattaaggatttacctccggttcgagttactttttgtattggtgaaagaatgggaaccccacaaattctatggggtccggcctaaaatccaaaaaattggcaaaccccttcttcgtggaaa

SEQ ID NO: 632900 - DNA, 289 bp, Homo sapiens
cttgcgtgtctctacacagaatggggataggggatacagcatctggtggccggctcctcaagggcttggcttgtggaccacatttacttctgcttggtcttctgctgtggctggtgctggatgtgactattggaagggcagggctcaggcacctatgggtgcattggttctggaaccttgggctaggcagggctcagtgtactttgggggtggcagggctcaggcacccttggggtaggcagggctcccttggtttaggggggatgcatgggtcccttgagggtggagg

SEQ ID NO: 632901 - DNA, 254 bp, Homo sapiens
  misc_feature (216)..(216): n is a, c, g, or t
  misc_feature (250)..(250): n is a, c, g, or t
accccatctctcccaaaaatacaaaaattagctgggcatggtggcgcgcacctatagtcccagctactcgggaggccgaggcaggtggatcacaaggtcaggagatcgagaccatcctggctaacacggtgaggccccgtctctactaaaaatacaaaaaaaattagcgaggcagtggagtttgtagcgagttgggattgtgccattgtactccancctgggcaacagacgtgagctctgtctcaaaaanaaaa

SEQ ID NO: 632902 - DNA, 154 bp, Homo sapiens
cgctgactcgtgctcccaaagtgctgggattacaggtattagccaccatgcccagccaaaaagaccctcttctgaaggagggtgtctatactagtcatgagtttggggagatctgggcccaagaaggatccttactgtgatcgtggggttgtaa

SEQ ID NO: 632903 - DNA, 147 bp, Homo sapiens
tcttaaagtatgtggcaaaacagtacacactgttaaatcactccatttctatttatttactgaattattttacacataaactgaattttagtttaaagaaaaactacactttgagtaaacaattctatcatacatttacttttacag

SEQ ID NO: 632904 - DNA, 295 bp, Homo sapiens
  misc_feature (1)..(2): n is a, c, g, or t
  misc_feature (113)..(113): n is a, c, g, or t
nngactgacattcccatggctgtggacattttggcggcttggcgtgctcccgtataggtggacggcgttcttcgcaataaacgtttcttctcaagccttaagcacaccttcgnagtctcctcatagataagaccggaaatggcgcttggacgccaccgcggccgagcccggcggatagccggttttgtaatgccctggatgttatcccggagcaccttacgatggcgcttagcaccacccttccccgccttttccgcctttgccgcggaccagacatggattcctatcggcagtc

SEQ ID NO: 632905 - DNA, 344 bp, Homo sapiens
gcactaggttacaaatccatgagtattactctatgtcattgaaaagttcaatttagatctacaaatacaattctacggccttggtgtactagcctctttccaggtagcttacaggctaggtttcactttcctgaaacggattctccgtcatagaagagatagcgtatatctactttgacatcttcagttttcctttctgccattttcctggtttccccatcaggaagaacaatatcgatctcacaaattggaccaaaaaagcctccaagaaaactcattgtcaacgccgccgacgcgtcccccctactccactcctcttccctcaggagaacgcgtcaaaatcg

SEQ ID NO: 632906 - DNA, 573 bp, Homo sapiens
gcttgaccccttatccgccacatctgctgacttccccatatccccagtgtaggcatccagtgcccctcccctgactggcaagcgagtgcggggccgcccaaggaaggacaacctgataggactcaatgttttgggtccccaggtggcctgagggaggcaggcatccttccatagcggtctatgtggtaaggtgttacactgattgccaaccggctaccggcagacacgaggcccagcacgtgtgtcaccagcctaccagactgggctacatctgaccttcctcctccgagtgctaggtgtagagaatgggctacccatctctgaagaccccgacggaccccgaaagagtgagcctggaccagggaagcaggtggcttgtagagatactgcgtgcaagatactatccgtagatgctgtaacatctataaccggcacaagcttgtacccactcttggggagaagacctactacctatgccctagtgtagtagggtaagcgggttacaagagaaaagaccgcatgtcctaaccatgtagcggtcccattgatgggtccgcaggtggcaggccttag

SEQ ID NO: 632907 - DNA, 378 bp, Homo sapiens
gctcggccttttcgctaggtgagtactcaaagcgctgtcttagtccgagagaactgcgaagtggatcccagcaagtgctcgtgccgctgtacctcccagagcaccaggacaacccctacagatgtgctgcgagtctggccttcgcgcaaggatcatctattcctactgtgtcttcccacgggagttgcagaggtgtttgcctcgtggaggcatggagtgcagcaggtctgcggccgcccggacatccgtgagcggatcatcagcgcctccctcttcctgcgcttcctctgcccagccatcatgtcgccctcactcttcaacctgctgcaggagtaccctgatgaccgcactgcccgcaccctcaccctcatcgccaag

SEQ ID NO: 632908 - DNA, 836 bp, Homo sapiens
  misc_feature (202)..(202): n is a, c, g, or t
  misc_feature (204)..(204): n is a, c, g, or t
  misc_feature (207)..(207): n is a, c, g, or t
  misc_feature (212)..(213): n is a, c, g, or t
  misc_feature (215)..(215): n is a, c, g, or t
  misc_feature (219)..(219): n is a, c, g, or t
  misc_feature (225)..(225): n is a, c, g, or t
  misc_feature (609)..(609): n is a, c, g, or t
  misc_feature (611)..(611): n is a, c, g, or t
  misc_feature (633)..(633): n is a, c, g, or t
  misc_feature (641)..(641): n is a, c, g, or t
  misc_feature (681)..(681): n is a, c, g, or t
  misc_feature (691)..(691): n is a, c, g, or t
  misc_feature (697)..(698): n is a, c, g, or t
  misc_feature (703)..(707): n is a, c, g, or t
  misc_feature (709)..(710): n is a, c, g, or t
  misc_feature (712)..(712): n is a, c, g, or t
  misc_feature (723)..(723): n is a, c, g, or t
  misc_feature (741)..(741): n is a, c, g, or t
  misc_feature (743)..(743): n is a, c, g, or t
  misc_feature (745)..(745): n is a, c, g, or t
  misc_feature (756)..(756): n is a, c, g, or t
  misc_feature (758)..(758): n is a, c, g, or t
  misc_feature (764)..(764): n is a, c, g, or t
  misc_feature (767)..(767): n is a, c, g, or t
cacgcgtcgcgcagctccctcgcggcggctcacggagatggctcttgactcggacttgtggtcgcgattggaggaaaaagcgcgggccaagtgcgaacgagatgaggctgggaacccggccaaggaaagcagcgacgctgacggagaggcggaggaagaaggggagagcgagaagggggcggggcctaggagtgctgggtgncncgngctcnngnggcnggacanggtcctggggcctgcgcggcgctggcggcgtccgctgctagcaacgtgctctactgtgcggagatcaaggacattggccacctgacccgttgcacgttgtaaccgaggaactcggaagctacagccgaaggaaggtgggagctgcagcctcgcgggggctgatgtcaagactactctctctcagatcccaggattggcatgtgatgagagagatgagccgaaggcaggagggaacgccctgggaggtgttgatgctgagttggggaggctcctagacgaactcgcccccatctactgactgtgccagtcttacattttcaggatggagtggcaagggatgatataaacaaagcctacgttaccgtgggaagaagacagactgtntncttagctgggacgttggctttngtccaggntggctctggtgtgtgggagcaacaggtcccattttagcanttctttgtcnatggtnngaatnnnnnanntnttaagatggancgggagagacgaggctantntncgcgtcctgtnantctcanttntctgggcatgtaagggatgatggtatggactggatgtttcacaatacccaggtcgggggttccgaacaa

SEQ ID NO: 632909 - DNA, 109 bp, Homo sapiens
cccgtcatcaaacttcatcaaaccctcaacccttagccacagtgaagggaatggaaaatgagaagccacgagggcccctgccagggaaggctgccccaggtttcgatga

SEQ ID NO: 632910 - DNA, 247 bp, Homo sapiens
taatactgagcttgcacacacttgggaacctgcccagacgtgaggtcagtgagagtgggttacatgcattctggaaaacgtgggattacttgattacatgtacacccaagtccccacagccctgggatccatgcagagcacacagtgcaagagacgtggctcccctgctgagatccagctgctctgaccgggcagtcactttgtcactcagaaacagagatgcgatttttacggtggtggaacatgg

SEQ ID NO: 632911 - DNA, 310 bp, Homo sapiens
tcaaaaaccaaaacattttaactcttggggctcggggaaagggccaggcagagttgcaaggtgtgctccacaggaaggggttaagcagaaggaggagctacgagggggctacagctcctagttacctgtgttgggggaaggactgagggaatggtgaagttggtgtctcgcggaggggtgctccagttccgtgggtgcccagtttcgtgacaccgtgccccttctgggagtttcacagtgggaagttcctttgcaagctccgtgaaaaccaacagaggccgtgccttgaaaccctgtgggttcaggaaga

SEQ ID NO: 632912 - DNA, 111 bp, Homo sapiens
ctggaaaggcgatggtggagtaatcttccaactcaatttttatctttgacaaggcgtgagcagtagaaaactgcattcgagtcacatcctcaagatagtcatgcacagcag

SEQ ID NO: 632913 - DNA, 905 bp, Homo sapiens
  misc_feature (417)..(417): n is a, c, g, or t
gtcaggtggagcgtcgcggcgggccgcaggtcgtggatgggcgtgttctgcggccgcgaagggcgtattgtggtcggcggatgtggaggagtctcttgaccgagatggaggtggtggtgcaggagagcgcgcgaatttcctgatgcaatatcatggtcatcgctgaagctattctctttgcgtctcatcagcgcacccaggtcacttggcagcctaagctgtgaatgcgaccaggtccgatcagccttgaatcgtcatcgagcccagctgggaaggtcgtgtctaccaggatccttggacaggttccaggtaaacagcatacactatagtctaggcttacttagtcattaactgttgcgatgtcctgcagtttcgcgcttctcgagtgctactggaaagatgtagacgacgcatccntgtgcaaagcatctacttggcgagttatacctggagctcaggttatgagggaccgtcgtcagcgagctaacgtgtctctgacaagcagttgactgacatattattgattggcacgaaggaatacaaggaaggcactacaagaggtacatgattgagcagtcattgcttgtcaatacactagaatacctgtcacagaaactgcattgaacagcgtcagtgattcacgactgtgaaaagaggtgaaagtggagtcttcacgacatctatcatggttacatgtcccgttttcccttccagggactgcagagacggtgcatgtagggtcgtgagcctgtggtcctcgtcggaaggggttgcgtagtgatgaagaagccctgtagcagtctgtgtcatgaaatatccctgatgccagatctctgacgacgcttcggtaagacaatgtccctggatggaatcacgattttagacttcagataacggcctaatat

SEQ ID NO: 632914 - DNA, 938 bp, Homo sapiens
ggcggaacgcgcgggatcttgcgtgctgctgggcctgagctgtctgtctcgtttctgtccgcgcgccctgcatcccggcccgggcgcccgctggaggtcgccgaggagccacagggctgactggtcttgctgccctgggcccaggagtgcctggtgtagcagtcgcggagccatcccggcgtctgctgccatgaccgactctcccctcagaggagactcttcctcagcggtggctgcagagacagatgagcggctggctcctggccgcgggaccgtgagactgggttctgtggcctggccatttaggtgggacgctgctgaccacctgctgctgcccctccggactggttccttgggccccggaagctcgctggctgggccctgcgggagggctggcatgctcccggcggagtgctgctggccgcctggctggctggggactgcgggggctggggggcctgcttggctgcttcatggccaatcagtgccgcttcgtcacgggcctgcgcgtgcggcgcgccgcacacagatcggcgcagctctacggccgcctctactccgagagctcacgccgcgttctcctcggccgctctggcgccggctgcacggccgacctggccatgcctctgccttgatggcggggttagccgggcgtcttcgtttggggacgaggagaggatccaggcaggaggagttgcagagatcttattaattggagatagaagcggttggaacaaattgtccacattatgttcagagctctgagagtccagcacaacccttcagaacaaaaagccaacagaagggcatgaagattcacgacggcccagaagccaacgtggaaattgtgatggctagcacaacctttagctgggcggccccaataactggacccccttcaataccgagttggacctacagttttaacccgcgttaaa

SEQ ID NO: 632915 - DNA, 234 bp, Homo sapiens
ctgctcttgaggatccctcacagctttgggcctccacgaggtcctgcctatacctggaagtcgggggcgcaccttcaccttatctccaggctggccagctgggccagtgaggagcaataggaccagtaggaccccttgggccatctttccctgggacaccatcagcacctgggccacctggatgctgctggtaactcctggtctgcaaggaatgcctggagaaagaggaggccg

SEQ ID NO: 632916 - DNA, 398 bp, Homo sapiens
  misc_feature (128)..(128): n is a, c, g, or t
ctcatcctttctcttggctaaccttcattttggtgccaaaacccaggaaggggataggctctggctgggcgtccttagaggattctctctctctctctcctatcatcccttacccagccaacctcccnttcccgaacctgctaaagaccctaaggatctcccaaaattctcccattgttggccacctcatccaccatcaaagcctctgagagggtttttacagggccgtgttagagcctaaggatctcccaaaattctcccattgttgggccacctcatccaccatcaaaggcctctgaggaggggtttttacaggggccgtgttaggaggcctttcacccatgggaacagttacaagacatggatggttattccgaggaattaccgacaggttccgg

SEQ ID NO: 632917 - DNA, 1115 bp, Homo sapiens
cggttgccgtagctgaaatggctgcaccatgtcggccttcgagaagcctcagatcatcgcccatatccagaagggcttcaactacacggtgtcagactatcgcaaaaggccaacacctcattaaatgtggcacacatttggtgcaaccatctttcacagcagagatatttcagctactggagatcttggctggacaacttcatatatgttaatctcagcacagctccagcacatgccagtatattcatgtaaagggccatcacacagcacaattataacatgccatagcatggccataggtggcactcaggcacatcggcagcaaggagcacctgaaacattgtgcactgagcacgccgcagcactgcgacacctgtagacacgcgtgctgggaccccacacggccacaccacccacgactgatccctgatagctacctactgcgaaccctgtaccacacccgagacaccaccaacgacgacgacctgctactcgggaaccctgtacaggcacatttcgcgccaacttagactttacataagtaccaacgaaacgaaacccgctgctcccgctcatgctagacctgagcctactgaaccctacctgctagcgaatacttcacaaccctactcctggactcctccacgcaaaactaatacggccaaactcaaccgcagcacgaaggaagacaacaacacgtactcccaacaaaaaaaatgaggagagataaatagccaaagccaactgcagcacacctacacagaccaccacaccaccactaccacattaaagccaacttgacaataccaggcccaacattacagcgccaacacaaccctcccacgcaaacagacaacacaggatactcccaaatagactcccagtcacgacccggcctacgcaaacacccccacgtgcaaccccccaaacccacaaacggaggaaccaggccccccaccacggcacacaccaaaccaaaaccacggcagccacaatataaacaccacaacaacagaagtaagactaacccacacgcaatccacgagaccacagccaagcgaccaccacccgaaaccaaatggagcaagaccaccctaatccgcagaacacaccct

SEQ ID NO: 632918 - DNA, 472 bp, Homo sapiens
ataccaatagtgagtaaaggaacgccggtgtaaagcaaacacgtggggaagactacacggatgccacaactgggaagacctttgtacttactaaaacacaggcaaaagaaccggtgtgctagtgaatgcattgacctactaaaagcggagtggtgcagcgtaaaggtgaaaccggtgcccggtgcgggttgcgcttgagtgctaggagggtaacggggagaaagtggcaacgactaaagtggggattgatactacgttttactatacagttgaacaatataatacgaccatacaaagtaggggggagggggtaatgtgggtgacaggggggagcgaaacttgaaaggggacactaaaatggcaaacgtaaaaagccgactggaaggaatgtagggagtgcggtaaggtaggccgtgggggaaagggcgatgctgaataaatttaatttgatgtctatggtaaggtgaccagc

SEQ ID NO: 632919 - DNA, 254 bp, Homo sapiens
acgcacaaacccactctcacccacagcggctctaccgccttggttcagcgctcgtagagcgccagcccgtgcgaggggtcgatcacctcgtcctcggtgccgcggatgatgagcacgggagacgtgatcttggacaccttctcgatgctgcgggagggtcgtggagccggtgagacttcgcgcccctccagtctccccactcagccaagtcagtgggtcaggctcaggctccacccagtcccgagggccacccc

SEQ ID NO: 632920 - DNA, 331 bp, Homo sapiens
cagctaccccgtactgagagaagatactcaaagaccacggtgcccactatcactgtaagaaagatatttgttggtagcattaaatcaagacactgcaaaaacatcacctaagatattatattgaacagtatggaacacttcaagtgattaaaatcatgactgaccgaggcagtggcgagaaaaggggctttgcctttgtaacctttgacgaccatcactccgtgcatcagattgtcattcagaaataccatactgtgaatcgccaccactgttaattttgacccgccctgtcgtagcgcgagatggctcgtgcttcatccagccgaagagg

SEQ ID NO: 632921 - DNA, 356 bp, Homo sapiens
  misc_feature (328)..(328): n is a, c, g, or t
tttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaacttcctgacctcaggtgctccacctgccttggcctcccaaagtgctgggattacaggcgtgagcacttgtgcccagcctaagcatttcttaaaataaaaatgctaaaggngtagtaagtaaaataaaacttcctatgg

SEQ ID NO: 632922 - DNA, 752 bp, Homo sapiens
caggagtcatgatgatgatgttctagcaccagtaaaagatgtatggctatcctgaagacatggatcaagataagcatagaagacagtactgatgacagtgacaccgacaaatcagatggagaacagtgacggggataaattggtgcaccgagataatggtgagagagacaacaatgaagaagagaagatcaccggatctgagtgtacgcgtttgcagatatgcctggaagaatcaaggaagaaaaagaagaacatgaaggaactgactcctcttcaagccatgatgcttcgtatggcaggtcaagaaatccctgaggagggacgggaagtagcaggaattttcagaggacgactgatgaagatgcattctgatgactctgaagcagaaaaagcaatcacaaaagcagcataaagaggaatcccattctgatggcacatccactgcttcttcaccagcagcaggctcccgccgaagtctgttcctccttctcagatacaaagcacctcccatgccaggaccacacctcttggaccagcacactggcatccaaccattacagggctccttggggccaaacttaacagggccttccatcgctggtccacctcccaggagctcctccattccttgagaccaacctggaaatgcccaggaactccggagggccctattaccccaggatttttaccttccaaggaacaccaaccagggaccgacccccgggatcattccctagaaggcaacaagaaaa

SEQ ID NO: 632923 - DNA, 508 bp, Homo sapiens
atggtctctacctccagccggactccagccttctcggtgatgaaaactctgtccagttctgctacggaggggagagagatgagagccttttaggctagaggaaggccagcactgggggtgtggcagggttcgagaaaagctcccagggcctgccttccttccctgagctcatatattggtatccccttatcagactcctgaggaagaagagattttaaacaaaaaaggatctaaaaaaattcagaagaaatatgatgaagggaaaaagaatggcaaaatcagcagtctccgggaggagcagttccagcagggcaagtttctgggtgagaaggcggtggggtgggagggggggagtcgcagagatggagtgtgccgaggcacttttccctggtctcagttccttggactggccagccatgcagtctaacgggtccacggataccgggttgcaagcacaagggggaaggtggggccaccctatacgtatgaagctgaaatgggaagcata

SEQ ID NO: 632924 - DNA, 517 bp, Homo sapiens
  misc_feature (215)..(215): n is a, c, g, or t
cctgctccatggagccttcagtctcctgggaagctgtgcctgtctggctctggcactgaccacatcctctcggccatttctgaagtgcactcctcccagcccagctccagaatggccctgccccccagccccctggccatggaatatgtcaatgactttgcacttgcatgcaagtttgcaggtaaagcggcgaaccctctgcagggccgacctgngccccccttatcacgcctcactggcgctctcacaccgttacacgctcacgtcgcctccttcacccacgcttcagtgcaacctaggcactgcgtggcgggcaacccgagggcaccgcggccaggcctggacggagctgtactggctggctaccctgcacgcacgcaccctgcgcggcgcctgcgcggcacgcgccacttcggcgcgctgcacgtcctgcaacgcaggcccatggcacgctgcctgcacgggctctcggcgcccatgtccctgctcgactgggcccccatggcctcactaccca

SEQ ID NO: 632925 - DNA, 283 bp, Homo sapiens
taatcttggacaagttgagaagaattggtgttagttcctctttaaatgtttggtagaattcaccaccaaagccatcaggcccagccttttcttcgttgggagatttttgaatattgactcaatctcctcactaactacaatatagttctattcaaattttctatttcttagtgatttagtcttaacaagttttgtgtttctagaaatttgtacacttcatctaggttatccaatttattgatgaacaattgttggtagtatattttttttttttaagactggt

SEQ ID NO: 632926 - DNA, 324 bp, Homo sapiens
aagacagggtctggttgtgttgcctaggctggggtgcagtggcataatcatagcttgctgcacctttgaactccagggctccagtgatcctcccaccttagcctcctgaatggctgggactacaggtgtgtgccatcatgcccagctaatttttaaaaaaaaatttttgtagagacaagggtctgttgcccaggctggtctcaaccttcttacctcaagtgattctcccaccttggcctcctgaattgctgggattacaggcatgagctaccgtggccagctttttttctgttttgtttcttgttccccttctgtcgtcttctc

SEQ ID NO: 632927 - DNA, 293 bp, Homo sapiens
atcatgagaggtggtgtcatttgtgaagaagaatgttctcgtaactaggaggattgctcgtaggtttaggctgcttggattggcatcctagggatagatgaccgcatgttcattgttcctggtttcatccagccagcagactctacactccatcataggacatcgagtccctcctcctcttctcccatgccttcttccctgccatggcaaatctgagtggcttctctaagcatctgctggtacaagtcgatgtggcaccatgagcttcatggtggcagaagagactatacgtc

SEQ ID NO: 632928 - DNA, 304 bp, Homo sapiens
  misc_feature (125)..(125): n is a, c, g, or t
cttaaaagcccccccctttttttttaaggagaagggcccggtcttttcccaagtccacacagggggggtgaaagcattgcttttgtgtaaattatgtaaagcaaaatttttttaattttcgcccnaaaaaactttttattttggtttttttttgaaagaggggccttggggcccccccttcccccttttttttcccccaactttaaaggtatgaagggttttggtttccctgggggggggggggggcagccggggtttccctgtaccttgatttgagaccagttgaataaaagggcccccctta

SEQ ID NO: 632929 - DNA, 1614 bp, Homo sapiens
tgtacagaagccgtgataacacgaaaacaatactacgcactacaagccctgcaacgtatggccttcttgccgttagcagtcttggcaacggcgctctcgcgatcacactgctaccaacgcccctctatgtccacaggctccaatattgcgctgagctcttccaccactgtcatggacaataggccagacgaacctatcgctgacatacagcctatagcgcctgaagtacaccagcaacgtgaaaacctgtcacccatacaacacctttgggcggaacaacagacacctcactgacaagcgcaaaacggcgagatgcatccctttcgctcgataaccagtccgcgaactgcgccggacacttcgtcgagcacgacatagacacattcgatcgcatagtgcaccgggacaactcaccaattacgacattatccatgcaaaaccatatgcccccgagagaacacgacacactttacatatccgtggcgaaggcaccatatataaccaactccataacctgtgcccgcgtctcttggaacacatagggaactactgaccttgcctacaataaacacctaacgactacacccacataacattacacgagactatcatcaacaatataccatacctcacaaacgaacaaacatcagaagacaagacattagcaccgcacacttcaccgcgcgctcccagtacccttacgctcggaacacaattccaacccaaaaggtacatcataggcgccctttgcgctccgaacaacggaagaacgccaaagataaagaggacccaacataataaccttagcttgttcaatcactccttatttaaacaacccaaagaaatatcacctggacaacagaaacaaaatccatcgcagcaataaaattcaaagcgaagacgagtccacataaaaaaccaaagctgagcaaagcatgtagctcacctactggcacgcacatggcttacccaaaacaacaaccacaggccatcctgcaacacactagaccctcattgcgccccgacacactccattaccaactaccaacggcacaacgacaaaacggatggcccgaacaaaacaccccgcccctgagagccagaacaacctagaacaagcaacaagagacacgacatcaggaaaagaccagaccacaaccaacccatcccaacgagcataacacccactaagactaccacacaaaaagcaaaagcaaccacagacccgacccaaccacaccagagaacaacccaaaacgcaaacaaaaaccccctaaccgaacaaaagaaataaaacaaaaacaagactaaaaacaggcaaagcccccatctcaacacccaccccccgctcaaccacaccaacacacaaagaaccaccaaccaaaacaaacacacaccagacacacccgtaaaactcccgcgacaccacgaaaccaccgcgaacaacgagacacacgaccaaacacgacaccactcacagccacacacggcctaacccaaaaaaacaaagaacgaaaactccaacaacaaaaccacaacccactaaacaaacaaaataaacagtaaccataaccctcacactccaccccaccaccaacaggcacaaacacaaaa

SEQ ID NO: 632930 - DNA, 169 bp, Homo sapiens
tagggtgcacacgacacacaccctatctccccaagataaaatgcttaagtatttatgagcttgcaatacaggtgttagataatgtctccttaccctgtgttagacatcactcaggcccagaggcaaattcgatttcttgaattattctacagtaaaccaggctgtcttt

SEQ ID NO: 632931 - DNA, 551 bp, Homo sapiens
ggatggtctggccagtactggaaggagcctgtgcgagacccaactggtgctctacgctgacgcgtaggagctgaagaggagtgtgggcaagctccccagtcaccgggaatcactccagatagtgcaagcccaggtgcacacgctgttcagtcaggaccaatgccagggacggcgtatgactgctaaagacttactggacagactgtcttctatagacaacctgaaagcctcactcagccaagtggtggcggacttgaaaatgctcaggactgctagggacagcctgtgtgcgtactcagtctagaaaccaacgagaacaatctggaatcagccaacggtttactcgatgacctcgcgaatgatccgcatatgttgcttggtgaagtggctaagattcacagataggtctcaaagaattgagtgtacatggcacccaattaaagtcccattttttatgaccaaatgagcttgatgtaccaccttgacaacaaggcattgtatatttatgccccggtaacttaattacaatatctgatctgtgcttctgcttt

SEQ ID NO: 632932 - DNA, 215 bp, Homo sapiens
cgattcctggtccaaaggtgccagagggctcacacccagagttagcaatggagtcacgtaattccaaagcatacctgtgtccccagcgacaaagtgtaggccaggcagtgtcaacaccctgccacagcacactggataccccgggagccgtgcagtattcaactgacctccgttcacagtcccggtgctgtgctagatttgggctgacagggttt

SEQ ID NO: 632933 - DNA, 209 bp, Homo sapiens
gggggctgcggaggatactggcgtgaagccataagtcagagcttgcagttgagccgagatcccgccaatgcaggtccagcctgggcaacagagcaagattccgtctcaagaaaaaaaaagaaaaaaggagtagatacaaaaggaagcatgccctaccaaatcatcaagtaaacctgatcttgaatacgatgtagcagatttttcactag

SEQ ID NO: 632934 - DNA, 594 bp, Homo sapiens
  misc_feature (322)..(322): n is a, c, g, or t
tatattctaaagtggacctgagctatttgagcaaataatgatagggcatactcagacattttagctaccttttatacctacgatttcatgtcacatttactaatagaattaacgggaaatagaagcccgttctttcttactgcccctggagggagcatggcgctagggctctcagcctcctagaaggaagggactaaggagacgggcacagacttgcgtcatctcgtttccacagttgacgttttatattactttctccaaaatttaagtttaccaaacacaacacctgaaacagctgcaagcagtgtcttgccagaccctngcgatccttttctgtagcagtgattctaaagtggcgtttgctgtgtgcttgagagtaaaccactgcaaccggcttgcatgggctggttgcacgcagttcaagtcccaaggaaagccatcagcggcttgtaaggatcctgctaggacctctgcagactgtgctgcctgcacttctgctccagagtgtcccagccaaccctcggaagatgggattgccagtcagcctgctcaccatgcctgcaggaggctgtccagggagcaggtctgtgtgcc

SEQ ID NO: 632935 - DNA, 177 bp, Homo sapiens
accgttgtgccctgctgaccttgtgctcggctggttgccagcccacctgtgtccccttctccacgtgcaccctgttatctgcgtgtgtgacgacacgaccctggtgtactcctggtcttgccttcgcctgactcctttgctgcctgaccgacggttccacctgcctgacccccttgt

SEQ ID NO: 632936 - DNA, 187 bp, Homo sapiens
acagagagatgcgaggcgctctagaggattcccaatatagagcaggttctccttaacagggagaaaattggcagttttcccataagccactcattttcccatctatttcagggggcctctctccccaaaggagtggcatgcctcatgttaccccttcaccacctcactaccctgcctttttgcactg

SEQ ID NO: 632937 - DNA, 105 bp, Homo sapiens
tctaacgcgcagctggatcatccccattcttctgttaccagatctttgacttatgccctgaaacatgttggttagcaaaacactgtgctatatttataccaaaac

SEQ ID NO: 632938 - DNA, 807 bp, Homo sapiens
cccttcctctagcagtctttcatatttcgggaaattttccataccggctctgagagggaccccaggggatagatggaaggatttcgtcaagggtcccttgaccaaggaagactgatgatttctagcattgatgacagaatgcctttaacaggccctcttactatttaggttatctggccagaaccagattgttatgtgccttgtgtccaccaggggaaaaattgaccgcacggagcttgaaaatgattctgctcccttgaagcattcattttgctagaactgttagacaccttgccgtatgctgtattgaaagtaggaatatagttttaaaaccccttggaccaagtgtgtgcataacccgtcatgagattaaccaccccatgcatgttgcccttttaatgtagaatacccctaggtatccttaatagtgttccagatattgtggtttagtaaagttgatacctcggttataaatattatgcccttatttttggctagaagaagaattatttttagcctagatctaacccttttcatactcttaagctgattggaaccgattccaagaagtatcgagtgctatgccttgaaacttgtttttaaatgttagatggccctatgtatattaatgtaaaaaccatgttaatttactcaagttttcagtttgtaccccctggtatgtctgtgtaagaagcccatttttgtgtattgttaccgtttcaggttatttatattcgatgttttgtaaaactccaatacgactatacttatggacccaataatggcatctgcattcttgttacccca

SEQ ID NO: 632939 - DNA, 529 bp, Homo sapiens
agcgcgttaacgggccatgagcggctggactcctaaggccctgcggcacggtctgcacctgtgtatttgcagtattcagtccccacagctgccctcatgggctttgttggtgcaaagtgcctgtagtctttacccacagagggtacaaagctctggtgggtccatgactctggggtctgcatgatggtggcctccagtgtggaggctccaacccccatattttccttctgcactgccctagtagaggtttccaggaggctctgcttttctggcagctttctgtctggacatccaggcattttcatacatcttccaaaatctatatgaaggctctgaagcctctgggctagtgctctatggactcgctggcttaagactatgtggaagccgtgaagccttatagctgtaccctctgaagcagtgatgcaatctgtaccctgtgcatctttcagccaaggtcggagcaggagctgcggctgctgggatgcaggcagcagtatcctgaggctgcacacagcaacagggccat

SEQ ID NO: 632940 - DNA, 100 bp, Homo sapiens
gttacttgcaccacagctcatccagggtatggcagtcttgccaccaatgtcagcatgtagggctgctggtcagctggtatgcaacagcctgtttgtctag

SEQ ID NO: 632941 - DNA, 193 bp, Homo sapiens
tattcaggtaagtcgctaggtaagagatcacaatgagaaaaaactttcaaggtctgcacttagctatatctagaacactaacaggactcttttcccttacaggctgaagctcatgaccacaaatgacgctcatgctattagaaagggactccagtaaaagataaacatttattgatgtcaaggataacattta

SEQ ID NO: 632942 - DNA, 942 bp, Homo sapiens
gaatgagagggagagagggaaaaaacagggagcgtgcacgtgccgtgaagagacagagacagagagagagaatattgagacagtgagaagagaaaatgggagagggagagaaaacttacaattatgtatgtctgagcacaccatattaaaggaggggagtggcagaaaaccgtgagtgggggaatcaacatcatgctgggctttttgggccagcaaactgtgcaactcagtgtctcagagatcaaggagccaagagatgagacaagcctggtccctaggtgataggggtgtgttgtgtccccaacccaaattctcatctggaatggtagtctcccataatccccacacatgtgtgtgacgcgcaccctgtgaaagatctttcactaaacttgacatctaccttgtgccctgtatgtccttaaatcccaatttcctgtgggttcttccatgtctcctcagaggaaggggctgaggacgacgaagaccaccatagtccatgctgattaaaatcaagattcacctaaaattaccaaatggcaaagatgtgtgccctggagccttgcctgttgcccacaggcggttctacccgtggcccacaagtgcgaaagatccgagcagatacccgagaagaaaacgggaggctcccattttcaaggcctgctctcccggaaggcccatgttggggtccttgccggccgggaacccagtgttccatcctctcgttcccaggtcgtgtgaatgcagcgggaaggggctgctgcaacccacctgcatattcccccaggcccgctgggtcctgtcagctcaccatgtcacacgggacagcgcgtcccctgggcaccattcgttgctcttctggcccacgtgccgcgcgtggccccccccgggcacgaggaacagcgccaccgggggggacccctggggagccccagttctgtgcct

SEQ ID NO: 632943 - DNA, 159 bp, Homo sapiens
agctgattcttgtcctaggagagagcaaagagttagatgtcggaagtataaatggtttgagaatagaaagaactaattttgcaacaactgagtttcaatggtgcaacacttatacccacgcattttcaaaggatgcccctccagggaaagttaacgatg

SEQ ID NO: 632944 - DNA, 254 bp, Homo sapiens
caggaggatcacaaatttatgtggaaaaaattaacttgaggtccaaaatatagatagataaaagccatagataaaaagataaaagccatatttttatagtttttgttggaaaaggaaatagttgagcattgtccaaagggaccctggccctttagctataggaacctcatttcaatacttgtttacatagtggctagaatattaatgtgggtaagaatcttgatttttttttttaacttcagaaaaatgtttag

SEQ ID NO: 632945 - DNA, 157 bp, Homo sapiens
  misc_feature (119)..(119): n is a, c, g, or t
tcacgcttatacttcaattccacccagtgctacagaagaagacagatttagtctggaagctcttcaaacaatacataaacaaatggatgatgacaaagatggtggaattgaagtagagngcaaagtgatgaattcatcagacgaagagggtaccgag

SEQ ID NO: 632946 - DNA, 545 bp, Homo sapiens
tagaggatccctcgtcttcaactgcggttttatggtttaggtctaacgtttgaatctttaatccatcttgaattgatttttgtataagttgtaagggagggatcccgtttcagctttctaaatattggttagccagtttccccagcaccatttattaaatagggaatcctttccccattgcttgtttttctcaggtttgtcaaagatcagatagttgtaggtatgcggcattatttctgagggctctgttctgttccattggtctatatctctgttttggtaccagtagcatgctgttttggttactgtagccttgtagtatagtttgaagtcaggtagtgtgatgcctccagctttgttcttttggcttaggattgacttggctatgcgggctcttttttggttccatatgaagtttaaagtagttttttgcgattcaaagtacaaaaatgccccggtgtcaatgacatagattccccaatgtcgaacatcccatcaaatattaccagtcatgttataaagcaggtgaataaacctgttttgaa

SEQ ID NO: 632947 - DNA, 439 bp, Homo sapiens
ctcgtattgtgcgtgcaccaaaaacgaccaataagagatcaactcctttcaaagaaacacaaacttgcgatacaacgagcacaaaaacacgtataaactcgagttcaagatcacaggataaatgaatatacgatttacaaactccggataaatgaaaatttaacaaattatttcattaaccaataaaaaataggttctatggcactttagatgtaactttacatacacacgccgatcttacttctcccaatcaaagagcccgaatagatagatggtcttggcatccagaatgccagtctactgtgatatttattggctatttatctccgaggcttattattttattttaaccaccacttttattcatttatattaacggcaacattgaaacttgattcaaagacaaagatttgagagccgtgaattctcgaatcaattt

SEQ ID NO: 632948 - DNA, 563 bp, Homo sapiens
  misc_feature (38)..(38): n is a, c, g, or t
  misc_feature (40)..(40): n is a, c, g, or t
tccaaagttaaacacttagatggctgtccaagggcggngnaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggtttttccttatttttttttggtgcaaatgatttggtgtttagtaaaataagtggctaaacacagtggactccattcaaacacacaaattgtggaacagtattgacacggaaggaaaggctttgaagaattactgcctcaggaagcagtgccagtggagtgcgaatttaacacagtctacttcttcctaagggaatatcatcccagggaagtgtcaaaaattaaaatccccttttaagtgtac

SEQ ID NO: 632949 - DNA, 109 bp, Homo sapiens
ctgatacagagtttattagaattagatttttctatttacaactgagatcacatctactactattgctagtctactgggacatatttccaacaagcttagacttaccatg

SEQ ID NO: 632950 - DNA, 243 bp, Homo sapiens
aaatgtgctcaatgtgatcccttaaagttgtacttccactgcttactatcgcggcactgttcgtcattttactcctgcttgactgaactgacctgtatgttccaacatcaagtcctacctgaggttccttccttccacaccaaacatgagctatgcagaggccggaggaaatggcccctgagaatcctttttctccccatgtttcccacggagaaattaatcccctgctttcccacccctgca

SEQ ID NO: 632951 - DNA, 434 bp, Homo sapiens
  misc_feature (409)..(409): n is a, c, g, or t
  misc_feature (411)..(411): n is a, c, g, or t
tttaaagtccctttctgtattgtttaaatgtatacaatgtgtcatttttcaaaaagctatataattctttggaagagaacaagagtaaaagaatccctatcaggaaaccatcatcagcaaagataaatgtgccccattctctggaatccaacatgatacatccagcaatctgaaagcagagcagtgggaacacaggagatggaacagactttttgcttcatgcctgccctaagcagaagtttggcacccaagtatgaagccatcctttataaagaagtcaccagagacagcttaatcaatcactaaaacaagtagctccctacatggaatgatgtgagatgcattaggggaaaatctctcttgtcctaagacagttcatgaccatcttctggaagcttaattcaccccnangataatgattacaaaaaaaaaaa

SEQ ID NO: 632952 - DNA, 249 bp, Homo sapiens
caacaggtgtgatgtcttaatgccactgaactgtacgctgaacaacgaattaagacagtaaattttatgttgtgcatattttacttcaataaaaaccagctaggctgctggccagcatgtccatcagcgccgtgggtggtggctcctgagggtggggtgcagtctccctcatctacccaacacctgcaggcacctggcctgggatacctcattcctggccaggtatcacatcatcctccatggtgctga

SEQ ID NO: 632953 - DNA, 168 bp, Homo sapiens
tccctcttacagaacaacttcattacacgtatataatataaatacttctgagtatcccagaattgtagaaccacatggtagaatcagaaacgtcttggacttgaggtttttcttcccttagggtaaattttaggttttctggttagtttccagagaggggcggagcag

SEQ ID NO: 632954 - DNA, 538 bp, Homo sapiens
gccaggctttcggacagcagcatcaccagcaagctaagtcacaagcagaacctctttcacgaaacaaagaaaccacaagcatacaccagtagtaaccagcagaagaattaaaaatgcaatcagctgcattttccattgctgcagatgtaaaggatgtcaaggcgggtcagtcaaatgagaatctaagcgactctcaacaagagccacctaaaggtaaagtcccggaagggcccgtagagccctctaattgggaaccagaatgttcaaagtatggagactcaaatcgacaaagcccaagctggttactcagcctgtacccctttgcgaataagcctgtacctgctccaatctacttttccttcaaaaacaggggggatggagggagggaacagcagtagcaacatcatcattaacagcagataatgattttaaacctgtgggtattggtcttacccattcagaaaacaaacaagataaaggcctgcctcggccagataatagagattattgattagaaggcaatagaggcacagctcat

SEQ ID NO: 632955 - DNA, 908 bp, Homo sapiens
gctccactcatagagcgtacgtatcacagatcatccctggacacagcaagtgactgatcaaaagaaccactacatagcaagggagacctcggggagtctcctacatgtagcgaggtactgtctcgacgtgcactacgaaagtatgctgaggaaaatatgccatggcatcgtgtccgtacctggacactacactcactattatcctcctagtggcacaccactggtatactagtataagccgtagcccagtgtgtcacagtccccattagtgacagcgagcgtcggcccattgactatactaggcgactggtatctccatcttaggcattcacacgagaattgcactcgtcaggcgcacgagagttccgtaaagccgagcacaaggtggcgagcaacaccgtagcgattcgcactgagtatgtttcgctcaaaatacgtatacagtagatacacgtctgagaagaccatctgcacagacaacgtcaccatccacatatagcaactaacaaagattagacgccccttgggggaactgctcacgtgacacttactactctgggcctaacaccacagtatgagactaggccaatagggcccgagactgtagacgtgctagtggcgacagcgtcaaagtatgggtaaaacagccgacccaaggcaactcatggacgtaaactaatcgaacataccaaatattgagccacagttcacacatcaggtactaggggtgcacatccaagtccatacgagcaacagaacacgatagcagtacgcatatgattgcaggcataacattgcataaggccaaggatacggacatggttccagcagcaagtacaattctacaccaggatgggcgcaatcaaccgcattaaataatgacagtaaaatatgcaatatcactacag

SEQ ID NO: 632956 - DNA, 287 bp, Homo sapiens
  misc_feature (262)..(262): n is a, c, g, or t
  misc_feature (264)..(264): n is a, c, g, or t
caacatgaaacatccatccatgtgatagatgtgatgatggtcttaagctgattattattaaaccaatgattgctgcgagcaagaagcagaagtttggcacccaagtatgaagccatcctttataaagaagtcaccagagacagcttaatcaatcactaaaacaagtagctccctacatggaatgatgtgagatgcattaggggaaaatctctcttgtcctaagacagttcatgaccatcttctggaagcttaattcaccccnangataatgattacaaaaaaaaaaa

SEQ ID NO: 632957 - DNA, 329 bp, Homo sapiens
gctcgacctgtcatgaacattctgtggcttaaaaatatctgtaaattctggctgggcgtggtggctcacacctgtaatcccagcactttgggaggccaaggcaggtggatcatgaggtcaggagatcgagaccatcctgactaacatggtgaaaccctgtctctactaaaaatacaaacaattggccgggcgtggtggcaggcacctgtagtcccagctacttgggaggctgaggcaggagaatggcatgaacctgggaggcggacttgcaatgagctgagattgcaccactgcactccagcctggatgatagagcgagactctgtctc

SEQ ID NO: 632958 - DNA, 403 bp, Homo sapiens
atgtatagacttgcaagaggaactacattagtacacagcaccagaatgtatattacggtgtggctttgagagccgtgggagggtaccagcagaaaggttcgtatcatcagatagcatcttatcacgactactatgcctgctatttgaagtgtaattgagaaggcaaattttagcgtgctcactgacctgcctgtagccccagtgacagctaggatgtgcattctccagccatcaagagactgagtcacgttgttccttaagtcagaacagcagactcagctctgacattctgattcgaatgacactgtacaggaatcggaatcctgtcgattagactggacagcttgtggcaagtgaatttgcctgtcaacaagccagattttttcacaaatttatattgtaa

SEQ ID NO: 632959 - DNA, 118 bp, Homo sapiens
ccgacagaagaaggagagtgaggctgtggagtggctggcggaaggcccagcatgtacaggatagtacttggagaaagacccggtgctgagtcgtgaagactggccatgaagtacacct

SEQ ID NO: 632960 - DNA, 187 bp, Homo sapiens
  misc_feature (181)..(181): n is a, c, g, or t
tggaatgtttcattctcccagatttatgaacattttttcttgagcaattggtaaagtatacttttgtaaacaaaaattgaaacatttccttttgctctctatctgagtgccccagaattgggaatctattcatgagtattcatatgtttatggtaataaagctatttgcacaagttcagtnagaaaa

SEQ ID NO: 632961 - DNA, 472 bp, Homo sapiens
tgttgagtggtattctattgtgtgaatgtatctattcatcacttgaaagatattgggattgtctctaacttttagacattacgaataaactgttgtaaatatttgcttataagtttgtgtgagcataacgttttatctcttttgggtaaatattgaggagtgctactgctggatcatatgataggtatatatttaactttataagaagctaccaaattgtttcccaaaggggctgtatcattttatgttcctactggccatgtatagaaattctggctgtttctaattctcactgatccttgatattgttagttttttaaaaatttatgttagttattctaatatatttgtagtagtatctcatcttgattttaatttacattttcctaatgactaaggctgtttggcctcatttcatttggtaaagtctcagatcaaaattttgctcattaaaaaattttcttgttttctt

SEQ ID NO: 632962 - DNA, 109 bp, Homo sapiens
gacttacgtccttacaaaactccatctttccctgacactgcatcttctctcttttttttttcttgagacggagtctgtggcccaggctggaatgcagtggtgtgatctt

SEQ ID NO: 632963 - DNA, 903 bp, Homo sapiens
ggaagaatagcttgaactcaggaggcagtggttgcagtgagccaacgatcgcgtcactgcactccagcctgggtgacagagcaaaactccgtctcaaaataaaataagaataaaatggccatcctggcaggtgtgaggtttatctcattgtagtttcgactttgcatttccctgaacactgatgttgagccttttctctatatacccagctggccatctgacatgctcttctttggcagaacctgtctattgcaagctccttctgcctcatgcttcctaaagtgctccccatactctgcgccacttgcagttgctcgcgagctcccttatcacattccggcatactagccctctcactcacgactactatgcgctcgccaaactatcctctatcccctctgctcacggttggccttccccatccctcgatcattcccccctgtgcctgtcgcacacaacctcttcccagcttcgacgctccgtcccaagctgcgtcacgccctcgctcccccgtcgcgccctgcgccgcacccaggcgccgtcaccactcctacagaatacttgactaggccctctctaccccatattgctgaacaccgcgcaatacgagaggctcgcaaacaagcgcaaacagtgacccgggtggtacacacgctccgtacctgaactcccccaagggggcgttacacgaactgggcgcccacaccaccgcgacccgaacacgggtcacagggatgtcctccaacaacgaagccgggtaacctcgggaacccccccccggtagttcccccctcgacaccacttcaaacccacaaaacggcggccacacgacgcacggggaacaacacaacgcccatcgtaggcccaacggaccaccaaccagcgttgggcctacgcaaacaa

SEQ ID NO: 632964 - DNA, 128 bp, Homo sapiens
atcgcctgaatacattgccttctgggacaagctcaagcgcggcgaatacgacgccgggcgctatcgccgcatccacaaggatggcggcgacgtctggctgcaggccagctacaacccgatcctcgatg

SEQ ID NO: 632965 - DNA, 130 bp, Homo sapiens
taactgtcatccaggagtgaggatccccctactaggagctgcagcctgtctttcttcccctccatcagtttccaacacaccctcgatccaggactgaggcctggctcccacgccccatcccctttccatc

SEQ ID NO: 632966 - DNA, 332 bp, Homo sapiens
gtcccagaagagaccgcaagaacccgctgacccccagcgttggcgtggttgacaagaccgaggagacgcagccgcccgtggcgcttaagacagaaggaataagacgagtttggaagaagacctgatcaacaacttcagggtgaagggaacatcatttgatagaagaccagaaaaggcgaccacctcgtgaacgaagattcgaaaagccacttgacgacacagggtgaaggaggcgaatttacagttgatagaccgattattgaccgcactattcgaggtcgtggtggtcttggaagaaggtcgaggaggccgtggacgcagaacgcgcctaa

SEQ ID NO: 632967 - DNA, 459 bp, Homo sapiens
gtgagcgacacctgggtcttccggggccactccaggtgcctgtaggccgctgttaggttcagctcctgctgggggcctttcaaccagcagttcaggatcttacggtcccggctgttctcagcatggatctcgccctgcactgctgtgttccaggctgactcgagttcgctccagctgtggaagaggctctgtgccaagactgtcactgtggaaacccggaggtaggtggtagctgcggtgtaaacctggatcttgccttccctgttggggccctgactcctgcagcccacgctgaccaccaggtcctttagggtccaggccttgcccagcgttagctccaggacagcctggaacacagctcggtgtggccagtatagcctgtgagctgcagagaccatcagccatggactatccaggttcaagactccttcccacttccacagggtggcccgagatgtg

SEQ ID NO: 632968 - DNA, 465 bp, Homo sapiens
  misc_feature (233)..(233): n is a, c, g, or t
tgtggtcgattctgaggatccccttatctcggccatcactcattgctccttcctgtgaagtcccccagctaacacggtgaactgtccccagccctatcatgcattcgcatttttcaacttgcgatgccaaggtatctcaactcagccccttactccacaatctgctttattttatatcctagaatcttagcgttcacatccttttcagttgtttgttcccctgatatttgtantcctttaataagtcaaggtatctctaagacctggctcttttattatgtacggtttcttcaaagagaagggtgtatagttgttaaagtgccagctgaccatataaagtgctctataaatactcttctccttcaccacagggatgcacttacagcccagggaaggggtctggacatcagctgtacgagagagacattcatgaccaaaatggtgaaagtcactcacaaccagtgt

SEQ ID NO: 632969 - DNA, 1171 bp, Homo sapiens
ctctgaccagcaccatggtcgtgttggctaagtaacaagtcgccttacgaaaggcggcaaaaagggagccaagaagaacgtggttagtatccatatttctaaggaaagtattggtatgatgtgataagcacctgctatgttcaatatagagaaatattggcaaagacgctcgtcaccaggacccgaaggcaaccaaaattgcatctgatggtctcaagggtcgtgtgttctgaagtgagtctcgcgtgatttgcagaatgatgaagttgcatttagaacaattcaagctggattactggaagatgtatcagggtaacaaactgcctgactacacttccatggccatggcatcttagccgtgacaaaatgtgttgccatggtcagaaaaatggcagacaatgagttgaacgctcacgattggatgtcaaagacgtaccgatggttcacttggcttcgatctgttcgtgtgtaggttttactaataagaacgcagacaatcagatacggaagacctcttatgctcagcagcaacaggtcctgtcaaatccggcagagaagatgatggcaatcatgatccgagaggtgcgagaaaatgacttgaacagaagtggtcagtgccttgattccagacagcatgggcacacgacgttgaacacgcttgccaatctatctatcctctccatgatgtcttcgttagaaaagtgaaaggatgctgaagaagaccccagtatgggactggggacagcgtcatgggagctccaaggtgaaggccaggaaactgggaacaggccacgggggacgaaacggggcgccacagctgaacaggcggaggatatcgagcacaagtcacgccatcggacaacgtccaactccactagaggcaagacaaaagggcactcggggaacccatccacacactaaatcaattacacaaaaaaacccaagaagacaaactacacaaatagaagaatcacaaccacctaacaaacaaaaagacataaataatatatacacttatctcactaccaccaaacataacaccaatattgaaatcacaacacaacactcaagctaccaaactagttaactaatatataccatacatagacataaccctcactaactacatctactcatacatatatattaaagcaacataatacaacccaac

SEQ ID NO: 632970 - DNA, 781 bp, Homo sapiens
tgccggagccctctgtcctgtctgaggtcaccaagcctcctccttgcttggagaactcctcgcctccctccaggattccggagcctgaatccccagcgaagccaaacgtccccacagcctccacggcgcccccagcggactcccgggaccgacggaggtcctaccagatgcctgtgcgggatgaggagtcggaatcccagagaaaagctcgctcccgtctcatgcgccagtctcggaggtccacacagggtgtgactcttacagacctgaaggaggcagagaaggctgcagggaaggccccagagtcagagaagccggcgcagagcctggacccttcccgaaggccccgcgtccctggagtggagaactctgacagccctgcccagagagcagaggcgcccgacgggcagggtccgggaccgcaggcggccagggagcaccgcaaggtcggacaggacagttggacgggggcttgccgaaggggacagacagcggaagccgggtgagacacgaacacagagagtcccagacacccctgagaaggggcgggccccctcgagccgcgcaggacaggcggtggccagcggggacctcagacccagaatgctgaggccagacatcggaagagccagacggacggcttaggaccgctgtatgcaagagctgcgcaagggagaccgcagcggcttcgccgaggccctgaccgaggaccacgctgcggatggcgcagctccaggtggagctggacgggacagcaaaggccgaccgctcggtgacaagg

SEQ ID NO: 632971 - DNA, 164 bp, Homo sapiens
tcttggagaatcaaagctttgcgcgaggcccacgacgctccgctcctccctcagctctgcccagtgctgacttcaaccagctggccgagctggaccgccagatctaagagcttcctgcgtagcctccaacccctacacctggtttaccatggaaggccctagga

SEQ ID NO: 632972 - DNA, 143 bp, Homo sapiens
tgagccggtcccagtgatgtgtcagaagcacagtgcactagcataacaactcggctttggcaattgtctgaagctctaaaacgctaagcctgtctggtggcttgaagaaccaacaggacataagttttgggctttatgacact

SEQ ID NO: 632973 - DNA, 433 bp, Homo sapiens
  misc_feature (43)..(43): n is a, c, g, or t
  misc_feature (121)..(121): n is a, c, g, or t
tcctcaaaaaaaaatgcccatagttggttatagaaagaaattntgggcccaggtgcagtggctcatgccctgtaatccccagcactttgggaggccaaggcgggcagatcacttgaacccnggaagttagagacccagccctgggcaaccgtggtgaaaccacatttccacaaaagatacaaaaattagctgggcactgtcatgcgtacctgtagtcccaggtactcgggagggtcaaggctgcagtgaaccgtgatcatgtcactgcactccagcctgggcaacagagtgagaccctgtctcaaaagaaaaagttgtgaaagccatcaagcccaaaacaataaattactgctgaagaaaactgtgtccagaaattgtatgtgacttcataggatctgtgacagagccaatcaaggaaatcatgaaagagata

SEQ ID NO: 632974 - DNA, 714 bp, Homo sapiens
gagaggcgcgctgactgctataactaagtgatgccgcggtggtgggctcctgttgtaactcatgtcagggcccactaacaactcgtgcgcggttttatcatcattgctgagtcaacatgcctagcggcctttactacgtctctcactgagagtcccacacctttatcagatgagatagtgcagcgtctatgtaccctaggtatatgcgacagtgccatctcgcggtgatactgagacgctaatactgctaccctgcacaacactatctcctacgtggtaccctacacctatagtgagttgcataagagacgcaatatgtgtcataggctgaacccatgggctgaaacctgtattgacagcatatcatgaggctgagctctgaagaatgatataccccacgagtctgagaccccactggcgatgattgagacctcggcggacagataacactttctgagctgaggggcggaggagcatgcaattgcactactcgagatggtgaggacagagagcctgcacttcagcagctgagggctgtgttagcacatattacaccacctcgctcctgcgggacagatgccgactctgtgtcctgatcataacacagagggcatacaacgcgcagctgttaacatgacggctgagagtatagagaccgctgcttctctgcgcatattctcctgactaggggccattcctgtttacagacatact

SEQ ID NO: 632975 - DNA, 747 bp, Homo sapiens
ggagtgcacctgaagatggcggatgctgtaggacgggttgctccgagcgtcggttgtcccgacatgtgacgtgccattccttggggcgatgactgccacgtgtggccctcacggcctgctgcgatgtgggaatgaacagattcttgacaaatttattggtgtactggttccagtcacatcaaaattattcgaggctacgcagttctctcatgccatgctacctgattgtcaaaccgatgcatgcaccctattttaaggcgtacagccgtcgtcaatggcaacggagtccaatagacctaaggccatcgatgactccagaggggaaactatttcttggtcgctctctcttctatcctcttgtgcatttcacctcttgtgtcgtcctacagacacatctgttgctttctagtgacaaatgctaacgaatttcacgaacgtgaaccgtgaacgttgtcgcagcctcagtggattggccactttaggccaatcttgcctcggatgagatatcgccaagaaacgaattgggggattgggccacatgaacatcagcgctctcgtcatgactgtgaactaatcagagttcccagagactacggtgtgcgtgtcacgaaggtcctggtcttgcactaagaggtctcttcataattgaccccaaatggagtcatcaagcatctgagcgtcaaccgaatctcacagtgggcggaaccgttggcaaaaaacctcgcttgttgaaggcgtccagaatta

SEQ ID NO: 632976 - DNA, 227 bp, Homo sapiens
aggaggtcagactcgatcatcgcattattgcctacatgtctcaaggtctaggtgcatgatgtggatgcgactgagagtgcttgtgtactatctgaactcaagtcgtaactaactaggttcctcattctatcagtcacatcatcgcatcgaagggtaaaatgtaaaatctcggcaaactcctttgccagggccggttccctttccaggtgtggggttggtgtgtaggg

SEQ ID NO: 632977 - DNA, 1190 bp, Homo sapiens
agcgggggcggaggcgacgttggggttgtttgggctcctatctttgcctctggagctcacggtcggcgcttgtcataacccagcacatcgcacttttcgcacggaagtacgtcttactagaaaggcctaggcgaggcctagagacgaggagcggcggagaattgcggggagaagcccaccacgcagaggagccagcgcgcacgcgacggagcggagagataaccgggaaccaagaccactactgcgcgagacactcgaggacgcagggcccgacgcaatcaacagcacccgggacggatcgatcatcacgataagcacagcgtaacagtcacactccagcaacaccaagaagaacataacggcacaacaactaagacgaacatgagccaacatccgtcggaacgcacgccccaggcagcgagcacagactcccgccgcatgacatgccgcacggagcacaggagagacaacagaggagatgcagatacagcgcaacaacaagatgacaccgcaggaacccgacccccaagtcatcaaggggcagtcaacagagccggacaaccgacgctccgactgaggacggccacgcgctcccaccccccacccacacggatggcaaacacacccagcggctcagcacacgactcactcgcgtgcggaacacgcaggcaaggcgaagtcaagccggacacacgcgacctcccagcattcggtacagactgcaaccgcaagcagggccgatcaaacaggcagcatacacagtcgaagcaggagaagcaccagaaaactgggaagaaatagcaaacccgcaagacggcgtacatggataacgcccaggaaagcgggcaagcaccaaactcacagaggaagcgcaggcgaagatcaacagaacaatcagcgagaccgcagcggttagaggagaagataccaaagggacgcagagacgcaggcacgcgaaaggcaaaagcccagccagaaggaagcagagacgcagaaagcaacaggggatggacggcagaggcaacgaacagcggaacaaccagcaggggaccagggcacagacaacagcgacaacgcgacaggagaagacagcacagaataaaaagaacgagaacagcaagaagagaacacccacacacgcaccaccgcaggcaccacccacacagacacagacaccaccagacacagag

SEQ ID NO: 632978 - DNA, 264 bp, Homo sapiens
gccctcacacatgagcaagaaagagatgtggccaaagacattcatggagccctgtttgttaaaacagagaaaaagaaattaagaaatacccagcctgggcaacatagggagaccctgtctctactaaaaataaaaatttatacttgggaggctaaggcaggaggatcacttgagctcagaagatcgaagcttgcaatcagctgtgatcgtgtcactgcatgccagcctgggtgacagagagtgagaccctgtatcaataaagaa

SEQ ID NO: 632979 - DNA, 150 bp, Homo sapiens
acgacttatccaaggaggaagagaccaacgaaatataacctcccacgtttgtctgtacatactggccgctgtgttagacagctgtccacctcctctgtggaggaaaggccttggggatctcagagaatgggacagcccccctcctctgtg

SEQ ID NO: 632980 - DNA, 170 bp, Homo sapiens
agagagagaaggggaatgggagtcactactaatgggtatggagtttcttttgaggtgataaaaatgttctagaattagatagtgataagcattacacagcttcatgagtatatttaaaaccaatgacttatatacttaaaaatgaattatttggactgcaatccatctca

SEQ ID NO: 632981 - DNA, 1324 bp, Homo sapiens
tttttttttaatcctctaaaaatctttactttttaaaaatcagccacccaaatgggtggtgcgcggtggggagcagggtgggtgggtagaaggaactgggggtgctcgtggccagtggcccactatacatgaggagacttcgtgagagcccgtcttcccgtgcctgagggacactttaacttttatatagcagcatacattaggggtcaacggggaaggcccaccaatgtcccttgaacatccatgggcacaggggaaaggaagtgggggagaggtgggatgtgttgacccacctctaaaaggtgtttgtcgccactatgagtcagagcccccaggggtgagaagggcctacaagataagagccgccaacaggtccccctcagtgataacgcaggggggctcacatcctctgtggccctcagcataccacacaagcccgcggcatcagcacaggggcaaccaagatatagcaaaaattcgggtcacatcacttttgtcacaagtgccacaggagaactggcatagtagatggggaggtcccatggggggagcggcctcacaagaggattgtggagaccttgagagggtggcccccacaggggttttgtcgcaaaacattgtatagtgctccctacgcaatagggcgccccatagataccgcacaattacccaagaaacacacatacgtgtagatcgtgggcccacaataccgggaggccaagatagacgatgagacagagattcgtcgcccctttggagcggccctaccaggacaggcaccgggatatcagctagaaggtgcattgtgtcataaacgcacgtggcataccacacaaaaaattctgcaaaatgagagaacaagccaatatacaatggagggaagcaacagtagaagtagaaacccaaatggaacccaccccaaagaatttatggaccacagcaccaatacgtggcaccacgagcgcccatcaaccaggatgtagaggcccacactatgcagacaacgacaactaataaagacgcacccaaaaacgagacgatgacaacaaacaaagagggtggaacccaagtgggggacatcatctgggcacacctatgaggcccaagaagacggggtttgtgagggatataaactgaggagacaagcgccgccaaatctacgtgagaagaacagagcgatcaacaggggcggcaagaacaagcagcgagagcgaccagaagcgaacgaacagaggggcaaatgagacccgatgaggtaggacagaaaaacaagaagaaaacaactagcaagcaacacaaacactaagaatgccaaacaaatgag

SEQ ID NO: 632982 - DNA, 141 bp, Homo sapiens
tggaaggaggcacagttaacccagaaacaacacccggtagtaaaggcatctgctggaaactaagtctagaaaaacaaaggtctgcattgaaatatgtagtttaaaaaacttctaagagggggaatacgagtatagggagtg

SEQ ID NO: 632983 - DNA, 235 bp, Homo sapiens
atcaagacccacgttatgaaaatgtcagcataactcgcctaattagttgtcctttatataatctcattgcagtgtaaatcaattgcgatcaactattttattcatgatgatctttcattttataatttatcctttagattcagtcgctatgtgtttttataaaggaaacattttttagagacgtctgagctcacttttacactggtggtgcctactgccgttcctgttctagttt

SEQ ID NO: 632984 - DNA, 251 bp, Homo sapiens
acacttttatagattaaactttgctaatactctacagtaaatgcttttgcggttagttactagaaggatgcgctaccgtggcggcacggctgagccagtgtgagctcagcgcaattgtatctgctggactaagcgaccggatggcttgaactgaccgctcaacatatggcccagataccatcgctcttcgatgcgcctgcatgtactgatcagtcccaccaagggctgctgcacgcgaccttgaaccaggg

SEQ ID NO: 632985 - DNA, 939 bp, Homo sapiens
tcagagtaagtgagaatacagtgctgttattgatatgctataatacttattagttatggtgcagcattagattattcttatattataatatgaatataaaaattgttaaggtaaatgaaaaaaaaaagaataaaaacaggatggaaaaaaatatataaagatagtgaatattgttaatgttgaggcatgtgaaaacttaaatgaatttatgtagaacagacatcttttatttaaatccatctgaactgtcccaaaaatgtaatttgcaaagagcttcaaacagcaaaaatataccattttaaggcatgtggtgacaatgctatttgccttagttcattcgttgtttactttgcaaaattgtgacttttaagtactaacacatttgattgaatgtgtattgaattggaatattatttctaaattcagcattgagtccttagttgatgattttcttttaaagaaattagtttatttaaaagcagataagccatgggggtgggagttagtgcatatcatcagcctccatctaaatgtgatggtaaagatgtgcaggataggacagttagaatgagtggcttgacactacatatggtgcatcatacctcaagtgaagaagcgaggatgtgacacacagtgaatgtggagggatccgagaaacttgcacagggattaagtgagggtcctttggtaaaggtaaacttgaaacacttcagttaaagtcctcactcgatagaatatggggtacccaaaccataatgtctcgttaaagagccctattaaattgatgggctggagaaaggtaggacatatttaaagcaatggcgggtacatatgctacaaagtgcttacaaacaaaggcggcgaatagagaaagacagatatgcatagtatgagggacaagacacgagagatggagaataaagtgtattatagtagagt

SEQ ID NO: 632986 - DNA, 420 bp, Homo sapiens
  misc_feature (420)..(420): n is a, c, g, or t
taacgaggaacacactgtacaaagggttgacgattcatggaccggacgatcctgctcctgactcaccgctagacgctctagcggaggaacacgacggtgaggaagcccgcgcgcaacagccatgggtgttaaggataccgcaaaaacacccggggagccggaggaggcaatgtaccggaacggaataaccctaacaagccgcaacgcaaaagccaagaaaaaggagtatgcagactcgagaagaggagcaaaagaagagacactgaaagggggaccaggacgaatgcctaccaagactttgagaatcactacaagactccaagtggtgaaggttctaggacgtgggatcggtgccagaggagaattcacaagcgactcactgacttgcacagtcccgctgagatggttgcagactactcn

SEQ ID NO: 632987 - DNA, 329 bp, Homo sapiens
cagcatcaccttgggcggtatctccggcagctgcacgccatcggaacttcctgtgtttttcgtgagcatggacctggtgcagacagcaccctgtccaggttcagatgtgacgcctgtaatcccagcacttcgggacgccaaggtggaaagaccgctttgcgcccaggatttcgaggctccattggtttttaatgcaccacttcacttcccgctgggccgccggggaaggcttcctctcttaaaaaaggagggcttagtgctgttccttaaacctgccgtattttaactgggcgaacttagaaataaactgttttcatgttatgaaaaaa

SEQ ID NO: 632988 - DNA, 1248 bp, Homo sapiens
gcgtgcgacgagatgccctcgttcggagaggggctcttccccgcctcccgttgaagaaagaggtctcgccccaaagagatgaacccgggggtgaagaagtggcgaccagagcaccccccaagagaggaccccctcgggtttttccctttggggcgccccaacgaaagaagaggcgccccccccccctgattggggaggattccccagggggtggacccgcgggggcgcaccctcgtggggcgccggagagaagcctgggaacttgggggcccccgggagaaggggcttttgtggtctagccccgggttgaacccgttgttggaaagccccagatgttttttggggccaagggtatgtagaatttgaatgcggaacaggttcattcgggggggtggagccccacaggggccaaaaaggggcttacccaaaagaggggggtttcacccccagtgcgtttgggcgaccaccccaaagaaaagcgttgcgccccccgccaagagccccccccccgaggggcgcttgggcgcaaaaggtggccccttgtatttgggggcactatggcgaatctcctgcggttgtttttaggcccttttttcttgttggcacccgccgcctgtggcgcagaaaaaggcgcgatccagtcacccccgcacctttgaggagtctcaccacaagagaagaatttaatataagaatttgtgcacacggggttatcccttattctaacaggagccgcgcacaagcttgagttcacaggggacccatatgcgctccccactcggctatttgagcctaattcttgaaccaagagagcacttcaacacccttcttggggtgtggcgtttttgtgccacctaatgggtggagaagtggagccacactggagattttgttcatatgctcgagaaagggcttgttgttggtggggagacccacaagagaagcgggtggctccacaccctctccccaaagttcctttgctgcggtggcacagagcgaaacgcgcgggcttcttggagagaaagagttgagccttaaagttcacttgagcacccaccctccacaagtttggccactggccggttccacgagaccactggagaggagagaaagaaagcacatttcacatgggagccacactgagagagaaagagccgagaattgcacaaaggagaagaaggagcttaaagccagggaccagattttgcagattggtggggtttccaatataaagttattttcccctga

SEQ ID NO: 632989 - DNA, 927 bp, Homo sapiens
tggaaaaagtcagggaggccagggggtgggtttgaaaccagcttgggggggttcgattccttcctttttggtctaaatttatgtataggggttctcgaaggtgtggtaggggggggggcatccatatagtcaccccaggtttagggagggttctctctactataaggactttctcgctctcgaagcagaaggcttctcaaatcatgaaaattataaatataacggcggtagaggaaatgaatgagcctacagatgataggatgttcagggggtgtatagcatcggggatagccgagatacagctcgggagcattaccgggataaggccgcaaacagtgtcgcgcagaaacaccaagttagattcaccgccgactgaactattgcctcagagaacagggattagggagcgaacagaagggaacaacggggtgtacaccatgcaagcaactacggggaacaatcacgcagacagtgaagcccccacatgaatgaaatcaacacgccccataattgaaaacgaccacagcgacagtggccaaacaacagaacacgatactcgctagatacaaaccaagtgtaacagcgacagcagactaggcataactactagcggccccgcaggcccacacctcagagaaaacaaagaaaaagaagactacgctagagacacaagcaaccactgaaagcacacacacaatacaaactgagaccccggcgagaattgagcgcacaacacaagaaaacaaaattataccacccgcaggacagacatccaacgatacttgacacacgcgaacagtacccacccacgtgtctacgcgcatcccctcgtgcaaagacgtaacgtgcccaccacacaaacacccgacagcccactacccaacacacacacgagaccccaccggactcaccgcgaacaacacatgc

SEQ ID NO: 632990 - DNA, 321 bp, Homo sapiens
gatcccgcctggattctctatggatgtacatagaaaggagtatggatgagctatatcctttttaaaggatgagaccttcataaatggcccctcggatactggtgatcccgccgcaagcgcaaatgctccagtagagttatgaaaatatatgttaatctgctctgtttcttcactggatacaagattcgagaggtcttctcaaatctttaggataagctggtttaaaacctgaatagttaccgcatcatttaccttttcataaaaatagatatatctgtacagaatttctataaaaagctgcacttgtagagagggtccagg

SEQ ID NO: 632991 - DNA, 265 bp, Homo sapiens
ctcgaactcctgacctcaggtgatatgcccggcgcattcacatattttgaggatttaattcaccaatctgttttcctctctcttgtttccttagctagactgaaggccttcagtgtgtttcctagacacaactcccaaatctgtggtccctttttctattgcatatttacacagtggtcagtttctgattactttaaccactagaacagaaatctgaaactagaagtgatgaggcaaagctttggaacagcagcaaaaacagccc

SEQ ID NO: 632992 - DNA, 1025 bp, Homo sapiens
ggcgtctgtgaagaccgaattggatggagccgagctgagtgctcggtattcctgcatgatggtcatgggttttggtagattcaccgcgtgtgtgagatggggtagaggagatgttgcctctggtgagtgatggtggtccgagtttcagctaagactgtcgggggacagataagctcagaaatgagtcacgtgaagcagtgctatagtacgtgtgatggacgagagtagcggggatgtgaactgatcgcccggcgcgctgcgagactagtgcgccaggatagcacttgagtgcggccaataccgcattgtaaccctagagggcatctcgagtttcacacaggtatagtacgagcggactggcacagagtccaagagtcccataagccatattggagaagctttaggcattcacatactgcgtgggcgcgaggccgagatgggaaagcgtcgccctggccataagaggacaattgggcatcatagaaaacgaaatgtggggtgggtggcataactttcttctgtggacagtgtgcttatgaaggattagcatttttcaacactcggggagtatgactttttggaaatgattgaccaccttcaccgtgttgggacattgcttgacttgcacgcgtattggtaggaacacaaggtatgtgaacaaccagttgcggacagattcacgagttgaactaacctctggacgtaagtattgaggacttcggcgtgagtacacggttcaccgttaatagtcactacggccagaccgcgggatccaaggcgacagttggacccacagaaacattgtggtcacacgtactacactctgatgggccggctagtatcccccaacgggacaagtacaatccagacccaaggacaaatgggtcgccgaattgaacagtcgccaccgccacggacgaaggcgctccggggatatccccaaaggacgaccacgaccaactttggcgccccattcggacacacaacagcagtacactgcgggcgagggccatgtacccacacag

SEQ ID NO: 632993 - DNA, 753 bp, Homo sapiens
agcggcggaggcccatattacactatgacggttgatacacagtagaaaaggcagataatactagagaagagacccgaaggcaagaagggttgatgcttggtggcaaggtgaagaagggtaagctcgataagctaacgatgcttcaagaaggggaagaaccctatggcagccgcatagcctgtccgttgtgcagaggaatttgacaggtattcctcagagtctgcctgtgtataccagtaaaggcactgtgcaagaggaagtactcaggccgctaaaatccaacagttgaaaacgacaaaagaacggagaaggtactcgcaactgttacaaaagcagttggtggtgacaagaacggaggtacccgggtggttaaacattcgcaaaactgcctagatattatcctactgaagatgtgcctcgaaaagactgtagagaccacaggcaaaaaagcccttcaagtcagacacgtgagcaaactgcgaagacacagacattaccacccgggacacatactgatcaatccatcactggacgccacaggggcaacgagggtggtaaaacctgaatgcagctggctaagtgagctatacttacttgttgacctggaacctcatgagtcctcaaatcgaagtcccgtcatacagacagaacaccaccaggaaaatacagtcattagccactacaaacacaaaatcgatcatcaagcaatgtaaacaatgcaaaacatcttacggatgctcacttcacgaagag

SEQ ID NO: 632994 - DNA, 780 bp, Homo sapiens
gtgcatgtgcttctccgcggcgctccgggcccgggcggctggcctctccgtccacatgtggagagacatgtaaggaattggcataagacagttatgctatagtggagctggaggagcttgattgtgtgcacagaagaatactcctgtataataaccctggatacgtccgatttgatttctacaccaagaaagactataagaggatcagaggcgaattgtagtgatagagaaacgtagtcgcagaaggccatagacagcaagcagctgttacttccagtactctggatttaggcccatataggcagaatgggtggttgcccagtcatcgtgctatgaacaagggtgcatgaagttttgagctacatgtacctccaagtgagagtatatgaagtagcagacttggtttatacatatgtagtacatcgaaagccagttgggaaagtatggacgattcaggtctgcgactactacaccctgcatgcttcgaaagtctgacaggatactggaggccattcagaaaaagcttggaatgaaggtcggggagactacacctgacaaacttttcactcttatagaagtggaatgtttaggggcctgtgtgaacgcaccacgtggttcaaataaatgacaattactatgaggattgacagctaaggatatcgaagaaattatcgatgagctcaggctggaaatcccaaacagggccagagtggacgctctcttgtgacagctgagtttacctttggatggacaccaggactggttgggtcagcggctaaa

SEQ ID NO: 632995 - DNA, 785 bp, Homo sapiens
agcgttctgaggagcctccatctccagttgtgggtgaccgcccttattctccccgggggtatctctcctcctccctctctttaggtccccctgtatacggtgttcgcacacaatatttgtggggcgttactcttcgcggccttttcaatggggcaatagagctgccaagcagttattcacttgcgcccccgttggtgggccccgcgaatgctccccttgttggggtttctcgtctaccgccacccggtcaccccttgggtttggcaccccagtaataagttgggttaaacttgaatttcccgcgggttttcttgtgactgagcacttataatcccccttattgggggctcctccactaatatgattattctaaaacaggatgcaatccccccacccctcttttttttcagcacagacttttaatcgagacaagaaaatcatcggggtcaccaacagccccgaagatggccaatttgtgcagcggctcctcggactcacctcgccagatgtctccttccccagggtggggttctagcaaatctcgtgcctcatgcctccccacgtagtgctgacaataacaggacgcatttctcagcgcataaccacgaatttttttttgtagtgcccgcgtgacgcacgattggggtcaactcccccatgactgccccacgtcttcgctggtgcaggcatctacaaggacgcggcgaggataccactgcgtccccgcggtggtcgagaacgctgccgggaccaaacattagacacccctttccccccacaaaaca

SEQ ID NO: 632996 - DNA, 356 bp, Homo sapiens
ccctagcggggaggtgcaatgcgccgcaagtctcgtgctcactagcaacctactgcctcctgggttcaagtgaactactgccgcagcctcccaagtagctagggattacaggcgcctgccactacacctagagactaaatataatgtattttatagtaggaggtgaggtactatagctatgttagcccagagctgggattagaacttctagagctacaagacaatcctaccaagtttaggcctacccaaagtagctgggattaacaggcatagagccaccgtaacctggtctatggcaagcttcttatactgcaccctgtatttatcagcagtcttatgtgatctgtgtctatgtg

SEQ ID NO: 632997 - DNA, 209 bp, Homo sapiens
ttatgctcagaaatgtctgaactatttaagaattatctaacacacacttcagagaggccgaggcaggtggatcacctgaggtcaggagttcgagaccagcctggccaacacagcgaaaccccgtctctaactaaatatacgaaaaatagccgggcgtggtggcgggtgcctgcaatcccagctacatgggagtctgaaggcagtctgga

SEQ ID NO: 632998 - DNA, 430 bp, Homo sapiens
  misc_feature (261)..(261): n is a, c, g, or t
  misc_feature (317)..(317): n is a, c, g, or t
  misc_feature (330)..(330): n is a, c, g, or t
  misc_feature (359)..(359): n is a, c, g, or t
  misc_feature (383)..(383): n is a, c, g, or t
tggtgatcagtgaggaggtgagacctgtacctaaaagatttccctcatttcctgcgctcataaggcctttctccaatgtgacctcgttggtgttgaatgaggttgcccttttgtctaaaacatttcccacattgtccacactcataaggatctttttccagtgtgaattcactgatgattactgaaggtattacatttgctaaagggatttcccacatttcactggcacacgtaacatccttctctaggtggaaaaggttngggtggggaacaagtgagtgagtaggttgccgaaaggttttgtgggggccagacanggtgggctcatgncccgttaattcccagcactttggggaggntgagggttgggggcggatcaaccnagggtcaagggttttcaagagcagtcggggggccacttgggtggaaa

SEQ ID NO: 632999 - DNA, 127 bp, Homo sapiens
tctgaatacttcgcgtggggcacatgatccaacgttgcaccaacccgaaacatccagcgtatcaccattacggtggtcgcggcatcaccgtttgccagagatggagggagtcgttcgaaaacttcct

SEQ ID NO: 633000 - DNA, 1203 bp, Homo sapiens
  misc_feature (1113)..(1113): n is a, c, g, or t
  misc_feature (1117)..(1117): n is a, c, g, or t
  misc_feature (1119)..(1119): n is a, c, g, or t
  misc_feature (1122)..(1122): n is a, c, g, or t
  misc_feature (1125)..(1125): n is a, c, g, or t
  misc_feature (1127)..(1127): n is a, c, g, or t
cttacatgaggtaaaagctaaatgaatgattatatatgtaaaagggttttgtcaagtattaggcaacagtaaggcatttcagctactgagggtaatcagaattgcttggaatcagtcttcatttttgtctgtccccaagatcatagtatgcagagtctgctaacattgagtgcttcttacgtgttactcactttggtgggctttaacatttatattaataattttacttgtgtttctaacaggggtcttaggctatcagtttaggctccattttctagattggaagggcctcagtattgggccatagaatcaatttctgctggtatccttttcccttaatctccactctcggctcagcttagcactttgcatatataagttctcttgccagtaatgataggacttgtattacttcgttaaattctgcctggaacatatataaataaaatttgctgttagctttagacctatattcctaaatccatttgaatggatttacccatttattccttacattaaagaatcttggagaatattgtgcaaagaatggccagatgggattaacaaagggaggttttccctgagaaagaaaaaggtaagaattatccaatgttaactttacaaagtctgtaaatctattctgaatagctttttttcctcgaaaaattttagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633001 - DNA, 1168 bp, Homo sapiens
  misc_feature (1052)..(1052): n is a, c, g, or t
cttacatgaggtaaaagctaaatgaatgattatatatgtaaaagggttttgtcaagtattaggcaacagtaaggcatttcagctactgagggtaatcagaattgcttggaatcagtcttcatttttgtctgtccccaagatcatagtatgcagagtctgctaacattgagtgcttcttacgtgttactcactttggtgggctttaacatttatattaataattttacttgtgtttctaacaggggtcttaggctatcagtttaggctccattttctagattggaagggcctcagtattgggccatagaatcaatttctgctggtatccttttcccttaatctccactctcggctcagcttagcactttgcatatataagttctcttgccagtaatgataggacttgtattacttcgttaaattctgcctggaacatatataaataaaatttgctgttagctttagacctatattcctaaatccatttgaatggatttacccatttattccttacattaaagaatcttggagaatattgtgcaaagaatggccagatgggattaacaaagggaggttttccctgagaaagaaaaaggtaagaattatccaatgttaactttacaaagtctgtaaatctattctgaatagctttttttcctcgaaaaattttagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgaggtaattttaaaaattcttactcttgaggtgttgttattgtcttagaatcaaattatttatctccccaaacgtacatttccccccgctttaggagaatgtttatgccagtttattcctcttaagtcctgttttctccttcagtgtaccttgcctgtaatntctagtccttattccttttccttgaacatcaacatttgccagagtagattctgcagatcactagtctcatatgacacttcattattaaagtgcttgctgttttgatgccctcttgc

SEQ ID NO: 633002 - DNA, 850 bp, Homo sapiens
cttacatgaggtaaaagctaaatgaatgattatatatgtaaaagggttttgtcaagtattaggcaacagtaaggcatttcagctactgagggtaatcagaattgcttggaatcagtcttcatttttgtctgtccccaagatcatagtatgcagagtctgctaacattgagtgcttcttacgtgttactcactttggtgggctttaacatttatattaataattttacttgtgtttctaacaggggtcttaggctatcagtttaggctccattttctagattggaagggcctcagtattgggccatagaatcaatttctgctggtatccttttcccttaatctccactctcggctcagcttagcactttgcatatataagttctcttgccagtaatgataggacttgtattacttcgttaaattctgcctggaacatatataaataaaatttgctgttagctttagacctatattcctaaatccatttgaatggatttacccatttattccttacattaaagaatcttggagaatattgtgcaaagaatggccagatgggattaacaaagggaggttttccctgagaaagaaaaaggtaagaattatccaatgttaactttacaaagtctgtaaatctattctgaatagctttttttcctcgaaaaattttagttgatgaggaatctggattaaaggattcagaaccagagcgaaaacgcaagaagactgaagactcttcttcaggcaaatcagtggcgtctgatgtccctgagggtaaagttaaaatgacatttttttctcccatatgaaatttaaaagtcgtccgagcgaccgagatcctgtagagtct

SEQ ID NO: 633003 - DNA, 448 bp, Homo sapiens
  misc_feature (8)..(8): n is a, c, g, or t
  misc_feature (21)..(21): n is a, c, g, or t
  misc_feature (37)..(37): n is a, c, g, or t
cctacctnatggaaaagctcntggaaacaataaggantttggggatttaccataaaattaattgggtgaaatagtcagccttgagtatagataaggtacgcaggtgaggggagcgcaggctcatgtcagtgactcaaaatgtgccctaaaacaattgtgaaggagaagtcggtgcctatctacaaatccctttagtaaagttccttcagtcttcagctgaaaaatgaagagactggcctaatgtaaaaaattctcagaagttctttctggttctaataccatgattcactaactgctattctgcagtacatcctgcctgaccgctattgaaagcaagcaagggcaaccctggggcagctggaaccggcccagcaacatcagcaatacacaccctaggcagtgtttctcaaattgtgttgctcagaatagtaataagtgtcccctacta

SEQ ID NO: 633004 - DNA, 443 bp, Homo sapiens
taatttaaaggctcatattacattattatttccccttccccatttcccagaagatactcaactattatagattattagctaacaaaacaaaaaccagtgatggttggtaaaaattgttcaagttcagataagaagctatgttctctagaagacaattctagagttcaattcccattgacttggtaagattcatgggatagagaaattcttagatctgagggtcccaggtcccagatgtttggggcattattcttaaatggtccggccacgggagatttcccccgaggcagctatgttttggagtcccttggtgtcccaggccttgggtttcatgtacagttgactcattttttcttgacacttgacataggcttcgtagtctgcaaagattttaaacctgtcatgataaaatagcatgtggatgatttcttggaagaggtcag

SEQ ID NO: 633005 - DNA, 3107 bp, Homo sapiens
  misc_feature (3017)..(3017): n is a, c, g, or t
  misc_feature (3021)..(3021): n is a, c, g, or t
  misc_feature (3023)..(3023): n is a, c, g, or t
  misc_feature (3026)..(3026): n is a, c, g, or t
  misc_feature (3029)..(3029): n is a, c, g, or t
  misc_feature (3031)..(3031): n is a, c, g, or t
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633006 - DNA, 2457 bp, Homo sapiens
  misc_feature (2367)..(2367): n is a, c, g, or t
  misc_feature (2371)..(2371): n is a, c, g, or t
  misc_feature (2373)..(2373): n is a, c, g, or t
  misc_feature (2376)..(2376): n is a, c, g, or t
  misc_feature (2379)..(2379): n is a, c, g, or t
  misc_feature (2381)..(2381): n is a, c, g, or t
gctcttaccctcgcgacgtgtatccactgagagtatccgacatgttagatcgctgtagctgtcgctataatgcacaatgtatgctgtcgcgtcgaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633007 - DNA, 3053 bp, Homo sapiens
  misc_feature (2963)..(2963): n is a, c, g, or t
  misc_feature (2967)..(2967): n is a, c, g, or t
  misc_feature (2969)..(2969): n is a, c, g, or t
  misc_feature (2972)..(2972): n is a, c, g, or t
  misc_feature (2975)..(2975): n is a, c, g, or t
  misc_feature (2977)..(2977): n is a, c, g, or t
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633008 - DNA, 586 bp, Homo sapiens
gtctccagcacccagaatctcattaaagcttatttattgtacctccaaaaaaaaaaaaaaaaaaaaaaaaaaaaaaaaaaaaaaaaaaaaaaaaaaaaaaaaaaaaaaaaaaaaaaaaaagggggggaaaaggacaaaaaaaaaaaaaaaaaaaaaacgagggggagggcacgggccggagttaaacaaaaggggggacgggaaaaaatagggggggaccaaaaaaaaaggattgggaggggaaaacccttgggcaagctggagtaaaagccaagggggccgaaccgaatgcccaagcgaacagaagagcagacggaatggaaaaagggaaagtgaaagggttaaggttaagttaaaaggcgagtgaaaaaaaggaaaggcaagataatttgaaaaacaaggggccgaaatggggaaagacccttaaaaagtaaacgaaaggaccgagaaggggtgagcgttgttaaagtagggaacaagagttcactagtaaagaacggggcctcaaatgtgaaagggggggaaactgaaatagggggagggaccgtcgggagccaaaccttaaaaaggggtggggccaggaggg

SEQ ID NO: 633009 - DNA, 2915 bp, Homo sapiens
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatacacaaatcaactggaccctaaacaaatttctagtgaattctttcctttcccccaatcacctagagcttctttcttcagcctcattctgctccttttcctttctttgcttggccatgaatttct

SEQ ID NO: 633010 - DNA, 117 bp, Homo sapiens
gctctgaggatcccccgctgtacagttgcgcctgcggctctccgggatcggtcgcgttcctgcactgactgcctcgggcgcccatctcctgcatctggattcggggatctgaacccg

SEQ ID NO: 633011 - DNA, 1733 bp, Homo sapiens
  misc_feature (1643)..(1643): n is a, c, g, or t
  misc_feature (1647)..(1647): n is a, c, g, or t
  misc_feature (1649)..(1649): n is a, c, g, or t
  misc_feature (1652)..(1652): n is a, c, g, or t
  misc_feature (1655)..(1655): n is a, c, g, or t
  misc_feature (1657)..(1657): n is a, c, g, or t
gtggaatagcctctaataaaatgctgattatattacaggtgcaaattgagcatgacccagaattagaaaaagaaagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633012 - DNA, 138 bp, Homo sapiens
gactgaggcgtagcggaggaaacaaaattttttttctcttcctggtgtttagattacccaattaaatccagaaccattacattgtcaattatatccataggttttagtttctagtatatacatttgagaccctgtcac

SEQ ID NO: 633013 - DNA, 142 bp, Homo sapiens
actgtcggggtgtcgacgagggacagcacatgggaaggagtcagttttgtatccataattcatcttgtgtgctagaatgcatgcttattttcctccaaatgaggactattcatttcaaataggaatttcttttattctcctg

SEQ ID NO: 633014 - DNA, 2296 bp, Homo sapiens
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatactgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattcgggcatctgagaagaaatgaagccaatgaatcccttacagtatctccttcatttcctttagtattatgtggctccc

SEQ ID NO: 633015 - DNA, 177 bp, Homo sapiens
caggtaaatgcatgtcagtgtgacacatcaaacttctgtgagaaaaaaaaaaaaaaagcagattattttaatagggcaaggatttactctaaaaatatttggaaaacaaggcatctctcaaggaaggtaagacatactttttaatccccaaaaggttcattaaaacgggaacttggg

SEQ ID NO: 633016 - DNA, 2152 bp, Homo sapiens
  misc_feature (2062)..(2062): n is a, c, g, or t
  misc_feature (2066)..(2066): n is a, c, g, or t
  misc_feature (2068)..(2068): n is a, c, g, or t
  misc_feature (2071)..(2071): n is a, c, g, or t
  misc_feature (2074)..(2074): n is a, c, g, or t
  misc_feature (2076)..(2076): n is a, c, g, or t
ggggcgcccctcccccagcctcgttgccgccttgcagtttgatctcagagtgctgtgctagcaatcagcgagattccgtgggcataggaccctctgagccaggtgtgggatatagtctcgtggtgtgccgtttcttaagctggtctgaaaagcgcaatattcgggtgggagtgacccgattttccaggtgcaaattgagcatgacccagaattagaaaaagaaagccctggcttgaaaaccagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaattcatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggnagtngntgngtntnatttttaaatcaaatcatcaggcatggagaaatattttttaaaagtgttaaaataaatgttccccctgtatattta

SEQ ID NO: 633017 - DNA, 141 bp, Homo sapiens
ttcgacggtgtctgacattagcggctcagctttccgctgatacgtgactccaggaggctccttgagttctgtgtgttcagctggcctccggtggccccattattattttctggccaggtaaaggtcagtcaccgtgcacac

SEQ ID NO: 633018 - DNA, 1988 bp, Homo sapiens
  misc_feature (24)..(24): n is a, c, g, or t
  misc_feature (62)..(62): n is a, c, g, or t
  misc_feature (109)..(109): n is a, c, g, or t
  misc_feature (242)..(242): n is a, c, g, or t
  misc_feature (565)..(565): n is a, c, g, or t
  misc_feature (678)..(678): n is a, c, g, or t
  misc_feature (681)..(682): n is a, c, g, or t
  misc_feature (1975)..(1975): n is a, c, g, or t
  misc_feature (1978)..(1978): n is a, c, g, or t
ttgttaaggttacttttcttgtantaaaaatactgccctgtggctcctctcatgcctgtaancccaacgtgctgggattacaggtgtgagccaccgcgcctgtccctantgctcactttttaagcctgttccccagataggattggagaaatatgccaattatcacaaatgtttttactacatttcttcttgctttatgaattgctgtattaactgcagtaaagctatgaaaatatttcctngaacactctattctgccatactcttttgtgaatttttttaaaaatctggtgtttgctctttagcaaaatgtgactggaaaatctctctaagattctgctgtggataatttttcccctctgtagatgaatagtaatgagttgtcagggcttctgactcttaagtgccgaagtctttatagtcctgtgttcaaaacaacctggcttttttgcctttttcacttgtaacgtgatcaattggtgttcataacaacaaaatacattattttagccattttcttaattggtactaaatacttatataatgccaagttaaaagataacangtatctggtgaaaactttaattattaaatcaattttcttttattctgatatagctgaattttaagatcattctatttttatttacttacagtcattaattgaccaataatggnttnntgttgttgttgttattattgttgctactactcatgggaaagtatcttcaagctgggcctggttacactgagtgtttgtgtgctgagcagccctctgatttctatttttgtgatctgatgtgagctgtctttgcatgcctctatctaagtagaacttaggttaaattcctgcgtttcaaatagctggccgttaataggtttgttaacatgtttcacagtgttttagtccagaagtctgaggtgtgtttactgatgtgtaaattcatttttaaaaggcgatgagaaatgtccagagtgacattgagaatggcctaaatacaaatggtgcaaagatgtccttgtcttgccagcttagaaaagttattgtcatcgctgtgtacctgataccatacaaaacatgctcatcatcttccagaaaagaagctcttcatcagattcaaggccagctttcattctagtctttttgttgtgctttctgtctacctcaggaaccatggaagtcatgtgtaatcaaggggtgatacggtatttgtgtgtgtttgtttttttttgacatttatattttaatcttgagtttataaatttttttgtcaagatgttactacagtatttaagaaaataatatcattcatgttttcattaacctaaaataagttttcttgcttgcttatcatccttcagctcttgtccatattcatacatagcattattgttcagtatttcattcaaccaatattgggtatttattgagaacctactacgcctcctgttatgttcctgtgccaggcacataacaggaaaaataactgtaaacaaaacagacaaaaatctctgccctggtagacattgcattataataatcagtagatatatgtattttatgcattctgcttttttcatgtatatttcaaacatttccccatttttactttgtcctcataaatactttaaatggctgtgtagcatgccatcttgtttttgaactgtaatttgcttaagctttctgcattgggcatttaagtgagtacctatatattacagttgttgggggactggttacattgttgtgaatgtctttatggatatgacttttatgtctgttgggccttgtccagagtctgggctagtggtcagatgattgggttccagtcccattttttccatttaatataatatgacctcagataagtctgtcagcatctctatgcttgagtttcctcatctgtaaaataatgataacacctccttcacaacattaaatgtgatgataatgcagataaagtgcctggaacanaangttcaaatcg

SEQ ID NO: 633019 - DNA, 345 bp, Homo sapiens
cagtgtactcttgagtggggtgggtctgttcctctatcagcatcacaggcttctggctgcgcaggatggctgctggacctgcggatggcatgccatgcgcaggtcggggcggtactatgttcttgcggatcatgtgtctgatgcttgtgagcgtggcgcgagcattcttgtatgatggtggtccgcacatacggagtgtggccggcttcctgcttgtgcctggatctccgcttaatgaccaacacgacacctttgccgtcggctgccggctccactgcccacagtcttgaggttgaatcagtccgtagtagcggccgtgaattgcgggccttcaaagttattgtg

SEQ ID NO: 633020 - DNA, 1934 bp, Homo sapiens
  misc_feature (24)..(24): n is a, c, g, or t
  misc_feature (62)..(62): n is a, c, g, or t
  misc_feature (109)..(109): n is a, c, g, or t
  misc_feature (242)..(242): n is a, c, g, or t
  misc_feature (565)..(565): n is a, c, g, or t
  misc_feature (624)..(624): n is a, c, g, or t
  misc_feature (627)..(628): n is a, c, g, or t
  misc_feature (1921)..(1921): n is a, c, g, or t
  misc_feature (1924)..(1924): n is a, c, g, or t
ttgttaaggttacttttcttgtantaaaaatactgccctgtggctcctctcatgcctgtaancccaacgtgctgggattacaggtgtgagccaccgcgcctgtccctantgctcactttttaagcctgttccccagataggattggagaaatatgccaattatcacaaatgtttttactacatttcttcttgctttatgaattgctgtattaactgcagtaaagctatgaaaatatttcctngaacactctattctgccatactcttttgtgaatttttttaaaaatctggtgtttgctctttagcaaaatgtgactggaaaatctctctaagattctgctgtggataatttttcccctctgtagatgaatagtaatgagttgtcagggcttctgactcttaagtgccgaagtctttatagtcctgtgttcaaaacaacctggcttttttgcctttttcacttgtaacgtgatcaattggtgttcataacaacaaaatacattattttagccattttcttaattggtactaaatacttatataatgccaagttaaaagataacangtatctggtggatcattctatttttatttacttacagtcattaattgaccaataatggnttnntgttgttgttgttattattgttgctactactcatgggaaagtatcttcaagctgggcctggttacactgagtgtttgtgtgctgagcagccctctgatttctatttttgtgatctgatgtgagctgtctttgcatgcctctatctaagtagaacttaggttaaattcctgcgtttcaaatagctggccgttaataggtttgttaacatgtttcacagtgttttagtccagaagtctgaggtgtgtttactgatgtgtaaattcatttttaaaaggcgatgagaaatgtccagagtgacattgagaatggcctaaatacaaatggtgcaaagatgtccttgtcttgccagcttagaaaagttattgtcatcgctgtgtacctgataccatacaaaacatgctcatcatcttccagaaaagaagctcttcatcagattcaaggccagctttcattctagtctttttgttgtgctttctgtctacctcaggaaccatggaagtcatgtgtaatcaaggggtgatacggtatttgtgtgtgtttgtttttttttgacatttatattttaatcttgagtttataaatttttttgtcaagatgttactacagtatttaagaaaataatatcattcatgttttcattaacctaaaataagttttcttgcttgcttatcatccttcagctcttgtccatattcatacatagcattattgttcagtatttcattcaaccaatattgggtatttattgagaacctactacgcctcctgttatgttcctgtgccaggcacataacaggaaaaataactgtaaacaaaacagacaaaaatctctgccctggtagacattgcattataataatcagtagatatatgtattttatgcattctgcttttttcatgtatatttcaaacatttccccatttttactttgtcctcataaatactttaaatggctgtgtagcatgccatcttgtttttgaactgtaatttgcttaagctttctgcattgggcatttaagtgagtacctatatattacagttgttgggggactggttacattgttgtgaatgtctttatggatatgacttttatgtctgttgggccttgtccagagtctgggctagtggtcagatgattgggttccagtcccattttttccatttaatataatatgacctcagataagtctgtcagcatctctatgcttgagtttcctcatctgtaaaataatgataacacctccttcacaacattaaatgtgatgataatgcagataaagtgcctggaacanaangttcaaatcg

SEQ ID NO: 633021 - DNA, 919 bp, Homo sapiens
  misc_feature (530)..(530): n is a, c, g, or t
cgcagtggctcacgcctgtaatcccagcactttgggaggccgaggcaagtggatcacttgaggtcaggatttcgaaaccagcctgaccaacacggtgaaacccgtctctactaaaaatacaaaacattagccgggcttggtggcaggagcctgtaatcccacctacttgggaggctgaggcaggaaaatcacttgaacttgggaggcagaggttgcagtgagctgaattcacattattgcattccagcctgagtgacagagtgagactctgtctcaaaacaaaaaaaaaggagaaaagaaacggttaaaaatggaaaagatagcctgtgttttcatctggcaaagaaaatcagtacagaaaactattactagtttggccatattagaatgaaagctgtttctgggtttggaccttaagtttcgggtctgggataatgccgttttatttaaccagccttcattttcatcatcataattattataacacgtaatgcagttcacattgatcaataaagcaaaactcaaatagncatagaatgtataccactgaaacagtacttctggcaaagtagcaaatgacacaggctgctgattccctttccccagaattaacccagagaactaccatttgcgagccagtgggatttccagaaaatccttaataagactgaggctcactctccccagattaccttcattatttttaccctgtcactatagaaattacaggggtagctagcaaatagggtcagaattcgcggggcaacattatgtccggtgcagaaaccggctgcgagtcaactggctgcaacctgtggctgtgacattggtcccaaatccatctaactacactgtcccttgtgccgggaactgggtccctcccttaacctgtttcaaggtcaggtcacacggggcaacg

SEQ ID NO: 633022 - DNA, 293 bp, Homo sapiens
atgagagagcgagatgaatgaaggttgacaacgtatactccttaccagagaaacactgcattcctcgatgtcactgagaggactatgaacaggcgagaggacagtaactgtccatatgtgccttatatactgtattgggtaattgaatgccagttgggctgttgaggaatggcttgctggaacattgaaacattgaaagacttcatccttgtcgtatactggcacatcagcggaacattcagtgctcctgactgggtgatagatttcttccacatctcctctcctctcttgta

SEQ ID NO: 633023 - DNA, 252 bp, Homo sapiens
ggtttgtgttgtgagtactgtaggtggatgggaggcgtccttagaagtagagtgtccagtctttgtttcctcaaacaggaagaaaagttagaagtaaagagagggtgggccttcccattgggtctaagctgtacccttttcatgcagtttgtctttgggatgggttgacttctggtcttctcaaggaggggaagtggccaagctgtctttgattcagctctttgggaacacctggacttggaaagggccttg

SEQ ID NO: 633024 - DNA, 239 bp, Homo sapiens
gcttaaggaaaggaaaagggtccccacccccaaaccaattttccccggggtgggggttaaagggattcccccggaaccccctttcccccgcccccggggttcccccccaaaaattttgggggcaaaattttttgaacgccccttggatgttaagcctttttgggggggggggggtccccccccccccccctttttttttgtttccccccaccccaataaaccttttttggtttttttga

SEQ ID NO: 633025 - DNA, 181 bp, Homo sapiens
caccaggcgcagtcattctcatatcgcccacgggttacatcctcattactattctgcctagcacaactcaaactacgaacgcactcatagtcacatcataatcctctctcaaggacttcaaactctactcccacagaactaatcatattttatatcttcttcgaaaccacacttatcccca

SEQ ID NO: 633026 - DNA, 392 bp, Homo sapiens
ctgtttaacgagactccccacaataagctccctggggaagggaatgcagagctgctgctgctcggcccagaagcagcatcaccaggaatgaggattcgaaaaccctctctctagtatgaggtctcggagagccccacaatggcttcggtgcctgctttgcaacttacccctgccaacccaccacccccggtgaggtccaatcccaaaaagccaggacgagttaccaaccagctgcaatacctacacaaggtagcgatgaaggctctgtggaaacatcagttcgcatggccattccggcagcctgtggatgctgacaaactgggccatattccctcagaatggcccccaagggacagccatgtcttgctagtctcctcagatcagacctgtgt

SEQ ID NO: 633027 - DNA, 106 bp, Homo sapiens
aaacatcacctcttagcatcaccagtattagaggcaccgcgcccagcctcatctattttatattaccctccttctagaaaatgatcccgtcatagaaattgttcct

SEQ ID NO: 633028 - DNA, 141 bp, Homo sapiens
aaaaagggggtttccccaaggtcgttccactcctccccggtgggcgtatgggcgggaggcgtttctcggggaggtcttttatgcgtgttcgttttgttggcgcccggtccctgtttttcccccccttttatttgcccgcgg

SEQ ID NO: 633029 - DNA, 114 bp, Homo sapiens
caagtcactggttcaggcagggtgcatggtggctcatgcatggtggttgcatccatccaggctcattgtaatgtgaatcttgcataatggccatttggccaaaagccgtcacgg

SEQ ID NO: 633030 - DNA, 585 bp, Homo sapiens
tccctctctgcgtccagattctcatctgcctccattcaatcgattatcatgtctcagcctcccgaatagctgagattacaggcacgtgccacatacctggctaatttttgtattttcaatcagagacagggttactccatgattggtcaggctggtctcgaactctcgatctcaggtggttcgcccacctcgggctcccaaggtgctgggattgcaggcgtgagccccaaagcctggcctaaaaatcatttattgaaaggtcactctttgaaggactataatgtgaccaatagatttgggccacaaggagagcattgtgccatgtgccaaaaaaaatgggatgtcagggtggcagctgatgacgtttcgttgaagagtgcgtcatagagggggaagacaagacagcaggtgtggactctgctccttcagtacaacttactgtatgtgtagtatggtgaccacccacccttgactgcggtagttcctggaatgctgactttcaattgttacaccaaaagtctggggcaatctggggccttggtcactagcgggagatatatgcaggtctaggatgtaggaataaat

SEQ ID NO: 633031 - DNA, 142 bp, Homo sapiens
ggagcgcgcgggcacagggtgcgctgaccgaggcgtgaaagactccagaattggaggcatgatgaagactctgctgctgttttgtgggggctgcttctgaccctgggagagttggcaagttcctgggtggaccagacggtct

SEQ ID NO: 633032 - DNA, 480 bp, Homo sapiens
ctgcccggacaaagcattgggacacacgcctcgtacggaagctggcttttcctctccagaccagagcacgccaggctgccaggtgccactcccgagctcactctttgcgcatctcatccctcatgccggatgctcttctccccgccctagtctgaccttttcagtacatctggataaacctgctgtgctgcctgtccgtgacgcgaggcgctccccgaacctggagccaaactctggtgatgaaacagctggcaccaaagagctggttctgcctcctcctcaccaagtaaacacgtactttattttttaaggaaagaaaagtcttaaaaatatatggcactagagtgtaaaactatacaactgcatccaatgaaaattccctgcagcttgcagcctgtggcacaccatgtccctcagatgtagagctgatgggaggccagggtgtccatgaacggccgcaccaggttgtccggggttgtt

SEQ ID NO: 633033 - DNA, 421 bp, Homo sapiens
agaaagggattatggatgaatctgctgttcaccaccacacagatggatcatgggtggtggtgaacagagatcatcaagtctgattgcgtagctgctgcgacacacggcttcgacggcgaagtacgccgcgtcgaacgaggcacgacgcacttcgcacggacagtagacgcacgcgaggaagcaccgcacacgtgcttatagcgcacagaactcaacgcgactcagccaccccccgcacaacaccacgcggaaccacccctaaaccgcacacaaccaccaccaacaaaaaaaacgacgcagcacaccccacgaacgaacaccacccacagcgacgcaccccaacccaaaacgcacccagacaacaaccacacgaaacacaaaaggcaacacgcacccaacgacaaggcagcagacgacacaa

SEQ ID NO: 633034 - DNA, 141 bp, Homo sapiens
agccccagatctgcctactgccatagcgtttggtcgggcaggtcagggcgggggagcgcaactcaaaacggaagaaacaccctagtgactaggcatggatgagaatcaccccccgagtcgcagatgcagagcccacgtgca

SEQ ID NO: 633035 - DNA, 814 bp, Homo sapiens
  misc_feature (814)..(814): n is a, c, g, or t
agcgggtcggctggtgtcccctgtccgcatgtcgaccactcgtgtgctcctgcacctgacccgctgcccgctgctgctttgcgctgctgtccctgtgctgctgtgcgctgctgtcgctgccctgtcagcgcggccactgcgtcgctgggtgggcgtccaggctgggggcgccccaggggcgggtgcccgatggcgcggcccaacagcatggtggtggaacaccccgagttcctcaaggcacgggaacggatgcctggcctgcagatctggcgtgtggagaagttagactctggtgcccgtgcccaccaacctttactggagacttcttcaccgggcgacgcctacgtcatcctgaatcacagtgcagctgagggaactggaaatctgcagtatgacctccactactgggctgggcaaatgagtgcaggcacggatgagaagcgtgggcatggccgccatctttaccgtgccagctggattgactaccttgaacggcctggagccacgtgcagcaaccgctgaaggtccaggggctttcgaagtccgggccaactatccttaggcgtacttccaaggtcctggccctgacagttacaacgaccgtgacggtgtgcccatccaggacttcaagccaccgtggctacccaacaccacgctggcgtgcgtgccacaagactcctttccaaggggtcaaaacgtgggccgccaccgtagctagcatccccgtggcccaacccgaagtgtaaacccctgttgttacctagggaaagaacgctttacaaaccaagctggcgaccatggcttacaatccccn

SEQ ID NO: 633036 - DNA, 149 bp, Homo sapiens
actctacaggactcccactacggcgatacctgtggggggtgtgtgtgctgtgtgtgtgtgtgctgtgtgttgtgctgtgtgtggtgtgtgtgtgtgctgtgttgtccgtgtgtgcttgtgtgtgtgtgtttggcggggctgggtggttg

SEQ ID NO: 633037 - DNA, 576 bp, Homo sapiens
tgtagtaggggtgcgtgcctgtagcctcagctactcgggaggccgaggtgggaggactgattgagccagggaggcaaggctgaggctgcagtgggctgtgatcatgccactgcattccaacctgggtgagagagaccccattttttaaaaaatatatagggccgggcgcagtggctcacacctgtaatcccagcactctgggatgccaaggcaggcagataacccgaggtcaggagtttgagaccagcctggccaacatggtgaaaccccattcctactaaaaatacaaaaattagccaggcatggtggcaaatgcctttagtcccagctactagggaggctgaggcagaagaatggcttgaacccaggaggcagaggtttcagggaaccgcgattgcgccactgcactccagcctgggcgacagaacaagactccgtctcaaaaaaaaaaaaaaaaaaaggataatcccttctgggcttgattcaaagacagagtgggaaaatgaaaaaattctggccggcttaatctccaccgaatcagaattggaggagcccaactttattccatatgggccc

SEQ ID NO: 633038 - DNA, 424 bp, Homo sapiens
gcgaaccgagggagcccatgggccattggtaccagaggcttatggtttgtcggcttggtctttgagatacatgaagagaagtggctacagcgaacctagtgggcaaagcattgtgatactctacacaaaggccctccagctgctccaagaagaatatctgccttcttgagagctgatatggattggctctgtgtccccaccctctcatctcgaatagcaatccccatgtgccagaggaaggccctggtgggaggtgactgaatcatgggggcggacttcctgcttgctgctcttgcgatagtgagtgagttctcacgagatctgatcattggtgtgcgggacattccgcgatacccgcctactgctccatcatggtgatgtgcatgctgcccctccaccttctgccatgattgttagtcttctg

SEQ ID NO: 633039 - DNA, 106 bp, Homo sapiens
cgatacacgtgtatgtagctatgtgtcatctaaattgctgtctagtagtaacaaaactacaaatcatcaaatcgcaactgatcagaaagttctcggagactagaaa

SEQ ID NO: 633040 - DNA, 295 bp, Homo sapiens
accacctctcctgtgcagatctaggccgcactccccgtgagtgctcctcaccttgccggcatagtggataatgcagaaatcagctgtgtccttcagctgctataggcttctggaacttgtgggtggtgtgccctgctcctgcatcaccttctccacgtaagctctcgatcggtcggcttatggggaaccacgcactcctctgtcctagcagggcacagaatgccctggggtggcctgcatggcattctcgaatgcaggtcggatgcaagggctgcagtgtcgcaggcccaatgtc

SEQ ID NO: 633041 - DNA, 281 bp, Homo sapiens
  misc_feature (208)..(208): n is a, c, g, or t
  misc_feature (226)..(226): n is a, c, g, or t
gtattatctttttgaaatgttgttggattcagttagctagtactttgtttaggattttagcatctatattcatcaggaatattggtctgtggttttctttttttgttatgtcctttcccccctcttggtattaggatgatactagcttcacgatgatttaggagggttcctctctctatcttgtagaaacagtgtcaaacaggattgngtacccaatttatcttgnaatggtcctgggtagaaattcctgggtgttgaattccggttcttggagcccttgg

SEQ ID NO: 633042 - DNA, 191 bp, Homo sapiens
ctgtgaatacaccagcgtgtgtactcaacaaaaggatgggctcattgccacctgcacggaggcgacgccacctggatgctgaataggcttccaattctccacacatgccgaccctgtgtgcacagcaactgttggttcttgtgctacattccatgtagtggctccgactgggacggtaatacaaactgtta

SEQ ID NO: 633043 - DNA, 84 bp, Homo sapiens
cagcaggaggactcggccgtgtatctctgtgccagcagctccgagccccagggactagcggggctctcttacgagcagtacttc

SEQ ID NO: 633044 - DNA, 225 bp, Homo sapiens
tttggagggtccatatcatttattgtaaagcacaaaacaggcattttattttttaaggtgtccattgaaaaagtccttttatttcacattgcttcacccacataattgcaaatacatttgctggaatgtgtacatctaccctaaatactaaaaacaaaccatttttcatttttacacagaaatattaccctcctatcagtagggatagatattttgtccattttc

SEQ ID NO: 633045 - DNA, 160 bp, Homo sapiens
ttttttttttttaccaggccccttttttcttttaaaatttgggggggggggggcccccccccaaaccccccgggtgttttttttttttccccccccccttttaaaaaacctttctcctgttttttttttttggttttaaaaaacctttttgccgggggga

SEQ ID NO: 633046 - DNA, 278 bp, Homo sapiens
gtttggtgaaaaggcttagttgaagaaaccttaaggccctgaccaccctgtgttagtaatttgggcggggagggggggaacccaaccatgttttgtgttggcaaaacaaaactgttaaagattgttgatcacccttttaagggaatttgtcttttatgaggaacccagggcaagcccctaaaaattgtttaaaagggccatcggcataaaccttgtaaaagctgaagttaattgagcttaaaggaattgttccccttaaagtttgggtttaaagccca

SEQ ID NO: 633047 - DNA, 125 bp, Homo sapiens
gtagaggattctgatgacggcgggggtagccagtacgtatccaggagagcaggtcacagctgcggaaacagcactcctcaacgatgccacggttgcgacgactcacacggcttgcggggccctgc

SEQ ID NO: 633048 - DNA, 402 bp, Homo sapiens
agtatcaggtcgtcaccaagggtggtgcggagtgaaccagggctttttctcagtatgaaagatggaagccaatgttgatagagctaaatgaatgaaggggagagtgataaggcaatgactagattatgtatattttgtagtccatgttaatgagtttagattttatgctaactacaataggaagccattgatgcttattgttagtaaattaatgggagacattttgcctatcggttggggcacttgacagacagccatatgatcatttccatgagaaaatgtcccttccattaataaacagtccgctttaggaataacaatcgtgtttctgagggatctagatatgtgctatcatagaaaaaaatctaccgcagtatttttttgtttcgaaaaacactattt

SEQ ID NO: 633049 - DNA, 357 bp, Homo sapiens
  misc_feature (49)..(49): n is a, c, g, or t
tcggtcatgcacctatgcctccaggtacaagtagttactcctgctcagnctcccgagagatggactacaggtgtgcccacaacgccaggctaattttggtattttcagtagagacagggtttcaccatgcatggccaggctggtctccaactcctggcctcaggtaatcctcccgccttagcctcccaaagtgctggaattacaggcatgagacaccaggcccgggcatcttcttgccagcaactcttagaccaggaagcctcggatggcagctatgaagtcctgtgcgcggacagcgtggatccagtggccagcgtccgccaccgcctgcatctgggcccgagggaggagccgcat

SEQ ID NO: 633050 - DNA, 1506 bp, Homo sapiens
cgagcacagagcgggaggacggacaggtagaggaggagagggggtttgcgcgcggccgctacccagaagccagcggaacggcagcacgggaagtgggactgtccccgaggcccagggcccggagcagagtgcaaggaagaaagaaagagggagaggaaaaagagaggaggagaaaagaatcgaagaaaagagaaaagaaggaaagagaaagagaaaaggaggagagaaaagaaggagagaagaaagaggagatgaaggataatagaatagatgagagagaggagagaagatagaaggaaggagagaggaaggaagaagaagaggaaggaggggagaaggagaagagatgagagaaagagatggagagagagagagtgagaagaaggagagagagagagatgagaaaagagaagaaggaaagagagaagaagcagagagaggagagaaggaggggagatagagagagagagagagagagaggagagaagagagaggaagagagagaagatagagggagaagagagaaggaggagaagagaagagagaagagaagaagaagaagagaaagggaggtgaaggggagatgaggaggtagagaagagagagagggaaggagaggagaaggaagagaatggggaagaataagaagaagaaggaagaaggaagaggataggaggagagagtgaaagattagaaggtagaagaggaggaggaaagaggaggaaggagaggaagagaaggtgatgagtaggggaaaagagagaaaagaaagcagagagaagagcaagggaggaatagacgagagaaggaggagaaaaagaagtgagagagaataagaagagacagaggaaagagaggaaggagagaagcaggaaataaaaatagaaagagcaagagaaaaaagaggaagggagaagaaaagaggggagaagaaaagagaggagagacacagagaaagaaacagagagaaatggatggaggagaaagagaggagtgcagagaagagatggaagagaagaaatggagatgaagaggaagagagagagagaagaagagagagcggatgaaggaagggaaggaacgagaaggagagggaggtgaagggagagagagagaaagagatgaaacgagagaaagggaagagaacaagagagagaaaagaaaaaaacagagagagggaggacaagagaagagagaaggagagaagagaagaagagagaggacagagggagaacaagatcatatgatcgacaaacaacggaggaggggatggaggaaacagagaagaaagagatgtaaagagaatgaagaaggatgtgagagaggagagagagagtggaggtcggtggggtgagagagaaggagtagagaggtagagagaaaaggatggagaaaaggaagagaggagaagggaagagtagaggaagacgtctttctggtaggtggtttactgtaggagaattaagaaggatagagcggaagtgacaggaggaagagagaaagagg

SEQ ID NO: 633051 - DNA, 204 bp, Homo sapiens
tagcggtaatcccagcacttggggaggcggaggcgggagatcacctgagcccaggaattcaagaccagccgggggaacagggcgaaactccatctccataaaaaatacaaaaagtagcggggcgtgggggcacacagcagtaatcccacctactggggaagcggaggggggaggacggcttgagccgggcaggttgaggatgca

SEQ ID NO: 633052 - DNA, 216 bp, Homo sapiens
  misc_feature (2)..(2): n is a, c, g, or t
  misc_feature (62)..(62): n is a, c, g, or t
  misc_feature (137)..(137): n is a, c, g, or t
  misc_feature (160)..(160): n is a, c, g, or t
anctcctccccccctcgccccactcccacccccttctctcccccacccttctccacaacccnctccgtccctatctccccacctccaccctctccaccttcaccctccccccccccccgcctcctctccccccgccncccccttcctccagccgcactcntccacttccccccccccactccaccggtcctcctctctctcccctcccctccctcc

SEQ ID NO: 633053 - DNA, 322 bp, Homo sapiens
  misc_feature (118)..(118): n is a, c, g, or t
  misc_feature (128)..(128): n is a, c, g, or t
  misc_feature (198)..(198): n is a, c, g, or t
  misc_feature (220)..(220): n is a, c, g, or t
  misc_feature (245)..(245): n is a, c, g, or t
  misc_feature (255)..(255): n is a, c, g, or t
  misc_feature (312)..(312): n is a, c, g, or t
gatctttgctgccagccacttcatcccctcccagatgttggccaacaaccctccctgccaccaggcactgcctggaagggagggaagtggggagccaatgaacaaggatgcaagtaangagtttctgnagttttctcctgtcgggttttggcctgttttgccttcacccataagcccttggaattttggtggaaggtnccttgtcctaagggttaaggantagggaggtcattctttgtgctcgntttaagggtnccttttccccaaataggtggtccattgggtattaattcggtactagtttctttgtgncaaattcttg

SEQ ID NO: 633054 - DNA, 120 bp, Homo sapiens
aaagcctgggggagggggtttttggggggcaaggaaccagtcagggggttgtttcccctcaaaaagctccccaaaggggcctccgcaaagccttaaacccaaacctagggtaaaaaaggg

SEQ ID NO: 633055 - DNA, 301 bp, Homo sapiens
ttaagtttgccaagaaaaattgatgtgttagtatcagaggaaaggggactggatcaaaagaaaaggagccaggcagaagcaactgctgggtcatcaatatagtcatatatttggtttgggacagaattagtgtcataatagcattcttctctttcacatgaatagtttctaaaaatataatatgttctttgaaatatatttcatatttcattcgtagagtgttaggagtggaatgaaaccctgaggctctgatgtttcagttataagctttaccacatcaaaaattgactcaggtggtgtg

SEQ ID NO: 633056 - DNA, 1301 bp, Homo sapiens
tgggacaaaattctcccaccccgctttaccccccctcctcgagagagaggccccctcttctggtgggcccccccaagaaaacttatcccccccccctctctcatgtgcgaaattctctctgtgtgggtctccccagaggaaacgaggctctctttttcttccgtgtggtcgctgctgggtcgcccagagagggctcaccacaacactcctcacacacagtgtgaaaaaaacccctattatctctcgagagaggagagagaaaacaagaggagagagagagatgtgttcttatatcatcaatatacacgctgtgggggtggtgagccccacaaaaaaacccgcgaggtgtgtgtgagaggtggcgggagaggtgtgtgggcggagctctccacacactcatcagagggcgctccccggtgtgtgggggctctctcgtgtcgctcccccctctctcctctcatcaaacacctctctcccgcgggggaggagtttgtgtgtgcgcgccccacccccgcgcgagagagagaagcaccgcgaaaagcgcgctccccccccccgcgcgcgcgcgagcgcgcgagcgcgcccgcgacgagagtgtatgagagaagaggccgcgcggtgtgatatagggagcccagagagccccacaaagcgcgcgcgggagagatgtgtgtcaactctctctcaaaagaccccgcgccgcgtgtttgttgtgaccccccgggggagcccccccccctcgcgctcacccaacagattttgtttgtgtgcgccgggcgagcccccccaacgagggggggcgcccatataaaaagcgctcgcgcgctctacagggtgtgtggccaaccacaatagaggcatcacacgaagaagagaactacccccgcggagagagaaccaagagaggggggaagcggagaaaaaaacaccttttttccaccacgaagaggggggagaattaacccccaggggggaacacaccccaaaaaacaaagcccccaaaaaaaacagcgggaggaggccctccccagagataacttcgtcaacacaagaacagagggaggagaacaccctctaattatatgatacccacaagaggagggccccccaccaaaagaggagacgggaaaaaagagctcccagacacccccccgcagaggaggaagacaccacacagaggagttgtgaccggcaggaaccacaccagagaaaaccgggtaaccctgcagtttcccccgaaaaaaaaaaggtcttgtttgtgttgggcaaaaaccccgcagccacctgtggagggggccctg

SEQ ID NO: 633057 - DNA, 275 bp, Homo sapiens
tagaggatcctacgtaatatgtaactattaacctaggtgaagattatgagcccacaggatgtgaatttcttaaagtaatacttgaatagttagaggaaaattggcatgtactttatctggtctggaatgtgtacaggacatgggtaaaggccagtatttgaactgggtgtattcttagctggccatgcctgcattccttagaagaggtatcttgggaataaatccaaatccctagggcacaaaagattatagcctttgtggtcgggccaaaggca

SEQ ID NO: 633058 - DNA, 222 bp, Homo sapiens
tttaaatgcaccaaagataactcatatacatagttaatcttcggtatccatggaggacctcctgcagataccaaaatccaaggatgctcaagtccctgatataaaatggcggccaggcgcagtgactcacgcctgtaatcccagcactttgggaggcggagatgggaggatcatttgagcccaggagttcaagacaccaacctgagcaagatgtctctatta

SEQ ID NO: 633059 - DNA, 498 bp, Homo sapiens
  misc_feature (339)..(339): n is a, c, g, or t
aaaagaggagctgctttccggctgggccaccaacagtgcccggggttttggtgagtctcttctcgcttgtaaagcctaaaacaaccggctggttgggagtaaaaagcaggattttttcccccctttcctttggggtctcaaaagcccctgggatttctttttccaaagggattttaaagggtttgggttcctgttagcaaaatttgggggggtggaaaaacagcccccccccgggttccccggggcccctggtcccccactgacctggggttcccccccgaatattttttctggttcaaaaaagggggggggggggttccctctttgtttccacctttnggggggggtgagggggcacttttttcttcccccctggaaaaaagaatttggaaattaatttggtttttccaaattttggtttgggggggtggggggtttatttaataaggccatttctgggaggtgggggggccaattaaggccttgggaccttcccga

SEQ ID NO: 633060 - DNA, 413 bp, Homo sapiens
  misc_feature (1)..(1): n is a, c, g, or t
ntatgaatatatatctatatctctcatcttaatttccaaaggtaccaaagggagttctacagagttaagcgttgcttgcctaaatctaaagatttggaaccttcatagcaagacccttgttgccagtaatttccaattcgccttaaaaaaagccggttagagaatccatttaaccagtcattaaagccagagagtctaagacagccatgtgtaattgcacagacacccttcttatttaagtatagaaagcatgtgaccctttgccattcttccacatccaccacacaggtggctctcttcacccacagggctatctttcaccttagaggcaaaaaccccagagattctcctcacaccgtgttcccccttctcctcgagctctctctctctctctctctctctccccgcgtgca

SEQ ID NO: 633061 - DNA, 474 bp, Homo sapiens
agcgtctcgtaggccgtcgagctctgtcgtgcatggccgtgcatccaagatatgtatgatcagcgacggagggtgccgacagcgcttccctgccgtagctcacatgatctgtactatgcccaaggctgctcctacttgccacatggctccatacccatcatcctcaaaaactcagttcagggaccagccccttcaggaaactttccaaggggtagaattacttgtcttttctatgtgcacctgccagaccctgtgcatcttactatagccacagttagcatactgaattagagccgggacacggttgtgctcacgcctgtaatcccagcactttgggacgtgccactgatggggcagatcacgaggtcaggagttcgagaccagcctggccaatatgttgaacccctgtctctactaaaaatacaaacaaattcggcgggcaaggtgtcaggtgcctgtaatcccagctacttg

SEQ ID NO: 633062 - DNA, 898 bp, Homo sapiens
gagtgcgttacttacctcgattcttagcttgtcgggcgaggtaaccgggaccggtgtctgctccgtgtcgcgcttccgcctcctaatccctagcgcatatgcgtgagatgcatctccatccacgtgggcaggctgctgtccagatggcaatgcctggtggtgacgctctagtgtcctgaacacgtggatccagcccgatggcctgatgccaagtgacaagaccatgggggaggagatgactccttcgacaccttcttgcagtgagacgggcgcgtgtgcatccacacgtgccctggatgtgtttgtagacttgtgaacccagagtcatggatgaatgttcgcactggcatctaaccgcaggtcttccaccctgagcagttcatcacaggcaggaagatgctgcgaataactatgccgaggtagtacaccatgtgcagggggctcatggacgctcgttgtgtaccgcattcgcaagctggttgaccagtgcacgggtcttcaggacttcacttggtttttccacagctttggtgggggaactgatctgggttccacctccctgactcatggaacgtctctcagtgattatggaagaagtcccagctgagttctcattcacccagaccccgagtttccacacggttggttggagcccctaaaatccattcttaccaccaaaacaacctggggcactcttatggtgcctcacggtagccaaggaggcccttgacttgtgtggtgaaactcatttggggccaccatataccaacggtttaacgagtgtgtctcccccgttccggaagtggcgcattgtgtgaatacaagtgtgcccccactcctgcaaactcgtgtggaccacaacttacacatgtgcaccgagacccaatgtgtgtctcca

SEQ ID NO: 633063 - DNA, 1177 bp, Homo sapiens
ggagagagagaactagtctcgagttattatatttttatttatctgggggctgtgactgtttttacattcattcttgaatcccgcgttccccgttggcgtgggggcatgaacacatctctgtgggcaccatgtggtgaacttctccgtggtgggtctcccataaccctttgctgtgttcccttgactcgtgatagcaccccaccaaagagaaagggatccaagagaatagggggaaggtacctaccctcaccatttgaaaccccgtggtgtccacatctgtgttcaagggagaacaggccttctgtgggccacacgacaccttttgtgaaaaagcgctatgagaaagacagaagagaggacgtcaggggccttaggctcacaaggggcctattgtggccaccccacaacaccatccaaagacccccccgaggaaagtgcccagcggcgccctcaaagagcccgggtgagctaaaggggcggcccacgcaaagaccagcggtgacacgcaacaacaacatccgtggaagagtggaaaaaacacggaggtgaaacaggaagggactacgagggcgaataaaaacggcaagggtgcaccacacccaagcccaacagcagaggtggcaaatgtgcccacagtagaggaagagagggagacaggagagcacccacccacacaaccacccaatggaggcggccccaagaggagacaggaacacccacaaaaaccgccccacaagagagagcccctagcaagcactacggcgccacaacgagggaataacagaagagagtagccaccacaccagcgcccccccacagagagaacaagaaaacaacgcagagcacaaagagagcaacaagaggacaaggcagacacagacataaaccgatacggacccagaacaagggagagcagcacccaaagaaaggagccgaggactaagaaaaccgccacacaaaacataagcgaagcgacacacagctaagcgcaacaaacagcaagaccccaaacatcaggcagcacaaatgaagcgccccaccaacacggggacaccaaagcccatgaacacaacaaacacacacccaaaaaaaacgcagaagccgacacaaccaaagctgcacaaacatcagagagacagaggcaatagaccaaggacggaccatgacacagaaagga

SEQ ID NO: 633064 - DNA, 369 bp, Homo sapiens
gaggcaggaggattgcttgagtccaggagtttgaaaccagcctggtcaacttagtctctacaaaagaaaaattttaaaaattagttggggctgggcacagtgctcatgcctataattccagcactttggtaggctgaggtgggcggatcacttggggtcaggagtttgagaccagcctggccgacatggtgaaacctatctctgctaaaaacacaaaaaattaactggatgtggcagcgcgtgcctatagtctagctactctgggggctaagacgggagaatcgcttgaatgagggagccagaggttgcagtgagccaagattgtgccactgcactccagcctgcactccaaacagagtgagactgttt

SEQ ID NO: 633065 - DNA, 125 bp, Homo sapiens
atcatcagctcggtaccttcgattgggccagaggcggaagatgaggaggacgcagcggtcacgggccccaaaggacagtgacgaaatgcttctcgctctccgtgcagatctggatggcgttgggg

SEQ ID NO: 633066 - DNA, 814 bp, Homo sapiens
acaaggccctgcagcggcgccggcggacacctgagcccttgtctcgcaccggctcccaggagggcactccatggagggctccgccccgctgcccctgcagagccaggcaccctcaagacagtctggtggctactccaggcattgacaagctgaccgagaagtccaggtgtcagaggatggcaccttgcgggtccctggaacctgagccccagcagagcttggagggattgggcagcccggctaagggggagccccaagccaggcatggaggggagcagcgggccgacgtccaacctcatcaaggcccaagttgggcaagtgagaagcccaacgccagagtgggtcctctccttggaaggttcgaagctgccgcttgcagaaccatcatgaggcttgctgcagtgtgctggttcccgcaggtggagaagatctgcatcgaccaaagggcctggacggatgagtctgagatcctgcgggttcctgcagctattggcaccctggtgggggcctgctgcccgtgccccaaccccatcctcatccgcaagtaccaggccaactcggggccactgccatgtggttccgcacctacatgtggggcgtcatctatcttgaggaatgtcggacccccctgtctggtacgacaccgacgtgaagctgtttgagatacagcgggtgtgagggatgaagccgacgaggggctcaggtctagggggaaaggcagggccttggtcctgagggcttccccaatcacatttctgagctttaaatttaccacgatcaggcctggaacatggcagaattgccctgatgtctc

SEQ ID NO: 633067 - DNA, 824 bp, Homo sapiens
agcggaaaaaggcggaagcggaagtcggggggcgcgccagctcgtagcaggggagcgcccgcggcgtcgggtttgggctggaggtcgccatggggcgaggcagctgcctccctgtcctctactgccggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgcaagcttatc

SEQ ID NO: 633068 - DNA, 2925 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 633069 - DNA, 2662 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 633070 - DNA, 426 bp, Homo sapiens
ttcagcgactgcagctcagccaacccaagggaagacctgggtgccttcagcagaggtcagatgcagaacccatttaaagacgcctcgtttccgctgcgaactggggatatgagcggccccgtgttcacgtattccggcatccacatcatcctccgcactgagtgagtgtgaggagcccacgcctgccctcgtagcagtgcagggcggtaggccggcgggctcccccttgcccgccagccattggcggaacctcccactccctgccaccgtcacacagtgctggagggagactcgaggggggaattgtttctagttaggcgacgctcctctgttcagtcgcaaaggtggagactcatggcgcggagccatggggggtctgagcaactgtgcggcaccctttcacccccaattaaacccagaaccact

SEQ ID NO: 633071 - DNA, 282 bp, Homo sapiens
ccatggacatctaaaccaacagccatgatgggggcagaagctgtgtgccagacattatacaggcagcaaaagcttgtggtcatgcctgggctcatagtgactgagcaggtacttcaggcccttggaagcaggcagagcggtagatcatgagacatattgcaaagaaggggcctctgatttcaagtcgaaactttgaaggtcctactgtgggttgcctggcaggatttcccacaagccaggaagtaatttccttatgcagacaactaaaactcacttgaaagc

SEQ ID NO: 633072 - DNA, 2901 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 633073 - DNA, 143 bp, Homo sapiens
actagaggaccggaggtatgctgcacagaaaggggtcagtcccagatccaagagcagaagctggacctgtatgggaaagaattaatatggagaaaaaactgaaaaagtaagtatatcgaactgtatcatgggacagaaacatg

SEQ ID NO: 633074 - DNA, 3200 bp, Homo sapiens
  misc_feature (2299)..(2299): n is a, c, g, or t
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcantggtaccagcagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcaccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 633075 - DNA, 4331 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagcgttttttctttaattaatttttttgagatggagtctcactctgtcacccaggctggagtggtgatctccgctcactgcaagctccgcctcctgggttcaagcgattctcgggcctcagcctcccgagtagctggactacaggtgcaccccattaccatgcctggctagtttttgtatttttagtagcgacggtgtttcaccatgttggccaggctggtcgtgaacgcctaacctcaggtgatccacctgcctcgggctcctaaagtgctgggattacaggcatgagccaccgcgcccgacctgcatcaacgtttgctcagggggcaggtggtcaggctgatggcccagctgcaggcagggtcatttccagcctgcccctccctgaggctgcgtgccagggttcatgtgtgccctccgcggctctgcactgaccccgccggtagctggggaggagtttgggcttggcgcctccttcgtgtagtggctgaagcttcccgggtgctcctcattcctgggaagggagtcgggtgatgggaacggtgggagctcagcgctccgagtctgcggccgggggccagcggggctgaaacgcgcctcctgagtgttgaaagcggcaggcgccggcctttgcacccagaggccagggcgtctcactcaccttcacatccaggcctcttaggggagcgcggctttggcttttccaggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacctggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgcaagcttatc

SEQ ID NO: 633076 - DNA, 127 bp, Homo sapiens
  misc_feature (23)..(24): n is a, c, g, or t
caagacctgatggatatccttgnnccctcccctgctattatacactttcttccttttttgtgtccttcttgtactcatggcagaagcaggacacaaaaaaggaagaaagatgtataatagcaggaag

SEQ ID NO: 633077 - DNA, 3088 bp, Homo sapiens
  misc_feature (2937)..(2937): n is a, c, g, or t
  misc_feature (2948)..(2949): n is a, c, g, or t
  misc_feature (2962)..(2962): n is a, c, g, or t
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcaaaaaaaaaaccnaaccacacacnnccaaccaccaccnagcacccaacccacagacagcacaagagagcaacggcacgcacacacacaaccaccgcgcacacaccagcgccagacacacaccgacgcggagagcggcggcaccccacaccgacacgcaggccgc

SEQ ID NO: 633078 - DNA, 3262 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcaaaaacacaaaacaacacaaacaacaaacaaacaccaaacaacacaaagagcggcggccccccccacaaacaactctcccccgaggggccccacaccctcgccgccccccgcccccccgcgccccaccgggcgggccccccatctgggcgcgcccagctccttaccccctcggcggcctcgtgcgccgccccccgtcttcaacgcgcggtctgcggcgctttggcggcaacactgtgcgtccccctctggcggcctcttgcggggcacgggcgccccctcttgtccccggcgggtgctgtcgccactccccctcgtggcacaccttcctcctctccgc

SEQ ID NO: 633079 - DNA, 466 bp, Homo sapiens
  misc_feature (352)..(352): n is a, c, g, or t
  misc_feature (397)..(397): n is a, c, g, or t
  misc_feature (419)..(419): n is a, c, g, or t
  misc_feature (432)..(432): n is a, c, g, or t
  misc_feature (463)..(463): n is a, c, g, or t
tgagacaggatctcactctgtcacccaggctggaatgcagtggtgcaatcatggctcactacaacctccacctccagagatcaagcagtcctcccacctcagtctcctgagtagctgggactaccagtgtgcgccaccatccccagctaattttttgtaatttttatagagagggttttatcctcttgcccaggctggtcttgaactcctggggctcaagctgtcagtccagctcagcttcccaaagtgctggggttataggggaagagccaccgtgcctgggccaagtgcaaagctttttaacaataggaagttttcaaggggctcagggaagggaccaggggggccattntagggttcttccatggagtttcacgctttaacatttattgttttnacgttttgttccaggttaacanttttgggtttttnccacatccaggtggcattggcctgtttaggnggg

SEQ ID NO: 633080 - DNA, 164 bp, Homo sapiens
cgtatcatcaggatgctctagaaacaagtcatctgacgagatctagaggcggggcttttcacatgaggccaagacaacaagtatacaatcaatacccatgtgacacagtccaagtgctggggaatatgagggggcagtgggccatggggaggaagatatcagcc

SEQ ID NO: 633081 - DNA, 3108 bp, Homo sapiens
agcggaaaaaggcggaagcggaagtcggggggcgcgccagctcgtagcaggggagcgcccgcggcgtcgggtttgggctggaggtcgccatggggcgaggcagcggcaccttcgagcgtctcctagacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcaaaaaaaaaaaaaaaaaaaaaaaaactctccggggctatctctaattccgggcgtggcgggaaaaggcggtgttttggaattgggcccttgggccataagctgtgttccctggacccaggctttcttggtcccacgggggtacattcggccgggccccccttatggggagcccgaataattccg

SEQ ID NO: 633082 - DNA, 465 bp, Homo sapiens
cagactcaagccagaggcaagaagtatacgatgggggacgctcctgactattgacagtaagccacgtggctgtaatagaaaaatacaagctgggccttggacttccccaatttgccctacttgattgatggggctcaccagatcacccagagcagcgccatcctgtgctacattgcccgcaagcacaacctgtgtggtgagacaaaagaggagcagatccgtgttggcattagggagaaccaggctatgcacgtctccactcagctggccagagtctgctacagtcctgacttggcgaaactgcagccagactacttggagaaacttcctacaatgctgcagcacttctcacagtcccggggcaagaggccatggttggtgggagacaagatcacttttgtagattacctcgcctatgatgtccttgacctgcacggaatattagagtctgtattacctgcttgg

SEQ ID NO: 633083 - DNA, 285 bp, Homo sapiens
ccttcaagacggtgtctgttcttgttgccaggctggagtgcaactggcacagtcttggctcactgcaacctccacctcctgggttcaagcgattcaagtagcttggattacaggcgtgtaccaccacacccggctaactttctgtattaatagagacgggttttcaccatgttggtcagctggtctcgaactcctgacctcaggtgatccacccacctcggcctcccaaagtgctgggattacaggcgtgagccactgtgcccggccaccagaacaccgtcgaag

SEQ ID NO: 633084 - DNA, 3103 bp, Homo sapiens
agcggggggagaggaagtgcccgtggagggcggcaggccccctcatcccgcgccaattatcctcagctcgggccgtcccccgctcccgaaggctggccttaagtcacgacctgacccgctgcgcctcggcgtgcacttagaggagcccggagctcttcgccaagcgcagaactgaccccccgcaactccacccgcgggggcggacacctaccgtgggccgtgtcgggggcggctcccccaggtcgcctttcccatcccgggagctcacctgtgcgaagcggtcaaggacccgagcagctaaaggacaaggcgaccagccagctcctgttggagacagattgggagtccattttgcagatctgcgacctgatccgccaaggggacacacaagcaaaatatgctgtgaattccatcaagaagaaagtcaacgacaagaacccacacgtcgccttgtatgccctggaggtcatggaatctgtggtaaagaactgtggccagacagttcatgatgaggtggccaacaagcagaccatggaggagctgaaggacctgctgaagagacaagtggaggtaaacgtccgtaacaagatcctgtacctgatccaggcctgggcgcatgccttccggaacgagcccaagtacaaggtggtccaggacacctaccagatcatgaaggtggaggggcacgtctttccagaattcaaagagagcgatgccatgtttgctgccgagagagccccagactgggtggacgctgaggaatgccaccgctgcagggtgcagttcggggtgatgacccgtaagcaccactgccgggcgtgtgggcagatattctgtggaaagtgttcttccaagtactccaccatccccaagtttggcatcgagaaggaggtgcgcgtgtgtgagccctgctacgagcagctgaacaggaaagcggagggaaaggccacttccaccactgagctgccccccgagtacctgaccagccccctgtctcagcagtcccagctgccccccaagagggacgagacggccctgcaggaggaggaggagctgcagctggccctggcgctgtcacagtcagaggcggaggagaaggagaggctgagacagaagtccacgtacacttcgtaccccaaggcggagcccatgccctcggcctcctcagcgccccccgccagcagcctgtactcttcacctgtgaactcgtcggcgcctctggctgaggacatcgaccctgagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggctgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccagctccaggccatgcccgcagccggaggtgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctgatcccagcatggtgagtgcctacatgtacccagcaggggccactggggcgcaggcggccccccaggcccaggccggaccaccgccagccccgcttactcatcctaccagcctactcccacagcgggctaccagaacgtggcctcccaggccccacagagcctcccggccatctctcagcctccgcagtccagcaccatgggctacatggggagccagtcagtctccatgggctaccagccttacaacatgcagaatctcatgaccaccctcccaagccaggatgcgtctctgccaccccagcagccctacatcgcggggcagcagcccatgtaccagcagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagca

SEQ ID NO: 633085 - DNA, 108 bp, Homo sapiens
tgacatgactccgttgcctacgcctttggtacacctagaggtgatttcctttttcatcgatggtactatttcttagtgtttaaattggaacatatcttggcctcatga

SEQ ID NO: 633086 - DNA, 155 bp, Homo sapiens
  misc_feature (10)..(12): n is a, c, g, or t
  misc_feature (53)..(53): n is a, c, g, or t
  misc_feature (119)..(119): n is a, c, g, or t
  misc_feature (137)..(138): n is a, c, g, or t
  misc_feature (147)..(147): n is a, c, g, or t
agtaagaagnnnaactcctctgtatccacacaacatcttgtctgtccagaatntggtcccctccttctcatgtggaggagtcccgccgtgccccagcacagtggagcccaggctacgantgtccgttagcccgctcnntggtacccntcccaggc

SEQ ID NO: 633087 - DNA, 676 bp, Homo sapiens
  misc_feature (277)..(277): n is a, c, g, or t
tgccttgtggcaatttattctctgtccatgactaaagaaatttatttacagggtgtaaaaaatcatgccatgcttctgcttaaacactgctctatgtttattcaaaatacaaatcccaaatccttctcatgcccacaaggccttcttacttacagctttcttctttcctctccctgtgccttttacccctcctcacttttcctttctcccaggaggcctccaattgcctttagtgggactttctttgttgctcgttgctgaatcttccaaaaagcancagcccacaccctccaggcctgttggcaacttacgtgtttccttccccccagatatttctttcccccagtattattcagggtgggtctctctactctcctcttccctgagaggccttctgtctccagatgttgtcacccgtatggacaatcttcttcccgaaacagtttacctggccctaacgcttattctccttaggcagttgttcatccttccagccactctgccagatgctttttatatgtacttatcatctgtgcctccaatagaatgtaagtcccctgacggcagaggcttgattttggctcactgcagaatcccctttgtctagaccagtgctggaacttttcagaggctcgttaaacttttttttttttcccacccgggggtgggggctctg

SEQ ID NO: 633088 - DNA, 108 bp, Homo sapiens
tggcatgtatagtgctatcatagattgtctgtgtgtaaaggaggtatgattatccccacgtcacagggatggaacacaggaagcgttgacaggggccatgctatctct

SEQ ID NO: 633089 - DNA, 482 bp, Homo sapiens
agggtggggtgtataggagggaggaggaatataagaggtaggggagggggagagggaggtgtggcaaggacgcacgggagtaaggggggaggagagtcgctaacgagggggaggtagacaggatgtgagtaggtggtgcagtggagtaggaaagaaaagtgggggtgagggggagggggggcgcccccagccccaatggtggggcggattttcaccccgagggggcagagggagggggagtggggggcacatccggggagaggccccgttgggggagcgggtcagggagtggtgggcgagtatgtcccgaggtccgccgggggaggggaggatggggggtcaattgtgggggggccccgggggatcgggggcttgtcatgaggttgtggggggggcccccccccccccccccccccaggggggttgggtggggttttaaccccggaagggggggggttttttttaaaaaaatttttttaaga

SEQ ID NO: 633090 - DNA, 778 bp, Homo sapiens
ggactctctaattacactccgttacagtggcttgaaaccaataaatagaacattaatgaagaatatgagatgaagcaagttccagcaccatcacaggcaaccaaaatcctcgtgtaggagtttgataggtggcagattctgaaagctgagataatgtttgtgctcgaagtatatcccaaacgactgcagaaaagtaaaatttatttaaggaaagcctaaaatactacaaattttagcagttttgagataatttgcctatgtaagctgatatgaaattaatccattattcaagtttttcagaaattaactgtgaagatgaaattttctgctataaatatggcagcaaatgaagtaatgatgacactgttgagaaaatttggttatgaaatagccacatgcttgttctgacattctacaaatattccatgaggttgttttccatattggctccctggaaagccttagaaattctcaagaagtcttggctactgattccagatatccgtgtcaaggtggagcaaagtctcttcctcttgttgactggaacacagaaaattactatcatctgcaccaccccaccctacctttatctgtaaaataattgctatatttttatgatgccattgtaatcaaccaactgtatcactttttaaaattgtatctgaggctaaatataatttactgcctaaaatttaaatatattaataaacttagtaccgtgccgaccccgcttttttttttttctatattattatatataatattatatataaatttt

SEQ ID NO: 633091 - DNA, 395 bp, Homo sapiens
acccttgaaattcggaggtgtagttgtagtgagccaagattgcccaccacactccagcctgggcaactagagcaagaccctgtctccaaaaaaaaaaaaagaagtctgaaatggggcctcaaagggttaacatcaaggtgctagcacagatgcttcccttctgaaggctctggaaaaaatctgtcccttgacctttctatcgtcaagaggccacctgccttctgtggctcgagcccaattcactcaagcctgtgctactgtcatcacatcttctccgactactcctgctccccacttgtaaaacccctgtgataaccttgacccaccgtggtaatccatagtaatctctcgaccttacaatgggaatgagcaaccttcatcccatcgtgcaacca

SEQ ID NO: 633092 - DNA, 538 bp, Homo sapiens
ggactctctaattacactccgttacagtggcttgaaaccaataaatagaacattaatgaagaatatgagatgaagcaagttccagcaccatcacaggcaaccaaaatcctcgtgtaggagtttgataggtggcagattctgaaagctgagataatgtttgtgctcgaagtatatcccaaacgactgcagaaaagtaaaatttatttaaggaaagcctaaaatactacaaattttagcagttttgagataatttgcctatagaatctctatttaaaccaacacaaatgcccaacaacgatacactggattaagaaaacatggcacatatacaccatggaatactatgcagccataaaaaatgaagagttcacgtcctttgtagggacatggatgaaactgggaaccatcattttcagcaaactatcgcaaggacaaaaacccaaacactgcatgttctcactcataagtgggaattgaacaatgagaacacatggacacaggaaggggaacatcacactctggggactgttgtgggagg

SEQ ID NO: 633093 - DNA, 787 bp, Homo sapiens
  misc_feature (22)..(23): n is a, c, g, or t
attaaaaggccgcaacataccnnccactcacccatagagttataataaattccatttcttccacccccacttcgagttgaacttacctattggctccctggaaagccttagaaattctcaagaagtcttggctactgattccagatatccgtgtcaaggtggagcaaagtgtacatctgctttatcactcaaatggctcattttataagtgaatttattatttgatttattttctattaaaacacacatacaaacatacgtatgcaaagattcataaacagattattttgtgcttttggtgattgttttatcattttaataggcaataagacatattagcaagtaacagaactatttatgaaaacaacctagcacaacattcatattatcgaaagatactgtaattgcccctgagaaccaaagtaaaatatatcttatcattctcaaaaaatatatattaataatgttagagtaggatatagataacatcagactccaaacattgattaggtgcttttatcttgtgattgcagctcttcctcttgttgactggaacacagaaaattactatcatctgcaccaccccaccctacctttatctgtaaaataattgctatatttttatgatgccattgtaatcaaccaactgtatcactttttaaaattgtatctgaggctaaatataatttactgcctaaaatttaaatatattaataaacttagtaccgtgccgaccccgcttttttttttttctatattattatatataatattatatataaatttt

SEQ ID NO: 633094 - DNA, 312 bp, Homo sapiens
  misc_feature (151)..(151): n is a, c, g, or t
  misc_feature (156)..(156): n is a, c, g, or t
caaactgaaatcttgagatcacacaggtggaaatatgtacataactgcacaaggtggttcaattctctggctctacagtgcagttttagtcagttttagtgcataggtttccatgtatttatagtctgtttatgctaaattctgggccaanacgcnatggagcatgtgtccaccactaaaatgcctctgcacttgaattctgtgctaattttgtggccagaaatgcggtgatcaaaacgctccatctttttacagtggcataggacagacgggcaaaaaaaattttttccccttaaaaaaggttgggccaat

SEQ ID NO: 633095 - DNA, 566 bp, Homo sapiens
tgggctcttgcaggaaacagttggtgggggtgggaggggaaccatttatttctactctccctatccaaagaagaggaggccaggggtgtgaagcttgcctctcgaaatgtggagagctacaccaggctggggaaccccacgcgctctgaggacctacgggattatgggccttccagagatgtgcctgcctatagtcaggatacttttaacgtacatgaggaaaacaacagccctttcctgaccatcaccagcatgcaccgagtcatggaagtctctcacgggggtcatatggctgtggcaacaaccggtggacttaccgcacacaggagctgtgctgaaggggcctttctcacgctatgcttaccagagacagccagatagggcaatatcctccatccgttctttaaagaacatccttccgggggctgcccaggatgctcatgcacgggatgagcatgggcaaggtttctaccagccacctccttatttggaatgactctgtagagatggcactccgggctcgcttccctctcttggggggggtgcagaccataacatggtgggct

SEQ ID NO: 633096 - DNA, 282 bp, Homo sapiens
catacaactcactatgagaaaacttcataccacatcagccgagcattacttatatgatatgtctccatagccatgacaatctccagcatacaccctcacacctaacaatacaagaaaattagccaggcatggtgtgtgggcacctgtagtcccggctatacgggagtttgaggcaggagactggcgtgaacccgggaggcagagcttgcagtgagccgagatcacaccactgcactccagcctgggcaacagagtgcgactctgtctcaaaaaaaacacaaa

SEQ ID NO: 633097 - DNA, 167 bp, Homo sapiens
cgcagctgtatccatttactggaactctggtgagacagccgaccgttgcgtgtaacaagagacatacatgaacgatggctacttgcacagggacttgtacactaacctcaccggatcgatgagcccttacgcaggcgttatgactgacgatgttcatgcgttgtggg

SEQ ID NO: 633098 - DNA, 118 bp, Homo sapiens
actgcgccggccacattcagttcttatctaagagatacccagacttaagtcttgaatgactacgattatgcccaattattaagtctgggttatttcttctgataagaactgaactttg

SEQ ID NO: 633099 - DNA, 109 bp, Homo sapiens
ctggggagcctggcgaggggcgacgccgacggccgagtttccccctttctagggtgaggatgggtcctacacaggcacccggagttacctaaggttgaaaaggtacgcc

SEQ ID NO: 633100 - DNA, 174 bp, Homo sapiens
gcaccactgtgcgctctggtggagcggaccatcccctcacttcacaggccatggcctcactttgtaacaaactcctaccacacgaccaataaaaacaacggtgggttttttttttttttttttttttttttttttttttttttttttttttttttttttttttttttttttttt

SEQ ID NO: 633101 - DNA, 88 bp, Homo sapiens
gattttcaccccacccttcccctccttttccctttttatatcccatttttatatcgatttcttattttacaataaaactttgctgcca

SEQ ID NO: 633102 - DNA, 419 bp, Homo sapiens
gtaacgtatctattgagttctagacgtgacgtgacagtcaatagacggtctgccctagtgtagtgtcctggtaatctgtactagaagcaattaccagactctggtcaggggaagccaagtagtgcttaaaggtctcccgtgagttaaggagacaaaacttggaattgggggaggttaatttttacataactaaattggtggggcagagtcattggaagaaggacgtgacatagacaaagaacactaaatatatgtcaccagcattttctttaaatggaaactatttcttgaaacaaatgatcaatggaaacacaatataccataacctgtgagcatactagcaaaaatataagggaaattttagctgtaagtacctacatcagaaaaagaagaaaaactccaaataaacatctaacatt

SEQ ID NO: 633103 - DNA, 554 bp, Homo sapiens
aagagcgacgacaggaagacgatgtggagctcggtacccatgctgttagtaaggagggtgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgttggacagtgggcaagcgaggtgttctgtccatatcctgacggccaggcggggactcgaaaagctaatgaaatcggccgcaaggaaaccgcgttgaacccgatcggagctgacactttcactttctgctccaaggaagcggggaagaccaccatgaaacaccgctcgggagggagggggagtcaagcgcaccaagaggaaaatttcctctgttcgcccgaaggcgggaccg

SEQ ID NO: 633104 - DNA, 186 bp, Homo sapiens
ttacgaatcgagccggtaccgtcccttgtttgggccagtttctcccatttcaaatgggtgtatttacccaatgcctgtacccccactgtatccaggatgtaactaactggctttttattttacaggctcataggcagaaggaacttgatgtttcagatgagacttgggacctggactttggattta

SEQ ID NO: 633105 - DNA, 1190 bp, Homo sapiens
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccaggtggaattcaagaagtcaggaagaggaacttccttggggcacactgaagaggaactcccctgcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgttggacagtgggcaagcgaggtgttctgtccatatcctgacggccaggcggggactcgaaaagctaatgaaatcggccgcaaggaaaccgcgttgaacccgatcggagctgacactttcactttctgctccaaggaagcggggaagaccaccatgaaacaccgctcgggagggagggggagtcaagcgcaccaagaggaaaatttcctctgttcgcccgaaggcgggaccg

SEQ ID NO: 633106 - DNA, 1441 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgttggacagtgggcaagcgaggtgttctgtccatatcctgacggccaggcggggactcgaaaagctaatgaaatcggccgcaaggaaaccgcgttgaacccgatcggagctgacactttcactttctgctccaaggaagcggggaagaccaccatgaaacaccgctcgggagggagggggagtcaagcgcaccaagaggaaaatttcctctgttcgcccgaaggcgggaccg

SEQ ID NO: 633107 - DNA, 1013 bp, Homo sapiens
ggcaaggtaggagaatggaggtggaggccgtctgtggtggcgcgtggtgatagtggacgcccatgacgtctgagccctgcccttggcttacagatatgggccccgtggaccggcagtggcacatacgaagctgcacgtgggttgaagacaatataggcctacgtaaatggtgaaatgaaatctgtggggtaagtgaaggacacgcgatgaagcatggtctaggaggtcgtatttggtgaggagtagtggagaattgtgctcgcaagcagtgcggatcattgacggggccactcgcaggagaccgtgcaagatcataagctattctagtagctttgtggcccggggcccttggctaggtggcgccgagccactcgaagatgattgccatgtataggaactctaattgcgttcaagattgatccagtgggcattgaactgtttgttggaggaatcaacaattatagatgttatgctgcaacaaaaagtcacgtcttccgcaaaggcctgacataagatcatcatttctggatgaagcagacagcatgacctgacggaaggcccaagcaagcctttgaggagaaccatggcaaatctactctaagaaccactcgcattcgccctttgcttgtaatgcttcggataagatcatcgagcccattcagtcccgatgtgcagcctccggtacacaaagctgaccgaagaccaaatcctcaccaggccttgatcactgtcatcgaacaaggagagggtaccctacacttgatgacgcgctagaaggccatcatcttcacggaccagggcagacttgcggcaggcgctgaacaactgcggtccaccttctcaaggattgggcttcatttaacagtgaagaacgttgttcaaggacttgtgaagagagcccgagcacgagtgatggtaaagggagatgatccaagactgtgtgaatgccaacattggaggagagctacaggattcttggtcacttgttgaatactggggtatcacaggaagaa

SEQ ID NO: 633108 - DNA, 262 bp, Homo sapiens
gaaccttcaaggatactctcagaaggagccaatggacactgagtgtagacatgtgaatgccaaaacctgagagtgctcctaataaaaagtaatcaatcttacagtgtatgagactattctatcatatatgggacaggttgtcagtatatcttaatgtttgggttgtctttgttttgttatggtagctacagcttggaaatgcaaactctgtatactctgtacacagggtatatatctgctacactggaggccgctggaggcc

SEQ ID NO: 633109 - DNA, 1577 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagtgagtgaaaccccggctgcagggcgcatgctccgccccagggattgtgggggttgtagttccacgcaggtggtggccagagtggtttgttgaggtgggggctgctgtttgggagtcttggccttctcttattcaggcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgttggacagtgggcaagcgaggtgttctgtccatatcctgacggccaggcggggactcgaaaagctaatgaaatcggccgcaaggaaaccgcgttgaacccgatcggagctgacactttcactttctgctccaaggaagcggggaagaccaccatgaaacaccgctcgggagggagggggagtcaagcgcaccaagaggaaaatttcctctgttcgcccgaaggcgggaccg

SEQ ID NO: 633110 - DNA, 594 bp, Homo sapiens
acgctcccgtgcacgtgctgactagcactgataggatgcacgcagtgagtgtgtacatggatccatccgaccaaaattctgccagacattgtagctctattccttgctgcataaactcggcactgcactcatcaggacttatggactcaatataacccgccagacataccgatagtacgcgaaggacatccaatcaattaaattgaactaaaggctcttattctcatagacactattggcaccatgtactcaccgtataaccaggatactgctttggatatagaataaacattagacctaacccttgatgactttaaggggaaatatttggagcttttcttctatcctttggatttcacctttgtgtgtcctacggaggccgctgcttccagtgacaaagctaacgaatttcacgatgagaactgcgacggtatcgcaggctcattggaccaccactctatacatcgggcctgaataaatacaccaggacagaatgttcacatgtgccacatgaacatcccactcttgtcacacttaaataagcttattaccagagcctactttgtgctgttagaagattctggaatagcctat

SEQ ID NO: 633111 - DNA, 123 bp, Homo sapiens
tgagtccagagtcgagacagcaggtacataaataaaattactgagtgtgccacacttgctgctatcggaggctaggtggaggatctgagcagtgagtatgatgtatcactgcacttcagccta

SEQ ID NO: 633112 - DNA, 215 bp, Homo sapiens
aactaacacatagtgtctgcgacgagacatactcacagcaactccactgctgttcagtgtgctacttcattgtatgtcttataagatgtatgaagattttcagatctatgggaatataataatgaatgaggccagccatgtttccgaatcgtgaatttgccatcatttttagccatctactgtccaactatcatgctaccgtgcacggttgaggt

SEQ ID NO: 633113 - DNA, 1345 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtggcctctgcatacctatgggaactcagtgatgtaatgcaaagaaaaataaacttactttctcctcttaaaagaaaaaaaaaaa

SEQ ID NO: 633114 - DNA, 440 bp, Homo sapiens
ggtcctctccagaaatgaaatctgctccaaagaaatctaaggccgatggtcagttagaggaagctgactagcccctggattcttctccagacccccctgcttcaggaacacccgtcctagggacccaccccgttccgcaaccaccgttgcgccagtcgatttcgcaccgttcaggccgtcgctgattccggtgtttcatctgctctctaccgcctttctcgtttctctcatgtatttatatagagataagtctacaagaaagcacattttacccaataagatgtttgcggacggataggcatgaaggctaggattagggaaaggaaaagaagagtagggagatgcagacttctcgtattcattccccattgaatgagaggaccattccatggggggaagaaggaattattggtgatgaggaggaaggaggtgttttgaag

SEQ ID NO: 633115 - DNA, 783 bp, Homo sapiens
  misc_feature (22)..(22): n is a, c, g, or t
  misc_feature (60)..(60): n is a, c, g, or t
  misc_feature (99)..(99): n is a, c, g, or t
  misc_feature (108)..(108): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (168)..(168): n is a, c, g, or t
  misc_feature (173)..(174): n is a, c, g, or t
  misc_feature (183)..(183): n is a, c, g, or t
  misc_feature (189)..(189): n is a, c, g, or t
  misc_feature (191)..(191): n is a, c, g, or t
  misc_feature (193)..(193): n is a, c, g, or t
  misc_feature (201)..(201): n is a, c, g, or t
  misc_feature (210)..(210): n is a, c, g, or t
  misc_feature (224)..(224): n is a, c, g, or t
  misc_feature (227)..(227): n is a, c, g, or t
  misc_feature (254)..(254): n is a, c, g, or t
  misc_feature (331)..(331): n is a, c, g, or t
  misc_feature (464)..(464): n is a, c, g, or t
  misc_feature (490)..(490): n is a, c, g, or t
  misc_feature (775)..(775): n is a, c, g, or t
cctgagggaaaaggtggcagangtccctgggttccggtgttcgcggaggagtcgaagcanggagaatcttcgtggtaggtgacggaaagaatggtggcncgccaggcnggcggggtccattggattngnggtgagngccgtccgcggcctcagctttcgcctcctccnagccnngtcggcgantgtccncngntgtgtatntcgagtagnagaatagtaggaangtnataggatgtgatgatagaatttgtganttccaagcaacaacttttcctaattcggcatgttaaaaaataagggtcactcatctaagaaatataacttgtcattnaatgcagttgctttacaagatcacattttacatgatcttcaacttcgaaatctttcagttgcagatcattctaagacacaagtacaaaagaaagagaacaaatctctaaaaagagatacaaaggcaataatanatactggacttaaaaaaactacacantgcccaaactagaagactcagaaaaagaatatgttcttgactcccaaaccgccgccgttgactttggcacagaagttgggcctcattgggcctccaccacctccactgtcatcagatgaatgggagaaggtgaacagcgctctctcctgcaaggggactccgtgcaaccatgccccatctgtaaagaagaattcgagcttcgtcctcaggtgtttagcatacgagggtgagctagagagctcctgggctgtttcctagggacgaggcccagagctggagcctaanattccaag

SEQ ID NO: 633116 - DNA, 1503 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagtgagtgaaaccccggctgcagggcgcatgctccgccccagggattgtgggggttgtagttccacgcaggtggtggccagagtggtttgttgaggtgggggctgctgtttgggagtcttggccttctcttattcaggcatgaagcaggagctgcagaacctgcgcgatgagatcaaacagctggggagggagatccgcctgcagctgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtggcctctgcatacctatgggaactcagtgatgtaatgcaaagaaaaataaacttactttctcctcttaaaagaaaaaaaaaaa

SEQ ID NO: 633117 - DNA, 1367 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtggcctctgcatacctatgggaactcagtgatgtaatgcaaagaaaaataaacttactttctcctcttaaaagaaaaaaaaaaa

SEQ ID NO: 633118 - DNA, 824 bp, Homo sapiens
agggcgcatgtccaccgtctaggagccttccggttactgcgcgagtgcgcgactcgtcccgaagcctggggatacaccctctcgagagcccgctgtctgccctccgttaaggtcgaatccctcacagattgctgtgagtgcaactccagtcccaatattccctacgctctgtgttctcgccccagatgggcaaactcggccccagggcttcccactgtatttctggatgaggtgtcccctatgctccccactaagaatgtcacagtaacctacggagggtcttcctgcaacccgcagaggacaaattcaggcaatcgccttctgcgttggcatgcaatgtaccaagtagtacagacgatatggctcgtgatggaagaaacatcttgtgcaagctacttgcaattcctaatgtcttctggcacaatctttataccactagtccaagtcgtctcagccatagtcttgaatgcttcgacaagggaagtccaggaaagaccccggttcaacgtacagtatcccaagcactcaaagatttacacatgcatcttccacgaaaggtgctctccacgtggccgacttggcccgcagtgtatgacaaggtcccatgcctaccatcgtttcagatcctactttatctctgcacaagacagcagctaaggactcacctcgagcacaaccgggtagagttcacggtcctgctggggacctgggaacactttgtcatcacgtgccaggttactaggggttgacgacatcaatggtgtgcacacttgctgcgactccccaacgccgaacaattgctgagcgcccctcgagagcaagcg

SEQ ID NO: 633119 - DNA, 1393 bp, Homo sapiens
  misc_feature (428)..(428): n is a, c, g, or t
gtggtcggcgcgcccctccccacctcgcgggggccgtgtgggcgtcgctcggtcgttggggtgccggggacgtcgtgatgagaacggcgtcccagagacgacggcgacagagccgggacacgtgacagtcacagggtcacattctgcggtccacgagtttgggaccgggctggtcacgtgacgcggtgggggcaccatggggtgatgtgagatgcgtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggagnggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccattcaatgcagtccgaataccgggagaagaacgtggagcggattcggaggcagctgaagatcaccaatgctgggatggtgtctgatgaggagttggagcagatgttggacagtgggcaagcgaggtgttctgtccatatcctgacggccaggcggggactcgaaaagctaatgaaatcggccgcaaggaaaccgcgttgaacccgatcggagctgacactttcactttctgctccaaggaagcggggaagaccaccatgaaacaccgctcgggagggagggggagtcaagcgcaccaagaggaaaatttcctctgttcgcccgaaggcgggaccg

SEQ ID NO: 633120 - DNA, 238 bp, Homo sapiens
cagtttacacaaggcttctggaacagaggcatgcagcttgtatatctatctatccatctatctatctatctatctatctatctatctatctatctatctaaactccataggagtacctagaggagtgcctaataaatttaaagcacgaaaccaaatacctgctagatttgagtcagcacttttctggtggtcaactattaacaagaatactaattagattagtttgtgtaaactgatt

SEQ ID NO: 633121 - DNA, 356 bp, Homo sapiens
gagatagtaaatcttttataaactaagattgtaccttttaatatgtagtaaacactcatttatttggggttcactcattggatctcatgcatccattgtgttctctttaatgctgcctgacttttagaggcattcactgccctagacaaatgccaccagagatagtgagggaaatgccagatgaaaccaactcttgctctcactagttgtcagcttctctggataagtgaccacagaagcaggagtcctcctgcttgggcatcattgaggccagttccttctctttaaatcagatttgtaatggctcccaaattccatcacatcacatttaaattgcagacagtgttatgcacatc

SEQ ID NO: 633122 - DNA, 277 bp, Homo sapiens
  misc_feature (127)..(127): n is a, c, g, or t
aactgggggcccccaagtgggaaaaaggtaggtttttccctgccagttatcccccggggagactgtcaagttgggaagggggaatcaaaaactgggttttgttttaaaaattaaattaacccctganaagaggggcttttttttttttgggggttggcccttgcccccaagtttgagcccctcccccttttgggggccctgtttcccccccgggccggttccttcccatgcctaacgggggaggggcttaaaagggaaaaaattgctttttcccata

SEQ ID NO: 633123 - DNA, 148 bp, Homo sapiens
gcactggtcattctgtgtcaatcggcatcattccactcagctccgcacagctgtgggcctgagcagaccatctcagcctagcaccgtggaagggatctccttctggcctcctaatcctgggagcagacatcaccatcagcacccaccg

SEQ ID NO: 633124 - DNA, 783 bp, Homo sapiens
  misc_feature (330)..(330): n is a, c, g, or t
  misc_feature (620)..(620): n is a, c, g, or t
aagcagtggtatcaacgcagagtggccattatggcggggggggttaccaataaaaaaaaaaaaaaaaaaaaaaaaaaaaatttttgggcggctggccttgaaaaaagttttaaaaccttcgttggggcgcggggccccatgaggacatgggcataacgtggtcccaaggaagaaccttgggcacatgagctaaggtgcggtgggagtcttctcaccccaaataaaaaacaacggccgggcgggcaaccacagaggagctgtctctcgacaaacacaaccacaacagtggagctgtcgcggcagcaggcaccaagatactgagaggatgtntcacacagcaaggagagtcgccaacagcgggaccgactccagtaatattcaaaaaataataccgccccccggcgtcgtgagtaacagatcagcgtcagctaggcaagagactagagacaaaagagaacagacgatacgagaacaacatgacgaagaacagataggagcgagaagcagaaccagagaggaagatacagatagcagagaatagaagcagagacacgtagtgagacagaagacaaacatacagagaacaaagagacacgacaatatgacagagaaccacaganacgacgcaagacacaaggagagacacgaagaatagtgcacagacagacacacatagacgatagataagatcgacacgcaggcaagtcgacagcagaatcattgacgcagatatagacgcgaagcaagagagcgacaacatcaagagactcagataaacaacga

SEQ ID NO: 633125 - DNA, 669 bp, Homo sapiens
caacaaggaaatctggtcatctctgtgacacacagtttaacagaacagttataattattactcataacatatactgagacgtatcagaattcataggagtcttacacaattttgtaacacatactaataacatagttatacgactataaacccaacagaaagttaaacacttttttatatttgacagtgcttcctacataattttaatacaccaaataagccaaatatgcctctttggactttaggggactttatttttctaaactgagaattggatctggggaagtctgtaaatatcaacaggtttgaaccagtagatatccacaaagtagaatcccaggtcaccataagtcattcatttagccacactgatacactcaaacatttggtcacacggcaaaaactttactctgcattagagcagcacgactccggcgtttctacaacaacgaaaaacccgcaggtgcagagcatcggcattgagggccccaccgtgaaaatctagtcctataagatttgtgtcgtgcaactcagttataactccgacaaggccgcagtgaacaacatctgtcgagtggtgctcctctcgtggtgaagatcttacccttgacccataatgccttcaaaagcagacaacccaaattttaattcatcgactttagtgccata

SEQ ID NO: 633126 - DNA, 622 bp, Homo sapiens
  misc_feature (9)..(9): n is a, c, g, or t
  misc_feature (141)..(141): n is a, c, g, or t
  misc_feature (150)..(150): n is a, c, g, or t
  misc_feature (213)..(213): n is a, c, g, or t
  misc_feature (226)..(227): n is a, c, g, or t
  misc_feature (242)..(242): n is a, c, g, or t
  misc_feature (244)..(244): n is a, c, g, or t
  misc_feature (263)..(263): n is a, c, g, or t
  misc_feature (268)..(268): n is a, c, g, or t
  misc_feature (279)..(279): n is a, c, g, or t
  misc_feature (282)..(282): n is a, c, g, or t
  misc_feature (286)..(288): n is a, c, g, or t
  misc_feature (317)..(317): n is a, c, g, or t
  misc_feature (329)..(329): n is a, c, g, or t
  misc_feature (358)..(358): n is a, c, g, or t
  misc_feature (371)..(371): n is a, c, g, or t
  misc_feature (380)..(380): n is a, c, g, or t
  misc_feature (393)..(393): n is a, c, g, or t
  misc_feature (416)..(416): n is a, c, g, or t
  misc_feature (433)..(433): n is a, c, g, or t
  misc_feature (450)..(450): n is a, c, g, or t
  misc_feature (454)..(454): n is a, c, g, or t
  misc_feature (458)..(460): n is a, c, g, or t
  misc_feature (464)..(464): n is a, c, g, or t
  misc_feature (469)..(469): n is a, c, g, or t
  misc_feature (473)..(473): n is a, c, g, or t
  misc_feature (483)..(483): n is a, c, g, or t
  misc_feature (501)..(501): n is a, c, g, or t
  misc_feature (503)..(503): n is a, c, g, or t
  misc_feature (524)..(525): n is a, c, g, or t
  misc_feature (527)..(527): n is a, c, g, or t
  misc_feature (533)..(533): n is a, c, g, or t
  misc_feature (541)..(541): n is a, c, g, or t
  misc_feature (590)..(590): n is a, c, g, or t
gttgtagtnatgatggagcaggttaggggaccaaaatacacaaccgtcataaagatgaagctctgacccagggcactggtcagcccaaagagcaggatgttatagatgatggcagggtacctttcagcaaagctcaagaantcccagagntccccagtgaacaggattcccattcccagcagcaatgtcgaccaaaggttgatgttcagcatnatgtggttggagnntgtttggtaatgagntnggatgtggtgttgggaaanattantgagtccatcncgngtgnnnccttcctggtatgagtagttgtttatagntgattgtgtgtncttctatcccaacaactttcttgggtttntacatcacaaccnccactccanccacaattaacancacacacaggtacttggccaacnggtacttcttcttcaanagggtcaccccaaccancatnactnnnattngcttncagnatttacaagnacctgagttgggtagttnanaactgtagtgctgaattgctnnanaccatngcacccanataggagatagaacaggcagcatagagccagctccgggtacgatacacnctggcagtgtcaaaaaactggatcaagatctt

SEQ ID NO: 633127 - DNA, 110 bp, Homo sapiens
agtggctgaaaacaagactagtttattttctgacagtcctggaagtcagcaatctgaaatggctcattgacaaggggttggcaagaccgcatcccttctgtcgtcttctc

SEQ ID NO: 633128 - DNA, 396 bp, Homo sapiens
agttacaacagcttccagttacaacagcttccagttacaacagctccagttacaacagctacttcttacctaccagttcctcagtggaaggcttacctctttgtcagttgtggtggtcatggcttttccccctggagtccttacagtaacaacccccagaaggcagaatcctgctctggtgttatacgtcttttctcttccccaccacaccacccccagcatagggcattttcctgtaaagggtcttgagtctttctgggaagtagctggggaatgagagtataaaataatgctgagggtcatgttcaggcagcatggcttagagattagattacagacattgaaaccacatatcctagacttaaattccgggtgctatttgctaacaatgaatcc

SEQ ID NO: 633129 - DNA, 180 bp, Homo sapiens
tggtgtgtgtgtgtgtgtgttggggggttgcgtctgtgtgtgtgtctgtgtgtgtgcgcgcgcagtgcgtgtctgtgtgccgacttctgtctctctctcaggtctctctctgtctctctctctctctctctcaactctcacacttctcgcatgtaacctgacagccctctctgtctgtct

SEQ ID NO: 633130 - DNA, 164 bp, Homo sapiens
ctgctctgagctaaggcataaggaatgtacacaacaggagaactaaggacaaaatgagccagtctcatgaagacagtttgacaagtagtggcttggaatccagataggaagcgctttgagactggaggtcagcgtaggcagtatctatcagagtgagttaaata

SEQ ID NO: 633131 - DNA, 204 bp, Homo sapiens
aaccttttaaaaggttaaaaaaatttattagaccaacggaataggttaaggatataaagaaaatgatttttgtacagatgtataatttgtattttaagctaagtattattacaagtcaaaaagtttttaaaaatgtaaaagtttataaagcaaaaaagttacagtaagtaaatatattgttgaagaaataaaaaatttaaaaat

SEQ ID NO: 633132 - DNA, 311 bp, Homo sapiens
  misc_feature (46)..(46): n is a, c, g, or t
  misc_feature (59)..(59): n is a, c, g, or t
  misc_feature (62)..(62): n is a, c, g, or t
  misc_feature (76)..(76): n is a, c, g, or t
  misc_feature (94)..(94): n is a, c, g, or t
  misc_feature (109)..(109): n is a, c, g, or t
  misc_feature (154)..(154): n is a, c, g, or t
  misc_feature (164)..(164): n is a, c, g, or t
  misc_feature (167)..(167): n is a, c, g, or t
  misc_feature (171)..(171): n is a, c, g, or t
  misc_feature (196)..(196): n is a, c, g, or t
  misc_feature (234)..(234): n is a, c, g, or t
  misc_feature (251)..(251): n is a, c, g, or t
  misc_feature (267)..(267): n is a, c, g, or t
  misc_feature (277)..(277): n is a, c, g, or t
  misc_feature (285)..(285): n is a, c, g, or t
  misc_feature (290)..(290): n is a, c, g, or t
  misc_feature (293)..(293): n is a, c, g, or t
gtttttccctccccccccccccataggaacaggatttggccttagnttttgggcctatnggntgccttccctttanttcctacccccttttttnccttcctttgagctntgttgggcttggggattttagtttttttttgtttatttcccagcncatttttttnttntggncagtttttttaagggggggggttgnggttttttgtttttgttttgcttttgaaaaagcatttnccttttttcctttcccnacataacaattgtggnaacaaaatgngactgctnatttnccnatgtttttaatgtaagta

SEQ ID NO: 633133 - DNA, 400 bp, Homo sapiens
  misc_feature (88)..(88): n is a, c, g, or t
  misc_feature (382)..(382): n is a, c, g, or t
gtggtggatgcgtcgggctccggcgaagccgcccggcttgaggatgacgcgcgtggtgtggaggcactcgcggggggggtaattcggngtctgttcttctgcttgccgcacagctttccccgatgctccactgtgtgacctaggcacagctgtccatttcctgtgaccatctcattgacaaggacatcgtctccaagtctgccccactctatgtcctaatcacaggatgtgggagggggcagctggtctgagcttggccggtctgaacgggtgtggaactgctcaagccctgagttctccaagactctacagcttgagtaccgctgtgaaacagacagaagctacgctgtggtatctttaacataaacaacaagacgccagnggtgagggatgattattt

SEQ ID NO: 633134 - DNA, 759 bp, Homo sapiens
  misc_feature (27)..(27): n is a, c, g, or t
  misc_feature (42)..(42): n is a, c, g, or t
  misc_feature (333)..(333): n is a, c, g, or t
  misc_feature (339)..(339): n is a, c, g, or t
  misc_feature (350)..(350): n is a, c, g, or t
  misc_feature (357)..(358): n is a, c, g, or t
  misc_feature (376)..(376): n is a, c, g, or t
  misc_feature (412)..(412): n is a, c, g, or t
  misc_feature (424)..(425): n is a, c, g, or t
  misc_feature (428)..(429): n is a, c, g, or t
  misc_feature (431)..(431): n is a, c, g, or t
  misc_feature (585)..(585): n is a, c, g, or t
  misc_feature (700)..(700): n is a, c, g, or t
catcagcacctgtccaaggagtcaatngcaggaaacaagccngccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtccccgcctctcccctggggccctgagacncccccncctcccttctncccatcnnccatgttgtaaaggaacncccccagtgcactgggggaggggagggagtgagggncagtggtgcccnnccnncngaagagacatgcagcagtagcgctggccccatctgcaggagctggcgggctggccttctggaccctggcttctccccactgtaacgcctgttacacacaaactgttgtgggttcctgccaggcttgaagaaaatgatctgaattttttcctccntttggttttattttgttggtttattttgtgttttcttttctcccttttggggggtattcagagtgggctgggcccctgggcgagacacagctacctctgttggcatctttttaanaccaggaacccagcggctctagccactgagcggctaaatgaaataaagtggaaaaaaaa

SEQ ID NO: 633135 - DNA, 179 bp, Homo sapiens
  misc_feature (34)..(34): n is a, c, g, or t
ggctttagagcctcccatcccattcaagcatcancagatatttgttaatagcccattttgtggccgggtgtggtggctcacacctgtaatcccagctactcagcagggtgaggtgagaggatcacttgaggccaagagtttcagaccagcctgggcaacatagccagacctcgtctcta

SEQ ID NO: 633136 - DNA, 2296 bp, Homo sapiens
aaaaaaaaaaaaaaaattaacccagagtgggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgaaaacaagaaaaaaacgcacagcaaaagcgcctagggggcactcaaactagaacagggttccagcggagacacacgacggcgcaccgaacgattgcggacacagtgggacaataggcgtgagtaacacagagaccaccacgtattcgctcggcaccaaagcgggggacaagacatcgcgccgggtacccccgaaaaataggagagcccacattaacagttcacgcgacagaagcccagtattaagccgggattaatg

SEQ ID NO: 633137 - DNA, 657 bp, Homo sapiens
  misc_feature (46)..(46): n is a, c, g, or t
ggtgcaatcttggctcactgcagcctcccacttcccctggttcaantgattctcctgcctcagcctcccgagtagctggttcccacaggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgaaaacaagaaaaaaacgcacagcaaaagcgcctagggggcactcaaactagaacagggttccagcggagacacacgacggcgcaccgaacgattgcggacacagtgggacaataggcgtgagtaacacagagaccaccacgtattcgctcggcaccaaagcgggggacaagacatcgcgccgggtacccccgaaaaataggagagcccacattaacagttcacgcgacagaagcccagtattaagccgggattaatg

SEQ ID NO: 633138 - DNA, 431 bp, Homo sapiens
aaaaaaaaaaaaaaaattaacccagagtgggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggtgagcctgggctgctcggacggtaccggggcctcagaccgggcccaactctagacacttccacagagaagcaagcgaggaacgccacagccccttcgctgctcacagccgtcgatcc

SEQ ID NO: 633139 - DNA, 604 bp, Homo sapiens
actgataaattaatagcttactaatataagtagaaataggtctattattactatgctaccgtactaaggagatcgataaggagagaatatattatccaagaaactcacccatttcatacaggtttacttttgagtatgtatacgggataagtggtatgcagctagcattcacggtttacaaagatacttgcatagagttggtagagtaacaatgataatatattttctctaattctaggtttgtttcttccttgtcatttcttatcttgtaaggttaatccttgtatgaattttctatagcagtggcttattcttagtagcttaaccaatacgcatttattatctcacatttccttaggtcagaagtctaaccaggtgttcgcaggatatagtcacagcgttggcggggctgtgtacctttctggaggctctaggacagtatctatccttgccttttctagtttctaaaggccgtctgtgtaccctggcttatggccttctgttttacatcttcaagccagccatgtcaagtcagatcctcacatcaaatctctctaaactcagccaggaaagatcccgtaatttcagggctcacgtgattaga

SEQ ID NO: 633140 - DNA, 2193 bp, Homo sapiens
aaaaaaaaaaaaaaaattaacccagagtgggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgaaaacaagaaaaaaacgcacagcaaaagcgcctagggggcactcaaactagaacagggttccagcggagacacacgacggcgcaccgaacgattgcggacacagtgggacaataggcgtgagtaacacagagaccaccacgtattcgctcggcaccaaagcgggggacaagacatcgcgccgggtacccccgaaaaataggagagcccacattaacagttcacgcgacagaagcccagtattaagccgggattaatg

SEQ ID NO: 633141 - DNA, 2114 bp, Homo sapiens
aaaaaaaaaaaaaaaattaacccagagtgggtcaggacagacaattcctcagtgacccaggagctgacacactatggcgcacgtccgaggcttgcagctgcctggctgcctggccctggctgccctgtgtagccttgtgcacagccagcatgtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggatgtgttctgggccaagtacacagcttgtgagacagcgaggacgcctcgagataagcttgctgcatgtctggaaggtaactgtgctgagggtctgggtacgaactaccgagggcatgtgaacatcacccggtcaggcattgagtgccagctatggaggagtcgctacccacataagcctgaaatcaactccactacccatcctggggccgacctacaggagaatttctgccgcaaccccgacagcagcaccacgggaccctggtgctacactacagaccccaccgtgaggaggcaggaatgcagcatccctgtctgtggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtgaggaggccgtggaggaggagacaggagatgggctggatgaggactcagacagggccatcgaagggcgtaccgccaccagtgagtaccagactttcttcaatccgaggacctttggctcgggagaggcagactgtgggctgcgacctctgttcgagaagaagtcgctggaggacaaaaccgaaagagagctcctggaatcctacatcgacgggcgcattgtggagggctcggatgcagagatcggcatgtcaccttggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccaggttacaagcctgatgaagggaaacgaggggatgcctgtgaaggtgacagtgggggaccctttgtcatgaagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgaaaacaagaaaaaaacgcacagcaaaagcgcctagggggcactcaaactagaacagggttccagcggagacacacgacggcgcaccgaacgattgcggacacagtgggacaataggcgtgagtaacacagagaccaccacgtattcgctcggcaccaaagcgggggacaagacatcgcgccgggtacccccgaaaaataggagagcccacattaacagttcacgcgacagaagcccagtattaagccgggattaatg

SEQ ID NO: 633142 - DNA, 950 bp, Homo sapiens
  misc_feature (1)..(1): n is a, c, g, or t
nagccctcgtttttccctgataaaaaaaagaacctgtctccctttgtcctttcccttatttacaagccccccccccttcttccccctcggtgacaaaacaccccgccacctgttaaccccttttaggcaaaaactttcgcatagcctctcttcttaaattaaaagacccgacgaacaacttcctttgtctcaccccctgtatcttagacgagcatcggtatggttcctctcccaccaccgcaccttactcctggtttaaaggggatggactatatccccccacaaagagtaaaatcctttgctagggttcctcacacgctcgctcccgcgaccaccctcgtgaatatctctgcaccacagaggagaatcttttttatatttccgcataaccccgtttattgttcacccccacgcgacaacacggttctccctcttaacattcagctgggggacgcgacgttttatgtctgtttcaggttttatatgatagagcgctggagttcagaccaaatactgttgtggctcgatgagagacaactcattgtgggtaaaaggtgataccaccccccttggtcttgaaggcgccccccccggggaggtcctccgccccctgttccatagaaaagttgaaatcctcgcgggttcttcttttaaaaaagattttgtaattaccccccctatagacatgatacatggtgtaatccattcctaccgctcaaaacaataatcacttgcataattgagaaaacgcgagtaatacattttggtcataaacaactcttcgtgattccccttttataaggcgcgacacaaaaatgccacttggttcttatagagctccctcgcataaagagttcaataaggtagccccttcttaaaaattctattaaaatctaaaaccgcctctcaaaacaaaggttttttataagttcgcccccacaaagacacag

SEQ ID NO: 633143 - DNA, 100 bp, Homo sapiens
  misc_feature (100)..(100): n is a, c, g, or t
ccctagttagaagttcaatagcacacagactaagaggacccaggtagtaaaggagcaggctgccatcctatggggatcttccaccgtggggactccccan

SEQ ID NO: 633144 - DNA, 1466 bp, Homo sapiens
gtgattgaccactgtgtgcctgagctgaacctctgtcagccatgaggccaagtgcatccccctggacaaaggattcagctgcgagtgtgtccctggctacagcgcggaagctctgtgcagacagacaatgatgactgtgtggcccacaagctgcccgccacgcgggacccatgtgcgtggcacacaactcaactgcgcctacacatgcaccctgcccccacagggccatccagctgcgaccgccttcctgatgcacacaccccccgaatcccactggctccctacctgacagcacccacgccccactgccgcacccagcctaccgacgcatgcccagccacaccggggacccacaagcctgccactccgcctgcgctgccacaccccaggcaagctaccccacacacactgcccaggcccctgacagccccaccccagtgcactcacggccccccgcccaacccccacccactgcaccgcacaaccagcccctccacctcgcacactcggatccaaaacacacacaccccactgcgacgccaacaaccgcaacaatcaccaatcaccggatggcgaacaaacataggcagcacaattccacggacccgaccacgcggactcccccagacaaccacccacctaacgggcaagcaaaacaccaacatacgtcacccaccctaaggaacacagcaggtccgcgccacccgcaacacagggacacgccaacacacggcaaccccacacccccgcggcccctcaccttcccccacctaacaccctaccatcaacccccctaccgcagccggaacggcacccgcgaacctgggcaaacacacaccacgcaccatgcagaggcaccaaacccccatgcccgcccaagcccgccttgggccctacagacgcccccatgcagcaggaccccacgcggcaacaaccacacttgggcccgagaagtccccttggagggcaaaccagtattaagatctcgacaaaacccctaggacccacccacgctgtggcccaacgccactcatccccccgccaccacaactactgccccaaaaaacaccccccagaaccccggccaacaggcgcgcaccaccaaacaccaggcgaccaggcgatccccgggcgcacaaggcaaaaacccaaacggcgccctaggcgaaaacccttgcgagacaccactcggcctgcagacacaccacagggcgatcagtacacatcccacaccgatacgcagccacacggggccatacggcgccccacaagcgcccccccatacgggggacatttgaggacacgcggcccacaccatttgccaacacgaaatgccccccgcgacaaggcaacaagcgcgagccacgatgttgggccaacacaaacgctccgaccactaaaacgagccaactatatacacccgcactcgggggaggcagaccaccgcaccaccatcaccaagctgg

SEQ ID NO: 633145 - DNA, 1713 bp, Homo sapiens
gcccaggtagaggggtcctgcgctggcggcggcggcggcgctgttccccgcgcggtccgcgagagcggggggatccggtgcttgcgcagacgatggggcggcggcggcacttgctggacccacggcacaagcccagaccccaggtgatccgcacatacactcgaacagaaaaaacaagaaaagaaagaaaaaaaaagagaaaaaaaaggctacccacgggagcaggagcgcaagcggagaaggcaagagaggagagtagcgggaggcacgagaacggaaagaaggagggaggacgagaaagaccggagacggaggaaacagacgagcgaagcagacgagacggacgacgaagacaggggagcagggacagcaaggagacggagggagacagagagcacgacggcgacagcgcgagcgcagcgcacgaggcgcaggagtcgagagagaggacggagagggaaccgagaggagagagaagcagagaaagaaaggaaggggaggcgaagaagaagagccagagaggcggcagcgacaggcacagagaacggcgggcagagcgagaaggggagaagagaggagacggagagggaaggcacgagagagagcgagaacagaggagaggaggggaggcgaggcggaggcagagaaggcgagaggaaaaagggagaaaaggagagcgcgagggcagaggggaagggagcggagacggcggggagcacgagaggacgacggagggcgggggcgagaagggcgggaagggcgggaggagcgggagaggagggaaggggaagcggggaccagggacgacgagcggaagacgcaggggggggcgaagagggaaggaggggagcgaggagagaccaggagaaacacagacgcgaagggaaggggagggagccgagagcagggcgcaggagggaacaaaaggagagagaaggcagaagaacgaagcgggaaggaggcgaggcagagagaagggaaacgaagagcacacgagcgcaaagagcgagggacagagcgagacagcaaaggagggagggggaagcagaaggagggacagaggacgacgggggagaaagaaaagagaagcgaaaggggaagagaaacccgggcgcgcgcagcgaagagcgacgagggagagaagagaaagcggagggaagaaggacaaggaggaggaagagaggagagagagagaagaggggacgcgacaggcgggagagggagagggagcgagaaggggggagagggagaaagcggcgcgagagagagaaggagcagacgaggaagcgcgcgagagagacgaggggatggggcgacgaaggggaagcgcaggggagcaagggcccgagcgaagagagcgcgagagaagggaggcagaggggaggagggacgcgaggaagaggaaggcgacggaagcgggccccggcagacgccaagagcgaggagaagaagacacggcggacgacagcgagcccccgccacacgagcatgacgaggaggaagcaaggcagagcgagcgaagagtgcacagagcgaggcgatcaggcgagacaacagaaggagacgagaagagaagcagagtgaggcagcgggaagcggaggaagtcgccagaacagctacagaggaagacgaacagcaggcagaacgcgagggcagacgacgagacgggaggcggacgaggcggtcttgagaccaggagtggacggagggaa

SEQ ID NO: 633146 - DNA, 373 bp, Homo sapiens
attaatcatgtatttattttagttcagttaaaacaaacatacattggttcattgaaaccggtgtagcatttactctctgccaacaggccacagaggcatgttggcctctaacagtacagctgggacatttacactatatacatacaaggagtcctctttcattgagatcacacttgacatgttaccagatagccatgtggtagctactgcattttgaaaatttagacctcatttaaagctttagattatctgaacttaagttgatgtccaaccaggttattgcaaatacaatttaaacaagttattttcaattttaggattattcacaaggccaattttcttaaaattgaattctctgtacaaggaaattgga

SEQ ID NO: 633147 - DNA, 276 bp, Homo sapiens
  misc_feature (26)..(26): n is a, c, g, or t
  misc_feature (90)..(90): n is a, c, g, or t
  misc_feature (104)..(107): n is a, c, g, or t
  misc_feature (110)..(110): n is a, c, g, or t
  misc_feature (113)..(113): n is a, c, g, or t
  misc_feature (158)..(158): n is a, c, g, or t
  misc_feature (169)..(169): n is a, c, g, or t
  misc_feature (181)..(181): n is a, c, g, or t
  misc_feature (184)..(184): n is a, c, g, or t
  misc_feature (186)..(186): n is a, c, g, or t
agtacaaaacccgagcgcgacaaaanagacacaaacgttgggttctgttgttctttcacggtgttgcccaacgtcgcattattcgtactnttattatccgcccnnnnttnttngcacggtatgccataattatccagtaggtcaccacgtcatgcatncgtttgtacanacccgtgcgganaananaaaaacccaaaactgaacagggggttggccttggcatgcagggaaaagaccagggagggcggaagtacaaaaggattaaagaattaaaaa

SEQ ID NO: 633148 - DNA, 237 bp, Homo sapiens
aattcttccacctcagaatcccaagtagctgggactacagacgtaagccaccacacccggctaattaagtacttttttagagacaggtattgccatgttgtctacactggtctcaacctcctgaactcatgcgatctccctgtctcagcctcccaaagtgctgcgataacaggcgtgagccaccgcacctgccttacacattgttcttgagtgagccatatgccgtactactgcagt

SEQ ID NO: 633149 - DNA, 393 bp, Homo sapiens
ttaaaactcatagctcattgttattcacaggatgcctctggttgtaaggaaatgctcttaagtcatgcgagtatcaccagtatgtactagccagcagtgtgaaccccaagcagagtactgagaccttccctaaggcagtcctgggccatcacatttaacagctgtgtgtgcttacgtctctgagaactgtacgcacatttaaccctaccgtgtcgcatgtgcacagtagtgccctggcatttcacaggacagcgctcaaattctcagaaccgtgttaccgcataacagaaatgagaacccagtttaacaataaagagaaaccaatcagcagtaaagtaagacaccaattccaagaactgtgatcccaaatacaagaaaactcgaactagtttc

SEQ ID NO: 633150 - DNA, 101 bp, Homo sapiens
cactgtctacacttatactattagcaggtacagaattaaaaagcttattacccccagctagtgatcaagatgtattaacaagaatatgaaagagcatctgg

SEQ ID NO: 633151 - DNA, 509 bp, Homo sapiens
agagtgctatcaacgcagagtgcccattacggccgggcgcggtggctcacgcctgtaatcccagctctcagggaggctaagaggcgggaggatagcttgagcccaggagttcgagacctgcctgggcaatatagcgagaccccgttctccagaaaaaaaaaaaaaaaaaaaaaaaaaaaaaaagggggggggggcccggaaaagcgtttaaaaccaatcgcgttggggcggcgggggccccaggtggggaacagtgtgagaccatgtgggccaaaagcgcggtggaccaaagggagaacccggggccaaggaaaaggggcgggggagttcctccacaattaaaaaagcgccagggggacaaacgaggagtgggtttttggaaacaaattctccaagagagggagagtttgcgagaagggcaaaataaggggggatatttatttaaaacgagggagttcacaaggcgaaggcgagaaattattaaattttagcccggacggtgggggggt

SEQ ID NO: 633152 - DNA, 104 bp, Homo sapiens
  misc_feature (90)..(90): n is a, c, g, or t
aaatgcaaaactcaccgtgcacactcctagatccctgccacaaagaaatctttgaaaaatgaagtcttcctttcggacaatataccattngagtttctctattt

SEQ ID NO: 633153 - DNA, 381 bp, Homo sapiens
ctttgcaattttaggaaaaagaaaaacaaaaaaaaaaaaaaaggaaaaatataaaaaaaaaaaaaaaaaaaacaaaaaaacaaccaaaaaaaaaaaaaaagaaaaaaaacaaaaaaaaaaaaaccttgtggcccccttggccccactggtttttggactggggcaggtttagccttgcggcccaatttggggttacttgggcaatttgcccttatggggggcggctttccatttaacgggccgtggtttaacacgtgtggatcgggggttggcgaattggcaaagggccccgaccgggtggcctttccaactggttgcccagccggaaggcctatgggaattggcaggccttattatttgtgtaaattcggcgtccaattt

SEQ ID NO: 633154 - DNA, 935 bp, Homo sapiens
agcggggggtgctaagagaccctagcggtgtcaggcgttcggagagcgcggggtgcgctgatatgttagcgctcctggctctcccggggcggggcgccagatgggacgccgcattcccggtgatgtagattggtgtaggtgcaaggcggaagcagagcggcggtcggggttcccgctcttggcgagcggatggtcactcccccggaggggagggcgatgcgaccagatatacctggggccgaggaaaccgtggggctcgggtgcagggactcacctgttgcacccacactcattcggggtttggacatttgccggcgtctagcgacgacgggactgtcgacttatgggggccatgaccatgatataatatggatgagttacaatcgattgcctcatataatattgactgctttgacagtccttgggatttgacgagactaaacatgcctggtgtcatgcctagtgagacagtcatggattttcaggaggtagcctgtcaaagaaaaacggaactttccttagaggttggttcagatgagagggaagcttagagagagcttggatttcacagatgctcaagaaaatgaagaaaaagcttctgagtatagagcatctgacattgctcaagttggtccctgcaggacagtcttgatcctattaaactgtgacgaagagagaaagctgggttcccccttgtggggactgactgtatctcgggacacttgctatcttaaaagcgtacctccggcatacacatttggcccgcgtaaagctggggacagagcatttaatattccgaaaaagagtctaaggggatgcccccgagcaggggtggcacaatcttgggataatagtgggcttccgtaatttctggtaagccagcggatcttaaaaaatatatcccccgccggaccggacacataatatcacacaaa

SEQ ID NO: 633155 - DNA, 204 bp, Homo sapiens
gtcagcagacctctcacctcagctcccaagtagctgagatcacagatgcttgccaccacacctggccatttttttcttttttgtatttgtggtagagatggggtttcactatgttgcccaagctggtcttgaactcctgagctcaggtgatccacttgccttagcctcccaaagtgctgggattacaggcttgagccaccgcat

SEQ ID NO: 633156 - DNA, 308 bp, Homo sapiens
aagagggctcgagtagcagatgcctctgagattgtatcttatagttgcataacatctggtggaaggtcacaactgaggtacaacgacttgtgtgactggtactgtagcaatgagggctttcccaggccacaacatctgggatcaaggcaacacatttggactaaataacactatcacagaaagtctgtaacaggcatgtcatgcaaatatcaacctcattttaaaacatgaggaaaactcattacccacattcagggctcaatttagctgtcaggaatagaccatacagttgaaaaaaacacagtctc

SEQ ID NO: 633157 - DNA, 124 bp, Homo sapiens
acgagaacaatgaattttgtgtttagacttgggtctactccaagatacctcattatatatatacaaaatcccaaatccaaaacatttgaaacactctggtccacacattttggatagggatatt

SEQ ID NO: 633158 - DNA, 351 bp, Homo sapiens
  misc_feature (222)..(222): n is a, c, g, or t
  misc_feature (273)..(273): n is a, c, g, or t
ctatatttactatgtctttttctatacatacatacttaggataaagtttaatttataaattaaatgttaatgaggctaacagtagttaataataacatagaacaattataacaatataccagcattactactcttgcacttttacattgttaagtaaaataggagttactggaacacaagcgctgtgatactgcaacaatctgataacccagacagtactgngtgactaactggtgggcgatatatacagcctggctgtgctggacaaagggntgcttcaagggtgagatagagtggatggcacgtgatttcatcatgctgctcagaacaatgtgcaatttaaaatttatg

SEQ ID NO: 633159 - DNA, 1131 bp, Homo sapiens
  misc_feature (638)..(638): n is a, c, g, or t
cggacgcgtgggtcccagtctatgcttcccacgaaaaacgaagcatagccataggtgattagaaaaataatgaatggccccctgaaagaatcgtacaatactatagacccgccacttaggcacaagatggctcatgaggatatcgaacccccatctgcatgctcaaccgaatcacacggttgcaagctgttttagaaattattactaataaaaccagtcaagccttgactgttcttgcctggcaagagactctgatgagaaatgcgatctatcaaaatagactagctcttgactacttgctagcagctgaaggaggaatttgtagaaaatttaaccttattggctgggcgcggtggctcacgcctgtaatcccagcactttgggaggccgaggtgggcagatcacgaggtcaggagatcgggaccatcctggctaacacagtgaaaccccgtctcttaaaaaaaaacaaaaaaaaggaaaatttaacctttactcaatggtggtctacccattagatgatccaggggcaagtagttgaggacatagttcacagaccttaaccagacctggcccatgttacccgtgacaatgttgttccacggatgtccaagccatgtaagcccatgttttcaccaagngtgcgtcccccagcacctaaggaagacatttaaaaaccctttataacataggagcgtcactatagccatcaaaaaacctgggctcaagggcacccctggtttggcaaccgtgtacttctttacagtgtatacaaaacgcttcctgcggctcccttagtgttccaccaaaagctgctttcgcccccaggggtacctatgtcaaccacgacctcaactgtgtgcccaccaaagaaccttctctttgcccactaggaggtcgtcccccccaaaataaacgtacgacaccccacagggaggaacacggacgcacgaaacaaccccccaaatgcagcaagggcggacacacaccgcgtctacaaaacaaggagccaaatacccacaggcacatgcagcccaagtcaaggacacaaacacaaagacgagcagaaacacgacagaagcagaaacacagctgcaacgcacgaacaacgcaccgcaatcaaccagcagcaaa

SEQ ID NO: 633160 - DNA, 207 bp, Homo sapiens
ccccagggggggggggaaggttttttcccttgtcccccaggggtcacccaacccctccagtgggtccccccttggggggggcccgcccaagggggcagggaaaacccttcctttggggggggcccttggggggcggtcagttttgcccaaaaggttccttttggaacttccagagcccttaaaaaaaagttttttcccatgtgaata

SEQ ID NO: 633161 - DNA, 105 bp, Homo sapiens
tactatactctgtgtgagtcccctatgccttctctctggtagctctctccgatctttggtgaacctcttgtctaattgtctgtaagctccatgaggatatgccac

SEQ ID NO: 633162 - DNA, 443 bp, Homo sapiens
ggagtcggtaccagtgctacctccacaaacagagagaaagggtcaagagcttctcaaaggcataatggctgaaagcttcccaaatctaaggaaagatatgaacatctaaattcaagaagttcagtgagctctaaatatggtaaacctaaagaggtctacactgagacacattacaatcaaattgtccaaagtcaaagacagaggtagaatcttgaaagcagcaagaaaaaattagcttatcacacacaagggagcttacgtatgattatcagcagatttcttagcagaaaccttataggctagaaaagagtgagatgatatatttaaagtactgagaaaaagggaaaaaaatgtcaaccaaaaatactatatactgaaaaactgtcctcaaaactgaaggggtaataaagacttgcccagattaacaaaagctgagagagttt

SEQ ID NO: 633163 - DNA, 174 bp, Homo sapiens
gggggggggggaaaaaaccccctattttttttttttaaaagggcctttttttccccctttttttttgtgggggggaaaactttcccccataaaattttttccctttttttttccagggacccggggttttttcaaaccccctttggcccgattttttttttttttttcccttta

SEQ ID NO: 633164 - DNA, 321 bp, Homo sapiens
tcgacaagagagagaagtgggcctgaagttcagaaatcaaagttgggaattggggcctggcacagtagctgatgcctgtgatcccagcactttgggaggctggggcaggtggatcacctgagcccaaaagtttgagaccagcctgggcaacatgacgaaacctgtccctacaaaaaacacaaaaattagctgggtgtggcggtgcacacctgtagtcccaactacaagggaggctgaggtgggaagatcgtttgagcctgggatgtggaggctgcagtgagccatgatcatgccattgcactgtagtctgggcaaaagagt

SEQ ID NO: 633165 - DNA, 552 bp, Homo sapiens
tcaacaccaaacacaccccaaacatatacacaccaacacacgacacacaccgacacacacagacactgcaaatacacacaccacacacacactacataaaagtgaaaaatcagccgagcgcggggctcactcctgtaatcccagcactttgggaggccgagtcaggcagatcacctgaggtcgggagttctagaccagcctgaccaacacagagaaaccccatctccactaaaaatacaaaattagccgggcacggctgtaatcccagctactcaggaggctgaggcaggagaatctcttgatcctgggaggcagaagttgtggtgagctgagatctcaacactgcactccagcctgggcaacaagagcgaaactccgtctccaaagaaaaaaggaaaagaaaagaaattttagaaggtgtgagagaattttaacaggtagaacaggtgatcgcgggtggatagagtctatctggcagtatatttatttcatgtatcagaccccaaagttgtggccttgtcattcttataatgtctcacattttggagaata

SEQ ID NO: 633166 - DNA, 205 bp, Homo sapiens
  misc_feature (50)..(50): n is a, c, g, or t
  misc_feature (173)..(173): n is a, c, g, or t
  misc_feature (183)..(183): n is a, c, g, or t
ggtaatgcaaaaagtttactacagcccagagaatgtttcacacatgtagncggtatgattaacgcttgctggtattttactatgtacaaatggtatgtgatggcactctaggaagagtttcaagtatttattctacacataacttatgtaatagaatgactcattgaatgaanaaatacatcntgagggcttgctttggagaact

SEQ ID NO: 633167 - DNA, 751 bp, Homo sapiens
ggtccgtttctggtttggctctagtgtggggtttcttcgcgggtgctcaagatgaacctgactcttcgggaaagcgaaacccgagggctcctgcggcccaggctggactggactggctttgggcccgggtgggaacaatgtagaagcagaatcctattggcacaaaggaagaattccctccgatgggggattcgctagcacgctatgttgggaatgtcatacggggcttccgggattcaaaggcaaagtattgaccgacggaggggggtccgtggcaaacaggccaatcttatttgggtccaacggccagaaaagggccttgtggcaggaggtttcttaacagggcaacacacgcagcgaattgtaacttgacgccaggcaagcgggggggaaccacatctttgtgccccaaaaagcgagggttcatttcaaacctatttgggaaaacagaggcccaaattttattaccccatttcccgaaggttcttttttcgacagcgggaacaatcccaaagagggaaccccacctgggttgtggacatgtgggctaatttgggacaactttggggacagtgttaacagtgggcaaatctttgaccggcactgggccattacacaaaaggcccaagggtttgaaaacgatttcggacccaaagtattttgggcacggcggttttctaacacagggaaccgcaagggcttcgagcaggggcaatcattcgatgggggacatcatgtgcccaatatttga

SEQ ID NO: 633168 - DNA, 508 bp, Homo sapiens
  misc_feature (67)..(68): n is a, c, g, or t
  misc_feature (436)..(436): n is a, c, g, or t
ccgtgcctattgtgcgtctggctgcacggcggagtatgaggacggcttctctcttccctacggctgnncgcccggggtcaagcgcaacggcttcccggtggctctggctcgcgcggtctccaacgagatcgtgcgcttccccactgatcagctgactccggaccaggagcgctcactcatgttcatgcaatgggccagctgttggaccacgacctcgacttcacccctgagccggccgcccgggcctccttcgtcactggcggccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgaccnccgcatcaagaaccaagccgactgcatcccgttcttccgctcctgcccggcgtgccccgggagcaacatcac

SEQ ID NO: 633169 - DNA, 453 bp, Homo sapiens
cgccgactctcaagcacacggaagcatggcactgatgtagtcactggaggctggatagtttcctttaaatacatgtacacttcatagaaaaagtgatttttatcctagaatagtataacttttctacctgagtagtcttacaaggaattagtgtacagtagattcttactattgaagtagttatgttctgtaaattcatcatgagtactggattagtgaatactaaaacattgctcctaggagaaatacaggattaggttcctataagctctggtctcattttcatcaactgatcaatacataaccttatttaacatgtgtaactatttaaagacacctttttaaatatatattgatggctcatgaatattgaactcacagccaaggactataactcagccctgaatagaagcttatttaatgcctgaattttctccataaggcacatcacag

SEQ ID NO: 633170 - DNA, 213 bp, Homo sapiens
taaaagaggaaccagcataactattacagcataaactattacagcataaactattacagcataaactattacagcataaactattctgcatcacagggattatgaataacttaataacaaaataatcctaatttctccttccagtctcttgtaacattgctagcatttatctctcttacacagaagcgtgtgtgcacatatgcagtatgtaca

SEQ ID NO: 633171 - DNA, 447 bp, Homo sapiens
taagcaaggttgattacgctcataacttataaatacaattactgttgcttaaaaacaagaatatgtcctgagaaaaggcacagtgaggtgattgcatcattgtgcaaacagcacatagagcacacttacgcaaaccaagatggtatagctggctgcacacccaggctagctgctgtattctctggctgctaggccacagacctgaacgacatgttactgtaccgatagctggcaggcaacttgtgacacaggcaggtcgacgcgggccgcgaaattttaagtaagtaggatattcgaccccggggaatatccggggtccgggatatcttgcaaagcggtaatcagtgtttgcccgtaattaagtgtggacgtgtatttagaagccttgggcggtaaatcaatggagtcataagcagggtttcccgagtggtaagtaatggttattcc

SEQ ID NO: 633172 - DNA, 281 bp, Homo sapiens
gggccttccatcgtccaccgcaaatgcttctagacacactccacctccagcacgcgacttctcaggacgacgaatcttctcaatgggggggcggctgagctccagccaccccgcagtcactttctttgtaacaacttccgatggtgcatcgtaaactgaacagtgtttattacgggttcatacattaacttattaacccaatttggtatttttcggaacaaaggccggccggagcaaattggaaacttggaggaggattaaaggcaatcctgtaaggttga

SEQ ID NO: 633173 - DNA, 589 bp, Homo sapiens
  misc_feature (1)..(1): n is a, c, g, or t
  misc_feature (3)..(3): n is a, c, g, or t
  misc_feature (7)..(7): n is a, c, g, or t
  misc_feature (26)..(26): n is a, c, g, or t
  misc_feature (39)..(39): n is a, c, g, or t
  misc_feature (42)..(42): n is a, c, g, or t
  misc_feature (45)..(45): n is a, c, g, or t
  misc_feature (48)..(48): n is a, c, g, or t
  misc_feature (66)..(66): n is a, c, g, or t
  misc_feature (92)..(92): n is a, c, g, or t
  misc_feature (94)..(94): n is a, c, g, or t
  misc_feature (113)..(113): n is a, c, g, or t
  misc_feature (128)..(128): n is a, c, g, or t
  misc_feature (138)..(138): n is a, c, g, or t
  misc_feature (149)..(149): n is a, c, g, or t
  misc_feature (153)..(153): n is a, c, g, or t
  misc_feature (155)..(155): n is a, c, g, or t
  misc_feature (171)..(171): n is a, c, g, or t
  misc_feature (183)..(183): n is a, c, g, or t
  misc_feature (206)..(206): n is a, c, g, or t
  misc_feature (215)..(215): n is a, c, g, or t
  misc_feature (217)..(217): n is a, c, g, or t
  misc_feature (221)..(221): n is a, c, g, or t
  misc_feature (231)..(231): n is a, c, g, or t
  misc_feature (257)..(257): n is a, c, g, or t
  misc_feature (277)..(277): n is a, c, g, or t
  misc_feature (282)..(283): n is a, c, g, or t
  misc_feature (289)..(289): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (327)..(327): n is a, c, g, or t
  misc_feature (334)..(334): n is a, c, g, or t
  misc_feature (338)..(339): n is a, c, g, or t
  misc_feature (341)..(341): n is a, c, g, or t
  misc_feature (353)..(353): n is a, c, g, or t
  misc_feature (368)..(368): n is a, c, g, or t
  misc_feature (380)..(380): n is a, c, g, or t
  misc_feature (393)..(393): n is a, c, g, or t
  misc_feature (404)..(404): n is a, c, g, or t
  misc_feature (407)..(407): n is a, c, g, or t
  misc_feature (410)..(410): n is a, c, g, or t
  misc_feature (412)..(412): n is a, c, g, or t
  misc_feature (423)..(423): n is a, c, g, or t
  misc_feature (442)..(442): n is a, c, g, or t
  misc_feature (453)..(453): n is a, c, g, or t
  misc_feature (468)..(468): n is a, c, g, or t
  misc_feature (471)..(471): n is a, c, g, or t
  misc_feature (565)..(565): n is a, c, g, or t
nanatanaggtaggctctatagcaanaggcctggaggtnctncanttntgggggaaaatggaaggnggagggtggagttttttctgcaggananctgagtggagggtgggganaggtgcaaactgganaggcctaaanagctaaaaaancaantnagggccagggccaaantcggcttcaatngaaaaaaaacccaattccctaangcccctaantntttntggctttttntttaccccaaaccagggttgggagtnctctgggcatccattttttntaaannaaattnaaaaaataaaaaaaagaaangaanctntnanccttttnccatttngttnnangggcctccaatncaccattcctccttnttccctttattnggtggggccaaanaatgggcaacnaanctntnggctttcccantaaaacaggctgcaaaaanaaccatttttnaattaggcgtttatnttnttcccttgtttcccaacctaccaattccactttaaaacccagagtgagttctacaagcgttgctggcctaatggatgggctgggggaagggggngggacaggggctggaggaggggct

SEQ ID NO: 633174 - DNA, 1262 bp, Homo sapiens
gtgacaaatttctttattttaaattcaacaaacctcattctttccttcaagccccaggaccagtggtaggcagccctccctctccatcccctcaccccacccctttagccacagtgtgaagggaagtggaaaattgagaagccacgaagggccccttgaccagggaaaggcttgccccgagattggtgtggtgagcacagtcagtgtgcagcttgttggcgtggggcacgcagcttgccacaggcttccttcccttattaaattataagttccgtgcagccacagcttgatggagaagaagcataccttgataaaacgcaaggccagatccagcattcaagaaggcaaaggcagacattcaggtgacctcccagccaatggaattgaacgggagagacacagagcctcaaagacaaaaacaggccagggggaaagaaggaagaagacagacatataggccagggcattggcggtgaagggcactgaggccctataaatatcgggctcccaggggaacgcgcaaaaggccagagcggaacacagtattcgagagagatatgagggcaagcggaccgtgctataacgaaacccatggcgggcacaaggactcgccaagaaagggccaccatccaaaggtgaaccaggcacacaagagctagacaccccacaacaccctgaacccacacacgagaacactgacaaagcacaggggagagccacacagaaacaatgctcactggacaacacacaatcataatcacaataatcacataacacccaaactatgcggagggtcacagagaccacaagaagactgacgaatcggagaacacacagcgaaacgaggcaagcgcacacaaccgagtaaacaaaaccaaacacagcctgaacaccgcccgcggaaagagacccaacagaaaaccaaatacaccacgacgccacaaggaagaaagaaacacgaacaagaatccaacacacaagagaaactacaaaaggaaaaaaaaaagagaaacaccagaaaaaaaaacacaaaaacggaagcagaaggaacccgaacccgaacagaaacagaaacacagacacagaaacaacacaacacaacgaagaacaaagagccaaaaaaaacacgaagatacaaacaccaggaagaaacaaaccgaagagacaaagaagaaacaacacaccaacgaacaataaaaacccaacgacagaaaccactgagacaccaataaacgacgataccgagggtcccacccaacaac

SEQ ID NO: 633175 - DNA, 383 bp, Homo sapiens
  misc_feature (23)..(23): n is a, c, g, or t
  misc_feature (43)..(43): n is a, c, g, or t
  misc_feature (328)..(328): n is a, c, g, or t
  misc_feature (359)..(359): n is a, c, g, or t
gccagtggccacacacacacacncacacacacacacacacacnacacacacacagagccatcagttaccaatagctcttcagctgggtgcagtcttaggagcctctcctccatccaagctagaatatgggtctgcagatcaccacagctgctgtgagcttgtgagtgtggtgtccatgccatgtccagaaggcagcattatatatacatggccctattccccaggcttcaggccttcattctttccaccacttcttcagtgctccctgagccttagacaagtctactgatagaaatggtctgttcagagctgaatagtaaacagtcanttagtctctacactttgatcagccttgtgtntgtaagctggatgctctctactga

SEQ ID NO: 633176 - DNA, 948 bp, Homo sapiens
tagccgagaagccgggcctgcagcgcttcagaaccgtccgggaaccccacccgcttcccaggcgtgacctgtcaacagcaattcgcggtgtggtgaactctctgaggaaaaaccatttggatatactctcagacgtgcgtggcaacaaatgtgatttgagaccctagaaatccaagcgttgcacggtcctgaggcagcctaagtcggcttcaaaaatggacacgaaggcggtttgtggggttccattcagagccgatacatcagccatgagtgtgtgaacaaagcccacgggaggacttgtgggaggcttggccaggggcaggatgctttggttgaacgggatggaaggccccttggccattgtgccggcccgtgggaaggctcggcttggccccaaggagaagctcttccccgcaactctttccagtgggcaaggcccttttgacggcggaagacacaccagcaagaccccttgaaggggcactggggtgcaggcctttgggcactttccaacctggcctccctcttggcattgctcgcttcaaggggacacaccattcttcacccttggggaccctttacaacagggttgtgcttcgactggacttgattgtggctcctttgcccagagaggcttcggccccaggaaggtccgacaacttacaacggtggctggaattcactggaagaaagttctaagttaggagaattactggactggagtggtgtggaaaagggcaggtttgtactaatttccagagccagaagaagttaggttatgaaaataacgaaagtaaatggttggaccagagctagagccttaattcataggtggcgtaacggtctaggagggctgtatatggttcaacattaaaatgtgaagaatgtatactgtgtaaaggaaattatccagataaagatgaatgctctataagagatatgacaagg

SEQ ID NO: 633177 - DNA, 256 bp, Homo sapiens
  misc_feature (58)..(58): n is a, c, g, or t
  misc_feature (67)..(67): n is a, c, g, or t
  misc_feature (136)..(136): n is a, c, g, or t
  misc_feature (159)..(159): n is a, c, g, or t
  misc_feature (170)..(170): n is a, c, g, or t
  misc_feature (218)..(218): n is a, c, g, or t
acagcgccaagtgaagcctcgcttcctcccgcggcgaccagggcccgagcgagagtancagttgtanctaccgcccagaaactagacacaatgtgcgacgaagacgagaccaccgccctcgtgtgcgacaatggcncggcctggtgaaagcggcttcgngggaatgacgncccctagggccgtgttccgtcatcgtgggcgccccgacacagggcgtnatggtcggtatgggtcagaaagattctacgtggcgacg

SEQ ID NO: 633178 - DNA, 1786 bp, Homo sapiens
  misc_feature (854)..(854): n is a, c, g, or t
tggcgggcggagcgcgtggggggtggtgttgcatcaacggcgccgcgtgtttgttggtgggcggcaaccacgcgttgtggcggcgccacgaggttcctagggtcgggttgtgttgtgtcggggggagggtgtgacacatggtttgtgtcgcgcgccagggtggggcgcccctccctggtggtagagctcttgtttgggagcgcgtgatgagtcgtcgtcttgcttgcacctctcgggggggggagccacgcatgtgggctggggggggccgtgttccacaagtggtgtcacggcgcggagaggagtgggtgggtgtcgtgggctgccccaaggggagacatgtgtttttgtcgcgtgctcgcggtgggggagatgaccgcgcgcttgtgtgatccatcgggggtgtgagctccacgtgcccgagcaattcaggtgggggggccgccgccgccccgccccggtttggggggagagcggtccacaggctgtggtgggggttggtgctacgacgtgggggttgccaacgggggttggagcgtgttagtgtcggccgttgggggaacccctacgtggcggcgccagggccgccgccacatatttgtggtgggtcgcgcgccgtggtggccattatgttggccggccccgcctcgtgtgagtatgtctgggagtgttttggccgccacagcacgccgagaggcgttgctatcgaccgcgtgggaggacacaaggggcaccagggtgtgtgggtcctcggagagcctcggagaagggggggagagagggaggtgttgagtgtctcccccgctgttgtctgtgcgtgtgaagagagaagagcctctgcgagaagagattangggccgccctgcggcagagtagtggtctggtgcgaagaagagttgtcctgcgggtggtgaagtagttggcgcggctggtcgacgccagctggtgtgctgttgagaggtatctgctgcggtggttctcctctgcggccacacagccccccacacgactgttgtgtgtcgccgtttggtaggcgagagcgcgctttcctgttcaccgaggcgggtatattcgcgacccgcgctatgtgtgggagttctcggcggctttgttgtctgctgtgtgttctgcggtgaggagtagagaaggggaggagcacccagcacacccagcagtgtgcgctccgcggtgggcgggtcgtctcatatccacagagcagcacacgagtggggcacccacagagaagagccgctgccgccgttgcgagagacctgctgggcccacacagaggtctcacaccagcagagtctgctggcccccccagagatatagagccgctctcagagagaggagcgctcatagagatgtagatatatgtagtcaccccctgatagttaccctggcgccacacgccacacactctcttatgagatcccagagtggggtggatagaacaccgggtctctccagagaactctgtgtttgtgtgtgtccacaattgtgcccacattgtatagagtttatgagtatgtataaaagagcctggttaaatgaattcacccaatgcctctcgttaaacccttccagagaggagaaagaggaaatgttttgtggaccccctttggttttctcttttttgccgtgtggccacgttttaaagttatattatgttttttaaatccgtgacttttttatgggaaccaccgtgaccccaaaattgtccccacgaattgttgagaccccctttaaaaagtttacatgagaaataacaaaaataaaaaaaaaa

SEQ ID NO: 633179 - DNA, 195 bp, Homo sapiens
gcgtcgacctccagccatgagccactgtaaatgtctcggaatgccaacttgaagcccagctggtcagaagttctagaggcccagacttgcaactggtgtctgaagggatggcagtcttggggactgagccctcaacctgagggatctgatgctatttccaggcagatagtgtcagaattaaattggaggatacgc

SEQ ID NO: 633180 - DNA, 149 bp, Homo sapiens
agtgagcgcatacagggatcaggatgagccgtggcgttgcccagccaccgatcccctcgacccgtatacgttgatccaggaacacctgacggcggacatcattgtgacgggaggtcatcttggtgtagctggtttgccatggatgggag

SEQ ID NO: 633181 - DNA, 743 bp, Homo sapiens
gttatagtgattgcttacgtaattggcagacgacacacgtgatgctggatatcagactctgtaacactaatcaatacgtgatctctgttacaaaagaaaaaagcaagtacaagttccaacatgcaatactggtcaacttcaaggtatatccagttgcagtccagctctttcagaatgggtggtatgggggatttcaaacttcaacacacaaaaactatcaactacgaaattagttgcctgactcttgcgtttttccaaccaaggcaatttaacaactgttatttttacagcacaaagatgtgcaaaatcactggattcataagttctcattttcactgtcttgccattcagtcatttcagtgttcttccatcttctcagcacaattccagactcaacacaatacaccgtttcagaaaaacacgaattttcgcaaacaagagcattttctctttaccctgcaggtagctaagagattaggaacaagcatgttctaccgtcaggattcagtacttgctacctttaagctacttatctgtgtgtgtgctgtgtgtagtgtcgtagtgtgtgtgtgtagagaacttgctgtagagccacagctaacacagacaaactaccacaggcactcgctggcatatagagacaccagagaagaagaataaaagaacatcgactgagaaacaggagccaggtctcaccacaccctcatacacaacaaaacgcacaccaacaggctgagaaaaca

SEQ ID NO: 633182 - DNA, 249 bp, Homo sapiens
agatcgagacagctgggcaacaccagtgagaccttgtctctactaaaaatacaaaaatgaggtgggtgtgacggcgcttgcagtcccacctactcaggaggctgaggcacaagaatcgcttgaatccaggaagcaagcggaggttgcagtgagttgagatcgcactccagcctgggtgacagagtgagattctgtctcaaaagcaaactaacaaagaacaacaatacttcctggggtttcggtgtgcag

SEQ ID NO: 633183 - DNA, 253 bp, Homo sapiens
cgcagtttctgcccattgtgcccactttctcacctgcgggaaagcttggagcttctggggctagtgatggggcacaggtgttgcagggacaaggtctaggtgatctgagttcagggcagccatgtgcctggggcctggtgcaggtgctcaggtgaggtgcgccgggggccggccttcagtaggttggtggccgggccccagacctttgggggagggggctgaagagggccctggagcacacagaccccattca

SEQ ID NO: 633184 - DNA, 100 bp, Homo sapiens
tcagtcactgaggcccttcctgtttacgagccttggcgctgcttccccgtgctgctgtctctactgagccacaatccaagaacctagatactgggcactg

SEQ ID NO: 633185 - DNA, 389 bp, Homo sapiens
tagcaggttacgtgcacattcaggtgatcgggtactagaaaacccgggcttgaggcacgtgcaagcgttaggtggacaggctttgtgattagttcaaagttgatgaagctcacttggtccagatcacacgataagtcttcttccctgtagcggcatcgtgatagggattttcggccgggacctcttgcgtgcgcacgcacgggggtccctcgcagtccataatgggagcgtcaccaccctggcgtttcaacgcttctatgttttggtcaagcaccggttactctcgttggcgttgggcaaactcatcggggctggggaccgcgaagaaaaacaggaacggccagaggaataccacacctagatgattagcgaagatgctgagccccgaa

SEQ ID NO: 633186 - DNA, 472 bp, Homo sapiens
caatgggaaacaataagacacgggagattccgaaaggggggatagtggggaaggaagcaagggtaagaaaaccgtctatggggtagtatgtccactatttaagtgacgggatcaacagaagaccaaacctcagcatcatgcaatatactcatgtaacaaacctgcagatgtcgccccgaaactaaaattggaaaaacaggcggggagaggtggcttatgtctgtaatcccagcacttggggaggccagggtgggtggacggcttgagtccaggagttggagcctagccggggcaacacagcaagaccctgtctctacaaaaaattaaattagccaggcatggtagcacaccccaatagtctcagctactcatgaggctgagtagggaggactgcttcaaccggggaagtcaaggttgcagtaagccgtgatcatgccactttattctagttggagtgacacagggagacccc

SEQ ID NO: 633187 - DNA, 389 bp, Homo sapiens
gtgtgctccttgcagagccatgattacctgcaacaaagtgcagattagggcccacgggccttgccaggtagaacatgctatcgttctttaattttattatatatacgtactttgcttctgtattttgcttaaagaactaaccccgatcaagagtatttgctttagactagcttaaaaagaaaacatatattttatgtaaaaacacatacatggccaaatgcaatactgaagagacaatcatcctgtatcttttatggtttttcctgcttctgagtgtcgttctacaatgcccgttgacttattccattgcgtctctgctttagggtatggtttggtcgctttggttgtcatgagaaagagacattctccttgcagctacctccatgtga

SEQ ID NO: 633188 - DNA, 171 bp, Homo sapiens
tatgcagcaataccgagggaggacatcagtgaaaactagcgtggcttgaggaatcggggcagattgagtgatcttggggacatgtgaactggtgaagcttggcaaattggataacagggtcactggggtaatgattgtctatgtctcctgtgaaggaggataatgcaatgg

SEQ ID NO: 633189 - DNA, 176 bp, Homo sapiens
aaaaagggggttttcccattttggggggggggttttcccacttcttcttttaaattattttccccgggccctcccaaaggtgtgggatttttagggggtgacccccttcccctgcccccaattttttttttttttttttggccccccaaaccaaaattaaattggtttttttttta

SEQ ID NO: 633190 - DNA, 175 bp, Homo sapiens
gcagcaggatctaagtcatatagattctacttcgaaaacagacttatccccacctggctatcatcacccgatgaggcaaccagcgagaacgcctgaacgcaggcacatacttcctggattctacaccctagataggctccctttccccgtactcactcgcacgtaagtttagcac

SEQ ID NO: 633191 - DNA, 188 bp, Homo sapiens
ggaagaaggaggaaaattacccggtatcgttagagctacaccaaaattgcattttagccaaactttgccaccaagagcccaaccaatcaccatgtatgcttgagcacgggaagggcagggaagggggttcttggtgaaggtcaagggggccctacccctggtcctcgttcaagcccatgaaggtaatg

SEQ ID NO: 633192 - DNA, 452 bp, Homo sapiens
  misc_feature (209)..(209): n is a, c, g, or t
ctcttcaccacaagcagtgtttatgacccatcagcatggagacgctgtcaaacatgtttgagctggatttgcccactgtgcactccatcatcagcaaaatgatcattaatgaggagttgatggcctccctggaccagccaacacaaacagtggttatgccccgcattgagccccctgcccaacagaacctggtttttcagctggccganaaactgggcagcctggtggagaacaacaaacgggtgttttcccacaaacagggcacctacgggggttacttccaagaccaaaagggcggctcccccaaaaacaagggttacatgccccccggtggctacccccaacaacagtttcaaacggcctattgagctctcccctttgtttcccgcctgggccatccaaccttgaagtcctaaacccccccccagtccctaaaggtttgtttaaagtta

SEQ ID NO: 633193 - DNA, 141 bp, Homo sapiens
ctcgggaccgctgagggtctgatttcagcgaggccaattttagtgcagaaagaagaaagggctccataataactgccccagcatgggaacgaaatgccttgggggtcctgatttcagtgaggccaattttagcgcagaagg

SEQ ID NO: 633194 - DNA, 109 bp, Homo sapiens
ctccttagctacaaacctgtatagcatgttactgtaggaggagggaggactggactggatgatgtccaggagcctagcactgctgttgaaataacattattctcgcagg

SEQ ID NO: 633195 - DNA, 165 bp, Homo sapiens
aggctccccgatacacacctcatctgcctttcgatccgtgatggcacgcgggagtgtctgcacacctaggctgctctctctctctctctctctctctctctcatctgcaacgcccacgggagcggtgccaagctgtccccttctccccgtcccccaatactccca

SEQ ID NO: 633196 - DNA, 223 bp, Homo sapiens
ccggggggccccccccccctttttttttcccccatatagaaaccccgggggggcttcccccccccgctctttttcttgggggggggggggggatttatttttcccccgggcccccccctcccccctgggccctttttggggcccctttaaaaccggttttttgaaaaaaacgggggggggccgggccgggttttccgggggttttttccccccccggccccca

SEQ ID NO: 633197 - DNA, 108 bp, Homo sapiens
tccacaccaagtaatcatatcctagtgtgccatcaagtcactaagtcgcatcacagagattcagcagtgtggaggccttccatgcgagagtgggctagctcatgcggt

SEQ ID NO: 633198 - DNA, 366 bp, Homo sapiens
accactgcatgggcgatcacatcatcgtgttcaccgtgtggccgatcagcgcccaggaaaccatggtgaccaccaagtggctggtacacaaggatgcggtcgaaggcgtggactatgacgtgacgcgcatgcgtgaagtctgggatgcgaccaacgaccaggaccgtcgcctggccgaggaaaaccagcgcggtatcaactccacggcctaccagccagggccgtactcgaagacctatgagtttggcgtggtcaactttgtggattggtacagcgagcggctgttgagcaacctgggggccgagcctgcgccgtacctcaagggtgtgccggtgcacggctaacagcaaaagcttcggtcgacgc

SEQ ID NO: 633199 - DNA, 334 bp, Homo sapiens
tacggcagttctgacacatgaggaggctgttaaaagagcaggggcgatgggtgcatctgccttgggtcgcagtaaaccccaggcacacaaagacagaggcttgtggctggcttgcggttgctgtgatcacgatggaatcagacaacggctgccctggcaggcagcacccaggcacctctcaggtgggaaaagactgagccaggtgaatgtcccagagctccagccggctcaggctcctatgggtgataactgcactagacacctctccgaagaagccaacagaaactgcatgcagcggcaacatgagcaaagataagtgttgggacccgttctt

SEQ ID NO: 633200 - DNA, 1005 bp, Homo sapiens
attggcgtggttttatattagtctttccaaatatgacatggattgtcccttggaacgtccactatgtgcattctcttaaaatgcccacaccctacttgctcatctcagagcgcgcacatcggcctagatcctctcgcagggtacaaacaggggaagctgatagcgtcgcttccatgtatagtgtttgtaatgcaataatgttccagtgaattcctatcgtccattaaatactcttgggtacttggtggtactgcagttattggaactgactgagcctttcgatgctgcctccgctttccctcctggggtagttccacgatactggagatgttatgaaggcatttcgggtgctctcctggtcagtgagtgtggacgagtcagctcataggtcttcatctgataccattgaacgttcgagagccatcttgtacatacatcatgtgctcaggctgtcaagaagaggattaaacaaggcaaataaccgcttgtctgagcaaaagtgggaactacgagtggttgaaggacctcaaaagtagtggcattttgggatgaaccacagcctgccagttagtcacatgttgactctgagcaatgaagcgcgaaccgtggaaaaccgctcctgtacgtcgagatgttgcgagcttgaacgcgctccatgaggccaaacgatgcgaaatctggcgtgtgacgggttccatctgacgaccgtgtgtaactgctgaggcaggcgttggtctgtacagtgaccatgaggagcccctctcttccttaagtaggaatctgtgaagctaaatgttttgctgtcggagacaactcaggactgtctgtccttgggaacagcattagccagatgaaggattgcctggggcacaggttgctgcgcgagcggtatataggagacacggtccgaaagggttggtggaaacacaatatcaccttacgagaaaaatacctgatgggaaaaaaagggggtttaaaccggccttccttaaccctcaaactagc

SEQ ID NO: 633201 - DNA, 343 bp, Homo sapiens
aaaaaaaaaaaaaaacccaaaaccaaaaaccaaaaaaattagctgggcgtggtggcaggcgcctgtaatcccggctacttgggaggctgaggcaggagaatcacttgaaccagggaggcggatgttgcagtgagccaagatcgcgccactgcactccaccctggacaataagagggaaaccccatctcaaaaaaaaaaaaaaaaaatttcttgtgaggatatgtttagaaaccgctaaaaacattagtgttttaggccgggtgtggtggctcatgctgtaatcccagctgaggtcaggagttcaagaccagcctggccaatatggtgaaaccccatctcaact

SEQ ID NO: 633202 - DNA, 317 bp, Homo sapiens
agcggccgcctactactactactaaatttgcggcccgtcgacgatcggcattttgaagactcgggtgggctggccagcacgggcggatcaggaggtcaggagatcgagaccatcttggctaacacagtgaaaccacgtctctactaaaaatacaaaaaattagccgggtgtggtggcgggcgcctgtagtcccagctgagggactgaggctgaggcaggacaatggcgtgaacctgggaggcggaggttgcagtgagccgagattgcgccactgcagtccgcagtccggcctgggcgacagagcgagactccgtctc

SEQ ID NO: 633203 - DNA, 1019 bp, Homo sapiens
tacgtgtacaggtggacctggagtcgcggagaaggtgctcttggacggcgagcgcgtgtacgtcaaatgatcagcctactgttgcgcgcatctgcaaaggcagaggagagtggccctatgtgggaccggaactcgcgtattctgtgcgagctggcgagttgctgaccgcgcctgtaggtggtccatggtagaccgtatgcacacggccgcagcagggtggactgggtagcgtgactagggtggtgtctgttgcgtagagagaattgcgtgagttggtcgagtccaccaattcgcctggggcgatagattgccgtgactggtggtctaccgagtaggatcgatcggagcggacagaaggtgacgatatcctcgcagcttgctcgtgtcaggccagaagccgatgctggcattgcactgtagcagatggctggttgacgcgcgggaatgcacagacgcgggagtgcctcggctgatctactggcacgaggaaagtgacaccagaggatggtgaaaaggaataccacagcgcttctgacagggagcttcgtgcgcgccttgagaaggcccgcgtggtctgcgcctcgggtggcttgtggactctcgggccgttcaggtagtcgccagcgcgtgcttccgggacggcgactcgaggcgttcacgacaatgttgccgtgggagtctctgtcagcctgggtcaggccgctcgacgtcttcgtctctcctgccagcggtcgccatggcagcgtgctcgctgttcatccgctcgtctggatgcgggagcgagcctgtccttgggacttatcgttgtgtcgtttggcccggggcgcgtggttatgctccacgtctctctgagaggtgagggctgctccctgcacggagagcctgatgcctgttgtagcggggcggcagtggtgagttggggcgcctggggggttgactgtgtcaccctggaaggctgggactaaacattccaagcggcgggtcgtgttttccacctcctgggccgggggttgggccca

SEQ ID NO: 633204 - DNA, 111 bp, Homo sapiens
gaatattttagagaagattctaagagaaaaagctaaggtgatttttttttttcagggcgttttttggttctcagacagtgtctcactctgtcgcccaggccagagtgccgt

SEQ ID NO: 633205 - DNA, 203 bp, Homo sapiens
  misc_feature (164)..(164): n is a, c, g, or t
  misc_feature (174)..(174): n is a, c, g, or t
gggatggggtcgtacctgggttggttcactgaagtaggaacctcagaataaaccatacagaattctccaatcttctgcagatcacccccacggcagtatatagtgtcagacaacctttgaaaactgaagcgtacccttgtggtgagccggataatgtccccagngctggatcangatggccaacattcgtcccagcacagaga

SEQ ID NO: 633206 - DNA, 139 bp, Homo sapiens
ccgatttgactacgcggctgcaggcgaaatggggttatagggtggggttatttacagttaatgttagtaagggtagggaagcgaggttgacctgttagtggtgagaagaattattcgagtgctatagccgcgtagtcag

SEQ ID NO: 633207 - DNA, 198 bp, Homo sapiens
tctgaaagcatgactggagacgccttaggaatcatagcggaagctgaaggtcatcagtcacttcttacatgcctgcagaagggggaagagagagcagatggaggtcccacacacttttaaacaagaagatcacatgagagctcactatcatgagaacagcaagggggaaatctgcccccatgatccaatcacctccct

SEQ ID NO: 633208 - DNA, 360 bp, Homo sapiens
aaaatgaaatatggcattggtttgtggctgacagctaccggtttgtccagacacttaaaaacttgggatacaatatgaaacgaaaaagacgaagatccatggaggcagttgcgatcatgactaaatttcactatcccatgcttagcttacacgtcaaatacctgctgattggaccctttaacctcctggagagcagttcgactattacctggacaaccttaaagaacttccagattggctaaatcatggctctaccttattaatctgtactcacattgtaatttggacaattgtcaacatatccaagatacccaaatcgttaggcacttttactaggatctcaatgttgttatcgggttt

SEQ ID NO: 633209 - DNA, 679 bp, Homo sapiens
attccaggcagagaaaataggcaacacaaagaactaaaggcagaagcatactgggcgtataggatgaagggcagagttccactaactaactgtgtatataaataggaagagaaatgagtactttacctggatgcgtgtggccttttctccgtgaactattttagatatatgtaaaatgcacttatttagaataaaattcacttatttcgcattcttatgggagaatatggaattaatacagtatgctactacaatcgaaaatctctattctcttgagtttaacatatccgtttctcaagtgcacgttacgacccaacaatacaacaaatgctcgggctattaatcagtaacatacctgtacttcctagtatccttccagtaattttcattattagccatacaggtacaataatctaatatcctttctttacatggcaatgtccaagcgcatcgtggattcagctattgaaacgccaattcttccacccttaagttgttaaccctagacaggaatgtgacactcaaacaccagagtactcacccaaggctttgttaatcaacagatgtgggctgtccgtgtggcatttttgcaccaccagacaaggactattttacaccgctgcagataacataaagctgatgcggtagaccaagtccccttcagcactgtacgtatgcg

SEQ ID NO: 633210 - DNA, 459 bp, Homo sapiens
cccaggctggagtgcaatggcgccatctcggttcactataacccttgccttcccagttcaagcgattcttctgcctcagccctccgagtagcaggaattacaggcatgcaccaccatgcctggctaattttttttgtatttttaggagagatggagttttaccatgttgtccaggctggtctcaaactgttgatcagcccacctcggcctcccaagtgctgggattacaaatgtgagccgggagccactgtgcccgggccaatttttttttttttttatagacagggaaaaacatcttaagatgggagagatcaaatacctggcctattttaagaagagcttttttcttgagagtccaggacccgatgaaaaggaagctcctcggctaaaatccgcttataaaaacccgtacattattagagtatggcctattggagggatctaaagttcctatgattc

SEQ ID NO: 633211 - DNA, 361 bp, Homo sapiens
tcttgggatatatatattctttactcttagcaatgaacatttcggagtttcatggaaagtccaatgcatttattaagcatctttaagttgacaagattttagctcaaaactctatctccctggcattagcaactgctgaaacctctggttagttatttagccatccagatgctgctttatgatacatatttttttacgctgcacatctgcaatttaggattcagccaaaggtatgagatgaatctgcagtcatatttgggacttatccatccatgtttgaattctttttggcagttttccccctgagttttaagccagtgtggaagttctggtttcaaataagtagctcctcagcctggcc

SEQ ID NO: 633212 - DNA, 1252 bp, Homo sapiens
  misc_feature (30)..(30): n is a, c, g, or t
  misc_feature (56)..(56): n is a, c, g, or t
  misc_feature (63)..(63): n is a, c, g, or t
  misc_feature (72)..(73): n is a, c, g, or t
  misc_feature (363)..(363): n is a, c, g, or t
  misc_feature (385)..(385): n is a, c, g, or t
  misc_feature (1252)..(1252): n is a, c, g, or t
cctcctcaggctgccaaagtgctgggattncaggcatgggccactgcacccagccnacatganacacttctnnaagataagtggaaattcaagccattgatttttctgacacaactgacttactacacacacacacacacacacaccacgatttagctgtaattggagttaaaattcagtaaaaaactgttattagtcatgttttccaatttgtgagttatacaatattggattagatgctaatttcttaactgttgctatgggctgcatacattatgtcaaactaactacctttgggagtgtctatataaacacttgaaacttttcaaatatatgaagaggtaggttctagtgtatacattntattggaaagccattaatcatngaagaacttaagcaggtggggcatttaatttcttccaaataccttattttgtggatctgctcaagtggttagggcgagtgcaccattattcccgaatccctgcaatgtggttcccattttgtctgcacaaattttcttgctcagtcgagccaatgacttttattggtttttgataatcaaggaatcgcggccgggggtatcccattatatatatctaccctatgagtgtagacgggtgcctggaaaactacccatcctcatgacctcagatctacataatcctaagtcataaggtaaacaaatactgatgcaaactagtgatcattgaagggcacaaccagcaataatgggggacacaaaacatagagacaacctcataaagactcggcaccacagcacgtccagatcaccaagagcaaaggagacacagcacacccgtgcacgtgccatcaggacaaaaaaacgtggcacacagatagtatcaccagggcaatgacagggccaagaaccgccatgaaaacagcctagtagaaacccccgggcgggatgaacaaatagggggaatccccagacgagagtatccacacaagagatgcgaacccaattataacagcgacaatagtcggatagtggacaagcgacacagagacccgctgacaaaaaaacagggggagacacccaagtggtgaaccaagaagtaaactctagaaaggaccaacgggcgaacagtatcacccggatcatcggaaaccacagatccatcactagcggaaaccaatggtacgacacaccgacgcgataggcacacaactctcaagggagcaacagcagacagcaacaatagtttgtcgtccatcctccaacggn

SEQ ID NO: 633213 - DNA, 920 bp, Homo sapiens
gacattgtgcaaaccattctctcctgtcaatcagaggccagcctcccaactacgagatgctcaaggaggagcaggaagtggctactgctgaggggtgccccacaaccctggtcgcccgatgtccaccgtgatccacagtcctgcgtagcgatgacctcgcgtgcctgaccatgtggtctggtccctgttcaagcaccctcttcatgaacacctgctgcctgggcttcatagcattcgcgtactccgtgaagtctagggacaggaagatggttgtgcgacgtgcaccggggaccaggctctatgtcactaccatcgccagagtgcctgaaacatcctggagcccgtgatctggggctatcttgcatcgcaccgattcgtgctcaatcatcatcccagatgtaggtcgtcccaggtcccagcgataagatcaggcaggcagtcattgcaggcccaggagctctgaccacgtgaacctgtatcccaggtaacatctatcatttccattcctcgagcctgacctcaagaaggccaaggagcctctgcaccattgaacgctggtatatccacgttaagtccagccttgcattacttcgcaccgggtgcccaaagcccgagtcctggcattcaaccctttaatcctcacgcagcattggctacaccaaaatggggaccttgcaaattacaacgggcgcgtactaattggttgtgccttggacccagacagaaacaccacgatacacaccgagatagccgacacagaacgcacgtttggtggcgcagacgctcaagccaccccgcacgagacagccccactccacgagcacaactagcgtccatggaccgccgccgccgcccccattaagaacgcgcggacaaggcgcgacatcggcggcgccaaacggcaagctcggcgaaggaca

SEQ ID NO: 633214 - DNA, 117 bp, Homo sapiens
caacgaggaatctgtgaaggagggggaggagaaggcaagatatggacaaattgaaaactacctgcagaccagcagcctcttagccagtgaccaccacctcactgaagaggagcgcaa

SEQ ID NO: 633215 - DNA, 475 bp, Homo sapiens
  misc_feature (246)..(246): n is a, c, g, or t
  misc_feature (462)..(462): n is a, c, g, or t
  misc_feature (465)..(465): n is a, c, g, or t
gcagttttgtccaacgatcaaacatcatgataataattttcctctgggacaagcatcagagaggtttacttccaatctattaagaaagattcaggtttcctgagcctgaggttcttcagctttaccacaaaccactgcattcacaggattaacctgaaatgctcctcacaggacttaggaggcaaggagaaccaacgtaaatatgaagataattgatgcttgctatgttatgagtaataaagtctntaatccctgaggcaggagtctcatatcttttgtcatcagtacaggttgagcaccccaaatccaaaactctgaaatcctaaatgctcttaaatctgacatttttaattaaaacatttttattactagagacagcatgttgcttgcccagactggagtgtggtgacatgatcatatcttacagtgaactcctgctcaacaaagtgagaccatgtctanacnaaaaattaaa

SEQ ID NO: 633216 - DNA, 375 bp, Homo sapiens
cgactctaaggatccccttctgctccctcttcactgtgctgtgaggcacactgctctccttcaaaggctcgtgctggccaggcacagaggctgacacctgtaatctcagcatttatgggaggcgagcgagtggatcatctacgtcaggagtcagatccgcctgagcaccatggagaaacccgtctctaccaaaaatacaaaattaagcaggcttggtggcgcatgcctgtaatcccagctactttgtggaggctgaggcaggagaatcgcttgaacctgggaggcagaggttgcggtgagccgagaacagcgccactgcactccagcccggtcaacaagagtgaaaatccatcttcaaaacaaaaaaaacacaaa

SEQ ID NO: 633217 - DNA, 657 bp, Homo sapiens
gcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaacccccaacgactcagaacagcacgggcgtttcttgcccctgttgcgtgtctgttggtgggggccctacccggaggcgtggctgaaggctgcgccttccccagtgtgccggctgctgggcgaggaaaacgagcacggtggagccacacggggcacctgcagctttgctggcagagactcctcgcgctatgctgctccacttccttgg

SEQ ID NO: 633218 - DNA, 1324 bp, Homo sapiens
  misc_feature (849)..(849): n is a, c, g, or t
cagacggtgtccgttcgtgtggggtagggcggaggggtggagggccgtctcttgtggttgcgtattgttttctcttcttccctccacgactgtctgctcgcgatctatagtgctgtttggttgtgtggaggggaggggtgtgtgttctgccctacttgaggtgagtttggggggatgatagtgaacccagtgtagtttgtgttgcttttgtattgtgcccgtcccaatcctacggggggaggtgggttgttttgtttgttgtgtagggtgtgtggttggtttgtttgctcggcgccgcgccggtgtcggccagtcggttggtgtgttccttgccctccatcagagtgagtgttggttctgcggtcagtgcatcaagcgtggtgtgggttgtgtgttagtgagctaccctccccctgccggctgtgtggttttgttgcttgcgtgcggcgatcatgcattgatggttcgttcttcctctgtagggaggcaggggtcggcctccatcagcagatgtattataggcctacgacgtcgttgtgttggtaccgcctctatagtggttgaggcggggcgccaccacgcgatgatgttgtgttgctccacattctcgtggtggtggtgtcgccggcacggcgcgcgaacggtcgttgctgctcccatcgacggcgcggtgtgctccctcacactctctcacacaccgcgcgtgtgtgttttttgtgtgcgcgtgtgtgtgtgtgtgtgacgccccacacgccgtctctctctctggtccatctctctcacgcggcgagtgtgtgtgtagcgcgccacactcgtgctctctatgaggagagagcacacacgcgggtntatagagagaatatctctctctggagacacacactcttcgtcccagcgcgcgccctcgtgtagagagagagtgagataagcagcacgcaccagcgcgcgccccgcgagtgtgtattgtgtggcggcccgccacctctagctctcccacctctctgctgtgtgtgtctcctctcggaccacctctcttccacctctccacgaccccctgcgcgctgtgtgtgaggagaggacgacccacactggataaaccaccctctgtgtgtctctatagtaaacccctgtcttcttctgcggtgtgttgtgtttggtgagagtgaatggtgtgggacacactccctctataaagagagtctataaaacaccacaaggagaaaaccacctgtctttggattgttaaatatatttgctcacacttattttgtatttttcccgagggagagacttctttattaaaattcttaaagggacaaaaata

SEQ ID NO: 633219 - DNA, 545 bp, Homo sapiens
attgaagccttccggaatgggacaagatacagaggtggaggctagtgatattgatgatcttgacactgtgtaggcctaacctaatatgtgtgtttgtgtcatagttttaaataaaaaaggttaacacataaagaaaaaagaaatttttaaataggaaaaagcttatagaataaggatatgaagaaagaaaatatttttgtacagccatacagtgcatcattttaagctgagtcaaaaagttaaaagtttataaagtaaaaaagttacagtagatagattgcctaagtatatagtgtttataaagtctacagtagtgtattgtaatgccctaggccttcacattcaattaaccgctcattgactcaaccagagcagcttccattcctgcaagctccatttatgttaagtgtcctatgcagctgtccattttttaatcatttatacaatattttaatggtatcttttctgtgttgagatatatttagatacacaaatactaaacattttgttacaactacccatagtatccaggtacagtaacatgc

SEQ ID NO: 633220 - DNA, 795 bp, Homo sapiens
agcaatgtgatggtggcatctcactggtgaaatgtcgaatgtgtgtgtgcggtgcctgccgccgaggcgggttccgaagagacctcagcatgggcatggccagggcctacgcgaacgcccacccttaagagcgcggggacatgggaacatggagctgttcctcccatgccccctgacgtctgctggtgcccatgtgtcccctgtccatgtgctggtttggtgctgcactgctgctgtgccccaactctgccctccactgctgtgcgtccccctgctttgtccctgccccctgtgcctgggaagttcctggctgggcggatgcttgtggcctgtggccctgagcggatctgctgtggctcggggctgcgtgtggctccgtgcgtgcgtgtgctgctggtgcctgctgaaggcgctggagctttggggagcggatgcccatggcccgtgcccggcgctggcggccattggaatggggcccatggacggagacgttgggggctggcagcacagggaatagaggcgctaggcaggcgtaaacgcccccggagataagagccccgatgcggcgcaagagagctcaagggatgcacaggggcaaaatcaggtcatggttccggtggcgccgccgaaaagtaccccggggaaggacagggcgggcatgcatacagagctcaggagcgaattcacccgggaaccccgcttgggtggccgtgtattaacacccaagcggggccttgtagctcacctgaagatgcaagagcaaaagaaggactggaagagattgccgggcgcctg

SEQ ID NO: 633221 - DNA, 198 bp, Homo sapiens
gaccgatgagcagtatgacacgagcctacaagatcatcagcactgcctcctgcaccatcaactgctaagcacccctggccgcggtcatccatgacacctttggtctcgtggcacaggctcatgcacacagtccatgccatcactgcccaccagaagcactgtggctggcccctcctgggaaactagttggctgttgat

SEQ ID NO: 633222 - DNA, 140 bp, Homo sapiens
ctacgactgactggtgctgtacacgctgaagcgtgtgcgccatcactgtgcccgggctgcccgggtcatgcacgatgtcttccagcacattctgttcgcgcagcagtcacatgctatgtaccgctatctgagagtgaggc

SEQ ID NO: 633223 - DNA, 406 bp, Homo sapiens
  misc_feature (65)..(65): n is a, c, g, or t
ataaatattatacatttaatataatgtattaaattatatctcttcctcaagaaaccacaaatagngctcccatgtgatccagagttcccactactgggcatctatccacacgaaaggatatcagtacattgaagagacatctgcacccaccatgtttattgcaggactgttcacactagcaaagagatggaatcagtggtgttcagcaacagataagtggataaggaaaaggtgccatatatacacaatggaatactattcagccataaaaaaacatggaatcttgtcattggtggcagcatggatggaactgcaggacattatattaagtgaaataagccaggcacagaaagttcactgcgtgttctcactcatatgtggaagctaccgggttctccatatgagt

SEQ ID NO: 633224 - DNA, 460 bp, Homo sapiens
tcagattatcccgaaaaactggagtccgatgtttgaaggcaggaagcatccagcacaggagatagatgaagtccagaagactcagccagtctgtccttccacgttcttctgcctgttttattccagctgcactggcagctgattagattgtgaccactggattgaggatgggtctgacttgttaatctcctttggcaacatcctcacagacatacatatggaggaacaatactttgcatccttcaatccaatcaaattgacacttgatattaaccatcacaatagctcactgcagccttgactgcctgggactcaagtgatcctcccacctcagcctcccgagtagctgggaccacaagtgtgtgccacgcccagctaatttattattattgtttattttattttttttagaaatggggtatcactatgcttcctaggctggttttgagtgtgattctgg

SEQ ID NO: 633225 - DNA, 714 bp, Homo sapiens
  misc_feature (40)..(40): n is a, c, g, or t
  misc_feature (74)..(74): n is a, c, g, or t
  misc_feature (91)..(91): n is a, c, g, or t
  misc_feature (98)..(98): n is a, c, g, or t
  misc_feature (105)..(105): n is a, c, g, or t
  misc_feature (109)..(109): n is a, c, g, or t
  misc_feature (119)..(119): n is a, c, g, or t
  misc_feature (126)..(126): n is a, c, g, or t
  misc_feature (128)..(128): n is a, c, g, or t
  misc_feature (132)..(132): n is a, c, g, or t
  misc_feature (146)..(146): n is a, c, g, or t
  misc_feature (162)..(163): n is a, c, g, or t
  misc_feature (170)..(170): n is a, c, g, or t
  misc_feature (179)..(179): n is a, c, g, or t
  misc_feature (187)..(188): n is a, c, g, or t
  misc_feature (193)..(193): n is a, c, g, or t
  misc_feature (196)..(196): n is a, c, g, or t
  misc_feature (207)..(207): n is a, c, g, or t
  misc_feature (223)..(223): n is a, c, g, or t
  misc_feature (238)..(238): n is a, c, g, or t
  misc_feature (250)..(250): n is a, c, g, or t
  misc_feature (260)..(260): n is a, c, g, or t
  misc_feature (297)..(297): n is a, c, g, or t
  misc_feature (301)..(303): n is a, c, g, or t
  misc_feature (339)..(339): n is a, c, g, or t
  misc_feature (347)..(348): n is a, c, g, or t
  misc_feature (366)..(366): n is a, c, g, or t
  misc_feature (714)..(714): n is a, c, g, or t
gactgtcggatcagaagtccaatggagctgtgggccaggnagtccttgcgaccgatgttgctgacctgcttggnctgcatagcctcgggtntgggggngttagtnattngttgatccangttcccncngatngtacagctgcgttnttttccaatgttcagnntggtttnatccccgcnatgtagcnnctgcngcntgggtggtatnttttgtttggtttttngcagcagcgctttgnggtccattagcnctgattcatnacacgctttgttgatgaaggtagtggcgatgtctgtntttnnngagcgctcggtgtggccaatccggtgtacatagttnttaatctnntctggtatgttataattnatgatgtgctggatggtagggtagttcaggtccttggtggtaacgtctgttgctactaggacatctttcttgctctctcggaatgtttcgatggtcttagtccgttcttcctggtctttgttcccatggatggctacggcctcaacccccttgagcagcaggtactcgtggatggcgtccacgtctgccttcttctctgcaaagatgagtacaggcgggggtgtcttctgcaggcactcgagcaggtacaccatcttggcctcctccttcacatattctacctcctggatgacatccaggctggcagccccagcgcgccccacattgatggtcacaggctttacaagn

SEQ ID NO: 633226 - DNA, 270 bp, Homo sapiens
cattcaaaattaaatatccatctaataacttttcgctgctctaaaatgtacctgaaatgtaaaagagggtcttcacaaggtaggtattatcctgaacttgacaaagaaggcaatccaacttataaaaacaggaaaccaagcacacagggcagtgcacagaccataatctcactctcttggagtctagtgcgcccttcccctcttttgtctgtctcccagtcagcagaaacacagctagctgtagccctgggccaggtccctcgtcgacgc

SEQ ID NO: 633227 - DNA, 506 bp, Homo sapiens
ggagcggccgtcatttttttttttaatttattattttatttatttattattatactccatctcactctgtcacccaggctggtctcaaactcctggactcaagtgattttcccaccttgaccccccaaattactagggatcatagacatgagccaccacacttggccactccatagctttttaaggtcttgtttataatggagtggtctggcaagctctgttgtatacatacaaatctagttctcctgaaaagtctcacagactgatacttttgactcttaagagaaaatgacaatgaactagaaatcatttttttttccaagagctccatcttccgtagtatagaaaaaaataattgattacattagcttcatcagtgtaccttttgaattgaactatatctcctaacacaaaactcagagactgatgaaatgccaaaagaatttgaaggtgacgccatgttatctccggatactaaaagatagagagaggaaataattatggca

SEQ ID NO: 633228 - DNA, 269 bp, Homo sapiens
ctagaggttcccgagctgatacacccgaaggagattattgtcttcccctctttccaagagctgagacagaagtaccacgtgcgatccattccatccgaaaggatgatgaagttccaggttgtacgtggacactataaaggtccgcaaattgggcaagtagtcccggtttaccggaagacatatgttatctaccttgaacgggtgccgcgggaaaaggctaatggcacaactgtccacgtaggcattcaccccaaccaaggtggtataag

SEQ ID NO: 633229 - DNA, 187 bp, Homo sapiens
  misc_feature (69)..(69): n is a, c, g, or t
acgtgtgtttgcagcatgtgcgagtgtgtacgtgtgtaaatgtttgggtgggtcttggtgtgttagccnccttctcatcggaagagtgagttctggatgtggaggaaccagtaggagacctggttgtttggttcccacaatagtttcaattttagttgcccatattaaaaaatctagacatatttca

SEQ ID NO: 633230 - DNA, 139 bp, Homo sapiens
aggggaaaacaacggccaggaaatccccaatcttgggcttggcggtttccggggggaaaaccaccttcaagaaaacccggagcttgggggcggggggttccgggggggaaaacaaccttggggaaaacttggaatttgg

SEQ ID NO: 633231 - DNA, 412 bp, Homo sapiens
cctatgtggacgccagtttctgtcctgacattcactagcagcttgaacttcattctgtggtttacttctgtgtcctccaattttcttatccataaggcaggacagaaacagatagtccacctcttagagttattgtgagaccacatgagtgaaggcctctcaatggctgtaagtaatcatctgtagtcgctgttactatttgtataacttgcacaaagttatatatttctaaacatttataattgtgtggaaatatataggaaacagttaaaaatatggtaaactgaaaaacagtgccttctagaaaagggacaggggttggggacatggagggcaagatataggaagctacttttttccatctttttttaatgtattgtggtttaggaccattatctatgatgttgctctt

SEQ ID NO: 633232 - DNA, 299 bp, Homo sapiens
ggtcaatgtcacagtccaggcccttggtggagatgtgctccatgaccatgtcgaggacaatgatggtgcctgtgcggccgatgccggcgctgcagtgcacgatgatgggccctgcgtaggcaaactttcctgccgctggttgatctggtccaggaagctggggacaccccaaggctcagtggggacccaatggtcgggccagctaaggtactgggaatgccaaatctcccgagtcaggtctccattgcccagcggggaaacctgtaaggtccggagcctagtttcggttgtgtcatgct

SEQ ID NO: 633233 - DNA, 201 bp, Homo sapiens
gtttcaaaattttctttttgattgatttttgaaaagaaacacgcatggcaaagagttatttgcatttacatgttctctgcagcattatgcacaatagccaagatatataatcaacctatgtgtgtatcaatggataaatggatttttaaaatgtggtatataaatgcaatgaaatgctattcagccttagaaaaaaaaaaa

SEQ ID NO: 633234 - DNA, 136 bp, Homo sapiens
gctcatagaaagcagacagcaatgttagtgtaccagctttaaataacttacaaagtcaatgtcatgcaatgtaagtgctatctgaaagccatcacttcagtgtttgctagcagcccccaagctggtgataaaaaca

SEQ ID NO: 633235 - DNA, 153 bp, Homo sapiens
tctgattctatagtctttgtcatgatgctagaaacaaactgctggctgtcttgggatgcgcccagctttgagaggccactaccaccatgaacttctgccattcactggacatgaagctgaggacactgggcttcaacactgaggggtaccgag

SEQ ID NO: 633236 - DNA, 453 bp, Homo sapiens
aagtttttatttgcataaaaaagaaagaagccggctcatggccacgtttactttcacagaaaacaaaatgcccatggttaaaaacagattttaatcgctggaaggatgaggatgactcagaacctgatatggatggaaataacttctcaaatatgctgtctcagatgtccaattttggtgactatggaggtgatgatggtatagacggtcatctagattctgacgatgaagacctccctgatttggaaatgccaaatgcagatgctaacaaatctgaagaaaatggaaccgaagaagaagccgaaaaaaagacacctgaaaaggaagcttcatcagctaattgagaaatgacctatcattcactcggtggttgtttgtctgtgagccgcctgtatatgcgcattttacactttcaccattgactatgttcttattacagccttttacgaggta

SEQ ID NO: 633237 - DNA, 323 bp, Homo sapiens
tgcatgattgtggggctccccagtcacgtggaactgtagtccagtaaacctctttctttcgtaaattgcccagtctatgggtacgtctttatcagcagcatgaaaatggactaatacaccgtctctacaaaaaaaattaaaaaattaacccggcatggtggcacgtgcttgaaatcccagctattcgcgaagctgaggcatgagaatcgcttgaacccgggaggcggacgggtgccgtgagtcaagattgtgccactgcactccagcctgggtgacagacgtgacgacctcccgtctccacacaaccacacccggggctcccc

SEQ ID NO: 633238 - DNA, 135 bp, Homo sapiens
cagtatgacatgagcaccgcggccggctgcagctgtcttttctaatgtcactagtacttttaatgatcagcattccaccgtgcttttctttttttctttagccccagttttaatttattccctcatgtcatacat

SEQ ID NO: 633239 - DNA, 788 bp, Homo sapiens
tggaaaccagccggggcgatttagtgaggccccatctcaaaaaaaaaaaaagggggggggggggaattgggctctgtttgggatgggcccggcccccaaaaaaaggggacttgggcccggacaggtggctttccacaaggcttggctttggcgtcaaaattgaagaagatggggggggtcttgtcataccctgtttcttcatacaagactccctatttggatgtgtaaaaaggtagctaattacctcacattgtcctcaaattcccagggtacgccatgtgataagacgtgggggtaacaagttgagcatgtttgccccaggattccaaatggtgcgtgtcctgcgacatgtgggaaagagacttaaggggcacccagtgagaagggcactgattcctgggctttaataagcgccacagggtcttcctagaacattttcaggggctttggctttgcagggacagtagaactccccaaaaaaagaacacaatttgggccttcttaaaaacattcagagacatctctcaaccggtgtgttttttaaaaatttaaactctcttccttttctttataaacaaaataaacaaaacataaagcaacacaacgctcgggggcgactctctagtgtggggggccggcgagacagaaagggggttataggaaagggggccctgtgggctactacgtggtgttctgttgaccccagttttttttgttgtcccaggggggcaatctggcgggggccccaataaggagaggcataattcgaaaacagcggtacccggtga

SEQ ID NO: 633240 - DNA, 111 bp, Homo sapiens
agcactgtactagcactattattattataattattattattatttgagatgagtctctgctctgtgccccacccgctaattttgatatttattttatctatctattatttt

SEQ ID NO: 633241 - DNA, 165 bp, Homo sapiens
gggagttagtgagagccacatttcagttcagggctgtgaggtgctgtcagaaagccgcagagagcaggtcggcgtgggtggtaacacatccagaggtcaggcacagcaagacctccctctttgtctccacagactccaacttaaagaccacagccacacagtcgg

SEQ ID NO: 633242 - DNA, 239 bp, Homo sapiens
agtcatggatgtcgaaaagtaggtcgtgtcatggatgtgttacttcatcctatctatcattaacatccatggcacaaagttatgccacacgaatccagcagcggttgaactcagaggagaaaactaaatcagtagagaaagtataaaactgcagaaataggaggtggatgggttctgccttaaatagggaggactccaagccgggaaggaacatacccttttccaacctgtatcaattt

SEQ ID NO: 633243 - DNA, 255 bp, Homo sapiens
gaaacaataatcaacgaatgaaaccccaaaattccaggtcgacctgtccttagtcgaggagatgttcctggcgtttagagaaagggtgaatgcctctcaagaagtggagccagtagaacctgaaaactgccaccttatcgaggaacttgaaagtggctctgaagatatcgatatactccccagtgaactgtctttcatctccagtgaattaaaatacccaggcatgccaaacttcgcgccagatgaaccagggaa

SEQ ID NO: 633244 - DNA, 933 bp, Homo sapiens
  misc_feature (346)..(346): n is a, c, g, or t
  misc_feature (356)..(356): n is a, c, g, or t
ttaggtacaccttgacaatatactgtgggtagagaataacagtggaatttaccaaagtatttagatcacaacatgctatggaaagaaatgttagaatatggagatgcaacatgacagacccgtacattgtggttgttaacggactaccattatcagcacgaactgtactttatattgaagagaaacagaggattatcctatttatgcacacatgacgaaatactgaaaaaggtttaccgcatcatgccagccctactcaatctaatctctttctgatggaatatacatccatgataagataccagcaggacagatgctggcattggccacagaaattcataatatngtactcatcncacttagtaatagtatgactaatgaacacccattctaggtcaattatgacctttttttattacacacaacttggtcatttccttattaggcttattaaaatcgatatatatttcatagaaagttattataaaagaatttctaaacttgcttatccttggcctaccccattaagagggaagctccatacaaggtgattattcaggattcaaggatcatcgccactgattggcatttagggcacagacactactattaaaaaatgagaggctcactctattgtgtaactggcgtgaaccagcactcactagggaagactactagagaactttcaaacgtttttgcatttcatagaggaggctacacagatgtatttcctatcccaccaacctgcgtgacagtaaagggggggaactgcttgacgcaaccccgccgacttttagaccgcaattcagcacatgttatgacacggaccgagtctgatggttccgaaacaaccatatttcaagactgtcgacagtgtctcagcaaagaagatctggctccctccctatggagatacatcggcccacgtcattg

SEQ ID NO: 633245 - DNA, 1346 bp, Homo sapiens
  misc_feature (1146)..(1146): n is a, c, g, or t
  misc_feature (1157)..(1157): n is a, c, g, or t
gcgactgcgcgcgcagggcctgagcgggcgccggagggaaggggaagcggcggggtagtaacagattatgggcaacagtccttttaattaatctaccgtcatcatggctaatgaggactgtcccaaggctgctgatagtcctttttcatcagataaacatgcccaactcatcttggcccaaatcaataagatgagaaatggacagcatttctgtgatgtgcagctgcaagttggacaggaaagttttaaagctcatcggctggttttggctgccagcagtccttactttgcagctttgttcactggaggaatgaaagagtcctcaaaagatgtgtaccgattctaggaattgaagcaggaatctttcagatacttctagatttcatttacacaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcagatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctatnggaggtgaaanggattcaatgatttttgatgtactgaatgctatgatccagttactaaacagtggacaactgtagcttcgatgaatcatccccgctgcggcttaggagtgtgtgtgtgttatggggccatctatgctttgggtggatgggttggagctgagatagggaacaccattgaacgatttgatcctgatgaaaat

SEQ ID NO: 633246 - DNA, 212 bp, Homo sapiens
gtcagttcctgcacttctgtacacatagcctggaggtaatctatacaatattttcagtaatattgtgcgggaaacaaggttttcaccgcactgactgtgacctgtcacaagaggtcaggaatggaattttcttccactgctatcatgtcggcgctcaaaaagttgaatttgggagcatttaggatttgggattttcgggccaggaaacaaga

SEQ ID NO: 633247 - DNA, 1022 bp, Homo sapiens
  misc_feature (822)..(822): n is a, c, g, or t
  misc_feature (833)..(833): n is a, c, g, or t
ttttttttttttatggtaagccaatgtttgtttttattttattggccattttgtcttcctacttctctaggtatagtgaacataggtgtgaataatgtccaggagttgattattgcagcagacatgctacagttgactgaagttgttcatctttgctgtgaatttctgaaaggacaaattgatccactgaactgcattggaatttttcagttctctgagcaaattgcctgccatgatctcttggaattctcagaaaactacattcatgtccatttcttggaggttcatagtggagaagagttcctggcacttacgaaagatcagctgatcaaaattttgcgaagtgaagagcttagcattgaggatgaataccaggtcttcttagctgcaatgcaatggattctgaaagatttgggaaaaagaagaaaacatgtggtggaagtgctagacccaattcgattccctttattacctcctcagagacttttaaagtatatagaaggagtatccgattttaatcttcgtgttgcattgcaaacacttctgaaagagtactgtgaagtatgcagatctcccaaagagaacaagttttgtagttttctgcagacatctaaggttcgacctcggaagaaagcaagaaagtacctgtatgcagtaggtggatatactcggttgcaggggggtcgctggagtgatagcagagccctcagctgtgtagaacgttttgacacctttagccagtactggaccactgtgtcttcacttcatcaggctcgaagtgggctgggagtaacagttctgggagggatggtctacgctatnggaggtgaaanggattcaatgatttttgatgtactgaatgctatgatccagttactaaacagtggacaactgtagcttcgatgaatcatccccgctgcggcttaggagtgtgtgtgtgttatggggccatctatgctttgggtggatgggttggagctgagatagggaacaccattgaacgatttgatcctgatgaaaat

SEQ ID NO: 633248 - DNA, 191 bp, Homo sapiens
cggggccagagactggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgccccagactctgggccccggggtac

SEQ ID NO: 633249 - DNA, 238 bp, Homo sapiens
tttaaaaaaaaaattggggatttttaaagttgaatttattggcttttttgatccagttttgtttggcccaaaaaccagtattggccaaagtattaagcatatttttttatttttactaaaatgggctggggggcctttggataataaggaaaagtttaattttaaacccatgttttttccagtataattaacatgttaaaccatgggataaatgcccccaataaaaatttttgcctta

SEQ ID NO: 633250 - DNA, 460 bp, Homo sapiens
catagcaccacgttctaagaactcacaaggttatgttaccctcaaaaaaatcctaggaacaattataattcccatatttcaaaatagaaaaccccagtgcacagcagcaatgcagtctgcccaaggtcatactacataaacgaagaggtgtcaaccaactccaactggggctcttaaccactcaccaaactgtttctctttctgtgccatgttacagaagaatctacaacacactgaatgaagaagaaatgctgtgggatagcatgtgtgtttgaattgaacattaccatttctatttgagaaaaatattttttctttgtgtgtgtgtgtgtgtgtgtgtgtgtgtgtgtgtgtgtatatatatattttatgcacccaccatttattgggtgcctgtgtgccctgcatctcgggtgtgaagccagtccaccggggctctgttctcgcaagctgttgtgtg

SEQ ID NO: 633251 - DNA, 190 bp, Homo sapiens
ggagggcccgagtaaacgtcttcatgtaccaggctcctgaaaactacggccatggaagcttggagctgctggcggatgtccagtttgccttggggcttcccttctacccaggctatgaggggcagttctcttctggaggagaagagcctgtcggtgaaaatcgtgcagtacttttcccagctggctcaga

SEQ ID NO: 633252 - DNA, 432 bp, Homo sapiens
tgctgtgactatattgtgagttacaggccttgcaaatttggcatctcactggtacaatacaacaaccaagatatataataactgtacagtgcctagacttccagtaagaaccattatatctttaactgtagagtgattaagtacatatactacaaggggcagtaaggtaagtaattctatagggtatgtcccgacataatatacaagatgtacaataccacaaacaacttcgttaaggccatgtcttatttgctgataaatggacaaaaggcaatgtaatgtatttccaagtactgccttgacagtctgtgctcataacaatcatgacaagtaggaaagactgtcaagtcactgcactttcaaatatatcttagacaatcgtggtctggacaagactacaagtcaagtataatcttaaagcaatcagtggca

SEQ ID NO: 633253 - DNA, 108 bp, Homo sapiens
gaagtgggcagcacagcccttctgaagtgcggcctctcccagtcccaaggcaatctcagccatgtctgactggttttacttgtccacaagtgagaagcggactgctca

SEQ ID NO: 633254 - DNA, 90 bp, Homo sapiens
actgaggacactgccgtttattactgtgcgagagataagttgtattgtggtgtgcctcctgtcatcctgggggactactggggccaggga

SEQ ID NO: 633255 - DNA, 107 bp, Homo sapiens
atcttgatgctgcgtgtgtcccatgagatatccaagtagactatccagctggccagtatctgtattcgtctacttggatatctcatgggaacacattatggagggga

SEQ ID NO: 633256 - DNA, 1384 bp, Homo sapiens
aaaaatggagattctccagggacccttccgtatctgcctaggcattttgctgtctcctcctaatacgctgttgctgtactggacacttgctcccatctactctcttctctggaatccacggggattcctaaggatgtcaccacagtgttggccagatgcacaggtcacaggggactgaacctcatcaccccacaaacataccattcaggttttgccaagaatgacactgtaaatgtaacaaagcttctgtgcttgttagtgaacaccaactcagctcctctcctgtattcagaaatcaggatgagatgaaaacaacaagcaggccaggcacggtggctcatgcctgtaatcccagcactttgggaggccgaggcgggcggatcacctgaggtcgggagctcgagaccaccctgatcaaaacagagaaaccccatctctactgaaaatacaaaattagccaggcgtggtggcaaatgcctgtaataccagctactcaggagctgaggcaggagaattgcttgaacccgggaggtggaggctgcagtgagccaggatcacaccactgcgctctagcctgggcaacaagagcgaaactctgtctcaaaagaaaaaaattaaaaataaaagaacaaggaaacaaaagtaacaaggcttgaagccagatgagcctgaatctaagcaagaaaagcccagaagaaatcccattttgggtcactggctgcatggtagtaataccatacacataagggaagagaggaggatgtggctttcactttgaattttttgagcttaaggtaacttttgcgtagctacaaagaagaattcaacagagatttaaacctacgatggaaagactgaaggggtccaagctgtagagaaacaggactgcaaaccacaaagggcagaatcagtcaaggagagcttcagggtgggatgaacagggaccaatggaacatttggacaagctgttgagaagaaaggaaaattcagagaaaaagaactgtcagtgaggtcataataggaactgttacagtgaactaaatatggcctgggaaggactctgtacttctagatttgagtccctgtggacgaactgcaacctaacttaataggtagaaagactgataacctaactttggagtatgcacctgtaactatagctgagtcctggccaatcccaacagccaaacttctgccactcacacactgctgagtgttcagctgtgttcaaataaggcaaatgctgagcaccgtaaccagtccagttgtttctggacctcactgctgagaactgtaacggacccagttgcttctggaccttactcctcacttcagatttctgtacatcatgttccctttattacctataaatcttccaccatgt

SEQ ID NO: 633257 - DNA, 148 bp, Homo sapiens
agagtagatggacagaggctgaggataatgtcattatttagactctgttctcaagaatcagtaggttctatatgccgtatatgttagatatcttctacttggcgaatactgccagcaataactaataagtactcaccaccattcagcg

SEQ ID NO: 633258 - DNA, 271 bp, Homo sapiens
agagccatatctttttcaacagagatctttaaagatttggataccgcctattttggttatatctaagaaattgtacctccattgcattcacagacacgtttggcctagacacaagattatgaaaaatcctcctcctcttaagttggatccgtaacatcaagcaacttttggaaatgatattgtttaacaaaacaaatggtttggtagaaatccatttcaaaagcaatgtttcttccacaaacaaaactctcgttaaacagaagcatcttgg

SEQ ID NO: 633259 - DNA, 887 bp, Homo sapiens
caggtgtttgcctgagatggcccgcgatatgactctgccgatacccgataacgtggctcgtcaggtttcccgtgccgaagtcgggaccgtatttttgtggtcggcggcaagctgctctggctgtgtttgctgggcgtcgcggtactgctgccgctgctggccatcttctggcgcggcttcagcagtgaagccgggcagggcggtggcctggtggcggcgcgggaactggtcaccagcgacaacttccactggttgctgggtaacagcctgaaggtttccggcagcgtggcggccatcgtcgtaccgttggcctacctgtttgcctacgccctgcaacgcacgttgattccgggcaaggcgatctggcgtggcatgtcgctgctgccgttgatggcaccgtcgatgctgcccgggattgcgctggtctacctgttcggtaaccagggtatgctgcgcgggctgctgtcggacaacatctatggcttctggggcatcgtcctcggcgaagtgatctacacctttccccatgccttgatgatcctgttgtcggcgctttccctggcggatgcacgcttgttcgacgccgcatcgagcatgggcgcgagtcccgcccgggcgtttcgcagcatcacctggccggcgacccgccaggccgtgtttgccgcgttttgcctggtgttcaccctgaccatcactgacttcggcgtgcccgtggtagtcggtggcgactatcaagtactggccctggaagcctacaaagccgtggtcgggcagcaacaattcggccgcggtgccttgatcggcatggtcctgctgctgccggcgctgttcagcttcggtgtcgacgcctggctgcgccgccgtcatggcgactccatgagcggccg

SEQ ID NO: 633260 - DNA, 231 bp, Homo sapiens
  misc_feature (10)..(10): n is a, c, g, or t
  misc_feature (19)..(19): n is a, c, g, or t
  misc_feature (135)..(135): n is a, c, g, or t
ggcacgagtntgccatgtntggagagttttggttgttgcagctggaggaggtggtgctactggcatctaatgggtagaggccacggatgctgctaaacatcctacaatgccccggacaacaagacaaagtaatgntccagccccaaatgtcaatagtgctgaaagtgagagaccctgattccatcttagagcttagagatcatccaagcacatttggcccaaattgttttt

SEQ ID NO: 633261 - DNA, 119 bp, Homo sapiens
tttatagtgctcctactaggtgctacttactttaggggcactcttaacaagttcttgttgattcacagatctaaaattgattaatgaagttttcatcattgaaatagaccgctttaccg

SEQ ID NO: 633262 - DNA, 452 bp, Homo sapiens
  misc_feature (28)..(28): n is a, c, g, or t
  misc_feature (32)..(32): n is a, c, g, or t
  misc_feature (34)..(34): n is a, c, g, or t
  misc_feature (110)..(110): n is a, c, g, or t
atcctcggaaggcaactgcaacagcttntcananttgggcataccagaagcttcactgagaaaatgatgtttatattatgacgagtatgactcagctagactcgagtgtngggggaagaacaacatatgcaaaggcccagaagaagtgagaacacggcatatttggggatgctcacaaaagctaagtcagtatggctgtgtgtgttactctagggttagggtggggtactcaaggatgacccgagataaggctagagaggaagggccaggtcacataagatatgttcgagaatctgtctccctccctgccaccaaaaccttgtcaatagaaagagttgggaccatatcctgggatatgcaccaaactattaaaggtagctttccctggggagtgagagtgcatagaggtggagggatttcactttattaaatattcccatgctggcatggtg

SEQ ID NO: 633263 - DNA, 1336 bp, Homo sapiens
ctgtgcctgtgtttactgctcgtgcttctggtatgtcggggctccatacacggtttgattccccccccgtgtgtttcacaacctacgaggtttccccctcgttctccttgggggttttgttttcccccctggctttttttttgctcactgtcattctccgtccctcttctcattttttatcccccgggcccgccccgtgtgtgctcgtacctcgctcgtgtcccccttagggtgtcccttatttcccgccccccccctggtgggcctcaagggaccccccctgggccaaaaacccgtatatttttcttttccccacgtgtggccccccttttttctctcccctttgtgtggggtcttttctttatagccctccccaagaaccttgtttgtcgccccccaagaacccaggtgtgttacccgcgccccagatctcgcgcccccttgaggacccagccgttttgagcctgttctcgcccgaggaaaggtggtccccctctgcacccgccatttcctcttcgccctctgtcccaacctctgtgtaaggcttatatctgccccgcgttccccccttgagggtttgcgccctcgccccacctcccccacaagggggatattggtgccgcgggagttttggagaagagaaccctcgttgcgccacgcgctctctcttgtggcccctcgttggttccccgctctccccgcgccctcgcccccgcggagaaggcccccggagactccgcgcctctcgcccccaagggccccctctctgcgcgtatgtgtgcccctcttctctctttctgagagggagaattgggaaaattttttgttcttctctggggtgccaccgctaaagggccacgcaaaatgtgttcccccccgagacaccccacgctggtgtttggagattttttaacacactccaccccgtgagagttctgtaaaaaggagccccccaccgcgtgttgtttttctgccacgcctatttttgttctaagacctcttggccacgctcccctcgggccctcggaactcgagattggaaccacctcttgttttttctcccctcgggccactcttatccctctccaccctcttccactcctcgcctctttacccaccccctggagtgagatggagttttgtaatttctagctcgttgtattttgtgaaatttgttaaattttgttgttttttctgtgaaaacacacacaaccacttggaatatatgggaggtaaaggagtgtcccccttgctcctggtcacctccccttatagcccttactgtcttgtttcttgtaaactccggttaggttttggtctctcttgctccccccgc

SEQ ID NO: 633264 - DNA, 274 bp, Homo sapiens
ccagctctactaaagatcattgagacacttctcgactagtatacaatcccatcgataggcattgtgcgtcacactagtgcagtcatatatttctcactgtgatatttaagctcggacccgaatatttatctgtccttcaaattcactgtgcccactatatgcttcgaaaggcctcatccctctgtttcagccctgagagaggagccatgatccttgtttggtctagctgaattctgttaggggagtgtgccccatctcatcatttcgaagatag

SEQ ID NO: 633265 - DNA, 258 bp, Homo sapiens
  misc_feature (10)..(10): n is a, c, g, or t
  misc_feature (49)..(49): n is a, c, g, or t
  misc_feature (61)..(61): n is a, c, g, or t
  misc_feature (63)..(63): n is a, c, g, or t
  misc_feature (121)..(121): n is a, c, g, or t
  misc_feature (229)..(229): n is a, c, g, or t
  misc_feature (236)..(236): n is a, c, g, or t
tactgtgacntcaggacacctcagctatttaatacacttcgcatccttngtctccatcagngnccactctcagtctggaatgactaccctgaagacaaatatcatactgtgagtgttcatnaaatgataagtattatcatcttcaaggcataacctgagccatgaagagcaggtagagctgagattggcaaatcagggagaacgctggcctcctgcccttccctgtgtnctctgcnctgtcttgagactcaacaagtc

SEQ ID NO: 633266 - DNA, 572 bp, Homo sapiens
tcaataggtgcatctcgattcacgaaagtactcatcaagtaggagcgtccagaggaacgttggactgacggtcttgaagacattgcaaaccagtcaagcggacccgtaaaattattcctcagagaaccaataaagaggtggaagaaggcgctactgttgctacgggatgaccgggggagccggaatggggagaggcgcccgtggtcaccagactgcaggtgtactagggttacagactcatgataccgtaccccagacagctgcatacattaaatgttcgaggcacttgagtttgttgaagtccgggggccgtctaaacaggctgtagagggagagcaagtaatccgaagacataggatctcttgctgttgcccaaggtggattgcatcgacatgatcttgggtcaccgaagtctcgatctcccaagtatcgaggcaccataagtgatcctgaggtaatcaggtgattctttcacctcagcctcttgagtaagctgggaccacaagtgtgtgccaccacacctggctaattttctttcttcttgatagagatagggtcaccccatgtggccc

SEQ ID NO: 633267 - DNA, 117 bp, Homo sapiens
ccgagcgctccgtaactgagctcctccgtaagagcgctctagaatggtttatattgggatcgcgatttttcttttcttgtgtggggctgttacggaggcgtcgttacggaggcgctc

SEQ ID NO: 633268 - DNA, 825 bp, Homo sapiens
agaatggggagaaggttatgagaagagcattattaagttaccaaatataactttgaattgccaaattgtacacctcagcaatgaagaatcgtcaattttatagagaaatgtatgataaattataagagatgtactaaagtgataggatagatttttgtattggagtttgcaagagatgcggattatatttgataggctatagtatgtagatatgccttcttaggaactattacagactgtaaatttatacttgagacttggcagtatctaaatgcttatattggttttaactgaaagagttatggcaatcgtcaaggttaatgggaaatatgtttgtaatatcccacaattcagagttttgaaaagactggtcttccaatgtgtaatttatagatgtcggtcactgtgttctatagcattaagatatgataaattagaccagttgggcatcctggtccttttgctaactgttccttggtgaattctgagcatttattctgatgacttaatatttttcactacctttggagaacagatgaacattgattcaccgatgaatggatctatactgtgtggtcatggagtggtgtatacttccataacactgtatcttgcttctgtcagtacccttaggagtacactttaaaacaccttaaggtctgagtgttatggcaagaaactactttttcagacctaaataggaccgatgtaatttctcaaagggtgattgcaacaggttagcccagaacttagttgtggggctaatgtaaacacatcgggtcaacaatcaaagtacacactggatttcacagacacaacaacacg

SEQ ID NO: 633269 - DNA, 415 bp, Homo sapiens
tgggtgaccttttcactagtgagcccttccttgtctatcgcatattgatcacggccagcctcaggatcaatcaccataacgtgtggcctttatcggtgggccaggaatggcagctggtgacaatgactgccatttacttttcattgtggcttatttaactcagcctctcagcaacctatagatgtaggggttaccacccccattatcacagattaaagaactgaggcccatggaaattaaggaaaacttgtccgaggacttgagctggtgaacaccaggactcccaaatgacagtctctttcctcctttaaccctgacttcctgtttaaactcaatcaaatttaccatcagtatcctcagtactctttggaaacaggcaggatacagattaatagccaggccaggcatatagtag

SEQ ID NO: 633270 - DNA, 225 bp, Homo sapiens
cataacagtagagacatgtcataaacaccagcacaggagacactgggtcccagtgcacattgcatgggtatactttgtgcacggactggcacgtgtcaggaaaatttgaagatcttgaagttactacctttgaaaggttaatgcagcatcaagttacactgggcagctgtgtaccccagaccgggccgtgaatcaccaccattgaagtgtgcgccggtgtgggca

SEQ ID NO: 633271 - DNA, 435 bp, Homo sapiens
gtctcctgtcatcttgtcgtagctgtctcccgcgttgccggctggccactgtatccgcttctccgagtaggctgtctcgcctcgctctcctcatgctattcgttcctgaccctctccacaggtggccggtcttccgtataaaccctatgctctgatcagagctcagcacgcatctcatccacaggatgggattagcgctcttcatgacactaccgagcactccttaaaagtcaccgtaatacctaatcaataccatacggcttagcatttaattattatctatattgctttatgtgtggaataatggaaaagaattaaaagatcgaaaaaacaaacacccacctcactccacattaggtgtgtcaaaatctgagctgatgagaggccttccccaccaaagctctgagcaccaaatgagatgatgtagggaagcat

SEQ ID NO: 633272 - DNA, 82 bp, Homo sapiens
agcggagtgcccccggcggcccgggagtggaatcttcccccaaatgcgcccgcctgcatggaacggcagttggaggctgcgc

SEQ ID NO: 633273 - DNA, 898 bp, Homo sapiens
gatccgcttccggagtcgaggtttcgggcttgtacccgcttggggggcgcctgtgtcggttgcaggtctttctgtgtggttctcttgccctgcaagggcctgtagagctgggtgctgtggaggagttagcgggggctctccggagggagagccggcacggcctggtggcacctattggttcccacctacaaaaaattctccttcttgaaagggcctacacttgtggcgggccccatttaaactcattccggccttttggccctggggtttggctttgcccccatttcggcgcggtccaaccggattgggtgcctgccccacaaacaagggttgctcccagggagaatgggccgtgtccgaaagaaagcaaggtggcgcttctattattgatccacatttgtgcccagagccaggtcctttggaacgaaacaatcctctggtgggccttcaaaacctaagacgagggattcgggcacatgtgtgtcttgggtctgcggggcgccacaaccttttttaaagcgctttatgttaaacaacgcttctggtcccggggggggggttttatcccctttctgggcattcctatttggttgtatcacaaatttgttgaggacgattggcgagaggaaaagggtgcaccggtgaaggtcttgggtaacgtttcttcaagagaaagcaggtttgcagacgcgttagaggacttacgaacggctacagacaacattaattggggtggcttgagtggacgccaatagcgtgtgggacaaaggtccaggtcttttggaacactggagggctttaattggtgaggttggggtccataatggggttttctaaaaaaaaaagaaacaaaaatatgtgtgcggtggctagggaatttaaccattgtggcggcaag

SEQ ID NO: 633274 - DNA, 134 bp, Homo sapiens
aggttgaggagggtcagtggtctgctgctccgtatcaagatagctgtatgttgagactctcacaaggccagatctgccgagtgcctgtcagatcccagttctcatctgagggctgctgcacctggaggccatca

SEQ ID NO: 633275 - DNA, 461 bp, Homo sapiens
  misc_feature (93)..(93): n is a, c, g, or t
cggcttctccttcttaagggttgggaaggtctgggggcaactctggggctcccctggggtggaaggagcctgttccagcacccttttcccaantgcattcccacgggtggccctggaactggtgagctttgtttgggggttgttttcggctggcattgctcctcccagctttggcccctttggtccctcaggaaacagtccccttgtttccctttttgggcagcttccttgagggcagaaacttgaaaacaaacccaaaccaaagtttttggccatttgtgggtggagggttttgaatgtcctctttccatgtcaggcaaagggtcagcccccatggttttgcctcaggcccccccccccccccccccaggcctgcccctcccctcagggccatacccccagcgccctgatggaggaaccagaccgcaggctgtgcccccctttaacaaaagcggctgtga

SEQ ID NO: 633276 - DNA, 117 bp, Homo sapiens
gggggggggggggggacccccccccccccgggggggggggggtttttttgggtaaaaaaccccccccccctttttttggggggggtttgggggaaaaaagccccgggtttttcccca

SEQ ID NO: 633277 - DNA, 834 bp, Homo sapiens
agcgggggggggcgggaggtgttggggccgttgaagcggcctccctcccgccccagcgccggtctggccccaaccctgtcccgactcgcggactggaccactccgaccctagccggccgaagggttccgctggacacgcaggcggactccggagcagccaagcccaatgagggccgcgcgcccggccgcacggtgctgacgagacggaagctccatggacacacgacgaggagcagacggatcaaaagcggaatcaaagaatcgattcaagaagagtataaattgaaacacacttcgacgtcttccaagagcaaaatgggaccagactacaaaagaccacacaccatgactaatggaacaatgccatgcactaaactgataaaaaatcacaacctgcaatttcccatcagtagaactcccgagcccagtccgaggggatcagatgaaccatacacataccaatacggaacagaataatgcaatgacctgcacatggggagaagaagcaattaaaacgacaattggtacataacaaaagggacacgaggaggacactcctgagacaccttcataaacaatcccacacaaccaaacacgagcaaaactaaccaccaacatcagatcaatcacaaggggacagaaaacagaaggacgcaacaagtaaggggacccaagaagaggaagcacaagtgagacaagaacaaaactgcctgactaaaacaagccaaggagtgacaaagcaaagctacaataccaactatgacagaatcatacacaagacatgaagaagcaaagcgaaaaaaacataatgaccagcaaacacaggaggcaccc

SEQ ID NO: 633278 - DNA, 1077 bp, Homo sapiens
agcgggggagagggaagggggcggagctagccggagccgcgagtccatttggggctgtgcttggcgcgtaccgtgcggtccctgtagttggagggacgggcggtcgcgcgggctttcccactcagccggaggtcgggagatgagtagccgccgcccggcgtcctctcgggaacagcggggtggtcctcgtagaccttctagcgtagggtggggagttggccaggtcggcagtgatctgcgtgggttgggggggctggcgaaggccgtctgagctccagtccggcagcgcgggagaaaccagcgggggcactgtcatgggcctggtggagagacgcggcctagcaggagggcgccgggtgcagctgtgtctgtggtccagaaaacctgctcacgtccggaggcttcctgggcccagctagcagcgtctccgacatcccctagaaaagaaacagacgggtgtgggcctggaggttacagcgcgccagcagcgtatggttgcatggcgccgggggagggtcgccctaaccgagaagctgcttattactaagagctccagggctcctgggcggttcaccaggtctaacacagccgggcttgatctggtgggggcgactgacagggacttgacgggtcaggaatggggtgctgtgccaataaatgcgttgatactgttcttttgcttcttactttgatgtaagcctctagattcgttagtcgaaagcgtgaaaaaaagagctgcttttggctcggggggaagtacgtaaaccctgccatataacattcaggcttgtatgcacaccagcagatgtgaatggaggctgttggaagcaagattccacatgagccagtatgtagagacagggatgaaggacacccgggggttagtgcccgtgaaccaccaaagaatgagcagaacaagtcttgaaggagaatcagaaggaagatgctgggaaaacctgatggcgaaccgagggcaagtcagaggtcacaaagccagaaagagaagttacggaagaggaaacaagcgaacagggatacaccgaacgggattgggcagaaatcaccacagagtctcca

SEQ ID NO: 633279 - DNA, 327 bp, Homo sapiens
  misc_feature (25)..(25): n is a, c, g, or t
  misc_feature (63)..(63): n is a, c, g, or t
  misc_feature (72)..(72): n is a, c, g, or t
  misc_feature (89)..(89): n is a, c, g, or t
  misc_feature (91)..(91): n is a, c, g, or t
  misc_feature (269)..(269): n is a, c, g, or t
  misc_feature (277)..(277): n is a, c, g, or t
tgaaatccgtgggctgtgtgaggantgtccatagtgggtcccaaacccctccctctgctggantttcctagnccttccccctccccaanantgtggcaagctagaggagcccctgccctccctccctgtcctgtgccaaacttctggggccaaacccagcccccttgagccagccctgccagactccaagcccaccctagaaccctcctcctgtgtggagactctgttgccccactttggacacagaattgcaacctgcctcacactcnccccctangctggggcttccatcttaatttattctcaataataaagacttcatgatga

SEQ ID NO: 633280 - DNA, 730 bp, Homo sapiens
  misc_feature (427)..(427): n is a, c, g, or t
  misc_feature (433)..(433): n is a, c, g, or t
  misc_feature (472)..(472): n is a, c, g, or t
  misc_feature (479)..(479): n is a, c, g, or t
  misc_feature (485)..(485): n is a, c, g, or t
  misc_feature (502)..(502): n is a, c, g, or t
  misc_feature (508)..(508): n is a, c, g, or t
  misc_feature (513)..(513): n is a, c, g, or t
  misc_feature (515)..(515): n is a, c, g, or t
  misc_feature (518)..(519): n is a, c, g, or t
  misc_feature (522)..(524): n is a, c, g, or t
  misc_feature (533)..(533): n is a, c, g, or t
  misc_feature (549)..(550): n is a, c, g, or t
  misc_feature (552)..(553): n is a, c, g, or t
  misc_feature (561)..(561): n is a, c, g, or t
  misc_feature (564)..(564): n is a, c, g, or t
  misc_feature (568)..(571): n is a, c, g, or t
  misc_feature (630)..(630): n is a, c, g, or t
  misc_feature (639)..(639): n is a, c, g, or t
  misc_feature (722)..(722): n is a, c, g, or t
cattcctcttgccatggggaagcttctgatgagagaaaggagccccacatccactgaaacatcctttggttctcaagcttcttctggaggcagtaaggaaaaataaaacccaccaaggctcaagaagggaactatagaaaagttcaggtttttaggctatagcagagacagtgagaaagcatctgggcctttctcttcctcttggtccaggggacctcattcaccaactagagcttggtgtacaggaacggggctcacagtgctgagggggcttgagtcccacctttcagcttgatggatgctcacctcttctcagccccagctcgtgccctgtttttctagccatagcccccagattactcacagctcctcatgccatttcctgtccagattgctatgtatgactctgcacctctcttgtccagtngctctngctgctcacctcctctcactgctagcaatattcaccaanggctttncatttngcgaagtcccttaccanctcctncttananctnntannnccatacatntccacactcccaactnntnnctctcccnctnaatnnnncctcatcattttcccattcttctacaaccttttccactctttttctccaccccatcacntttcatttnaattatcctttccccattttaatttattcatttttttcaattttcaacttaattccccacttcctttttaataatcagtatcnccttttaa

SEQ ID NO: 633281 - DNA, 355 bp, Homo sapiens
  misc_feature (21)..(21): n is a, c, g, or t
cgctgtcttacacaccacgcntctgcgttgaaagcggccctgtgcagctgagctcgactggatttgttgtagcagaggtagagcattttcacctgaggcgtgttgtgtggcgtagcccaccagtgtggtggttatgccggtaccggcaaaagcctgaaccagtagcttgtcagcctgtggaatgtgatgatggggcctgcttgtacttgtgtacactgcatgggcagctcctaaaggtataattagaagcttgaaacggtgattgtaaacggaacacacccaacagcacggcgcagggcaacagaatcaaaagggggctgatgctgatggggatgagcaggtagacgcgaccagg

SEQ ID NO: 633282 - DNA, 761 bp, Homo sapiens
ctagacggatcctctcggatgcaagtgtcgaaacagagcagaatgacgatagcccagaaaacaatgggcagggaaaatcctggtgatacacacagggtacagaaatggcatcgagcttttccaaggaagaaaagaaagaaagctgctacttgtaaacaagagcttccaaaacttatggatcttcatgggaaaggccccacagtggagaaaccttttaagtgtcaggaatgtgggaaaagcttcagagttagctctgatcttattaaacaccacagaatacacactggagagaaaccctataaatgtcaacaatgtgacaggaggtatagatggagttcagatcttaataagcacttcatgacccatcaaggaataaaaccatatagatgctcatggtgtgggaaaagctatagtcataacacaaatctacacacacaccacagaattcacacaggagagaagccctttaaatgtgatgactgtggaaaaagattcattcagaactcccaccttattaaccaccagagaactcacacaggtgagcagccttatacatgtagcttactgcagagaacactttagtaggcgctcgagacttcttagacaccagaaactccaagaagaagggagcatgtctagtgtctccaactgaggacagtacatgtaaagctgacttagaagggtgacgaatacaaatatgaggcccatggtaggattgtgatataacatgggaggtctgtacctcaaaaggacagggtgta

SEQ ID NO: 633283 - DNA, 91 bp, Homo sapiens
ggccatatattattgtgcgagagatattccatttcttacaatcggccagggaaccctggtcaccgtctccccagcatccccgaccagcccc

SEQ ID NO: 633284 - DNA, 452 bp, Homo sapiens
  misc_feature (373)..(373): n is a, c, g, or t
gcatggtcgtagtctaccctgcatagtggccattgaactggtcatctcctccttgacttcgtcccaggtggtactttgtcctcctgcagcaatcgggtcagtagtggagtggggtctagtggcactaacatcgattggttgatccagtggtggttcatgaactgagtgatggtcagcctctctgtggggtctgtcttcaacaggaggcggatcagctgcttggcatcctcagagacttctgaccactcaggattggggaagccgtactggcccaggcgaatcctcctcttcatccccggggagatggcctggcccgtgttggagtagaagggtgggaagccacaaaggaggatgtacatgatgacacccaggnaccacatgtcacatgacttgtcatacttctctggacccaggatctcaggggccacataatagggagtatagcagggtgt

SEQ ID NO: 633285 - DNA, 220 bp, Homo sapiens
  misc_feature (130)..(130): n is a, c, g, or t
tgttgggcatcacgtggcatcattgctatcttcacctttgtggaacctgtcagcgcctttgtgaggagaaatgtggctgtctactacgtgtcctatgcgtcttcgtgtcacctacctgatccttgcctgntggcagggacccagacgccgtttcccatggaacatcattctgctgagcctttttacttttgccatgggcttcatgacgagcttccgggat

SEQ ID NO: 633286 - DNA, 1011 bp, Homo sapiens
tgtgagtgttgtgttcggttcgctgtgtggttgtggcttgcgtcgttgacgcgtgtaatcttggtgtccgcgtgcggcgcggtgtggggcgtccttttttgccactaggttcttcgcttgcgaatttcggggttccccttcgccggttgtctacctcgcacttggtgttcacagcgtctgcctcttgtctataggagcgtccgccttggggccggccctcagaagcatgtgtcgtgattgtgtgtcgtcagtgcggcgtgggcgtggtggtggtgcgcgcggctcacgaaggtggttgtgttgtttgacgatttgtctcgcgcttccggtgttttgatgccccttggtagtcatttctctcccccgtctttagttcgctgttggcttcttcgcccgctccattactcgttatgacggcccttgaatctaaacagcagcgagggggtcaagcgtgtgccgcggccgtgagcatacaagaccaaggtggccccaccccaagtgtggcgtcaactaccacgggtatctccccgcttttgcgtcgcggcttattttcccaactgtccctacataatgtcccccccccgctatttttcctgtaaccctcgcgatcctgtcgagtcctcgatgccgtgtaacacctatcggtgtagttattgcgccgcgtctgtatgcccccccaccatctgttattataaattttcactcgaccaaaacactgttttcacacaacactaggactggtccgcccaccaacttatgtggcctttaacacaacagtctatatttccccggaccgtttatacacccaaccacccgttctccgccgacaacacacagcaccggggtatatatcatccgtcccaatagcttctgaaattccttggggcgacaaccccaacacgtttctcacacccacttcgctgccctataaataattctccccttaaaatttttaaaaagggcccctttttccccttcccccccctttcccccttttagggcccaaaaaaa

SEQ ID NO: 633287 - DNA, 163 bp, Homo sapiens
cgatctagaggatcccggtggagacgggggtccagtagacagtgtcagggtttatcacggtagctggctatcaaggagagtgaacatagtagggtatgctgaagattcggtagggtggctgccttattctggctgcagctctccagaaggcaccccggttcca

SEQ ID NO: 633288 - DNA, 173 bp, Homo sapiens
gctgaactgggacccttgtctaaagtagaagtggctaacgggtatcgccagcctacccaaagctgaagaagagctaatacatcccagtgccccaggaataagaggacgaggtgcgggttctgacacttcccctgcaagcccaccacgccatgtgcagtaagatggaagagttt

SEQ ID NO: 633289 - DNA, 384 bp, Homo sapiens
acacatatgcaatatcctatcagatacagttcagagatacatatacatgataccacaggacagcagtagttgttatcacagtgagttcaatcatatatgtatatctcttaagctccctgactatgctgctcgactttctctggcaaaatctcatccttggataaacccgaatataagatagttatgctcaatgacactactacactaatactttgctgccttatgtagtagcttcttactcagtacttacaccagttgggattgacacacacctctacagctgggattcaggagccagacagcagcacacagaacggggaatccaaagccatctctgacactgtacatttatacaacatgcctgtcatggttccagctgctact

SEQ ID NO: 633290 - DNA, 372 bp, Homo sapiens
acatgagtctagctttttttccagttctaaccaaacaaaataaaacctgcgtgcacagaagctgccactcaagtatttcctcacgcaaggcgaaccgctagtccataatccttctaatagctatccgtcttgcacacaatatactctccggacaatgaaccagtaaccaatactaccaatcaatactcatcattaataatcataatggctatagccatcaagctcggaatagccccctttcacttctgagtcccagcggttacccaaggcacccctctgacatccggcctgcttcttctcacatgaccgagactagcccccatctcaatcgtataccagatctctccctcacgaaacgtgagccttctcctc

SEQ ID NO: 633291 - DNA, 294 bp, Homo sapiens
gggcctaagcaggggggctgcgggcgcgcccaagcgagcgtaccataaattgggcaaatttacccggaagagaagtcggatgccgtggacgcaatggacttttgcagaaggtggcggaggaaagctgaagagcagtagagcgagaggcggtaattttgtgaaagggaggggtaagtgctctagacgtcagcttaacaatatcacgcagatgcaattagcatagcccactatcatatgcctggagtatcaggctaggcagggcccactctgatgacacgtatcggcgggtccctc

SEQ ID NO: 633292 - DNA, 328 bp, Homo sapiens
ttcacccttggcgttcttaccgctatttgggttagttcggaaatcactagcaggattaatggttggcgtagtttgttgtttgccattatttccaaacgtcagattatctgcactgtgaacactgactttagcattaccttcagcaccgagttgtaatgcttgaacgattgtcgttttggcatagcatactttttgtagcattagcttttttgttcagcaattgatttatcatagggggcctttgctttatcatattgtgcaagtgctgtatcgtaagcggccttatccttatcatactgtgctttagagcatcataggcggcctaatc

SEQ ID NO: 633293 - DNA, 224 bp, Homo sapiens
catttttaatcttagagcgaacagcctataatcactgcgcccgctcataaacgggatggccataggctaggtctatatgatagtaggggtggttggtgtaaatgagtaaggtaggactccgaggaggttaatcgtgagccaataaaaatcattccggcctactagtctatgagactcaggcttcggtccttccccgtatgttgtctggttctcagtttgtttgg

SEQ ID NO: 633294 - DNA, 685 bp, Homo sapiens
  misc_feature (31)..(31): n is a, c, g, or t
  misc_feature (115)..(115): n is a, c, g, or t
  misc_feature (140)..(140): n is a, c, g, or t
  misc_feature (174)..(174): n is a, c, g, or t
  misc_feature (188)..(188): n is a, c, g, or t
  misc_feature (196)..(196): n is a, c, g, or t
  misc_feature (230)..(230): n is a, c, g, or t
  misc_feature (232)..(232): n is a, c, g, or t
  misc_feature (251)..(251): n is a, c, g, or t
  misc_feature (262)..(262): n is a, c, g, or t
  misc_feature (265)..(265): n is a, c, g, or t
  misc_feature (271)..(271): n is a, c, g, or t
  misc_feature (279)..(279): n is a, c, g, or t
  misc_feature (286)..(287): n is a, c, g, or t
  misc_feature (291)..(291): n is a, c, g, or t
  misc_feature (319)..(319): n is a, c, g, or t
  misc_feature (323)..(323): n is a, c, g, or t
  misc_feature (327)..(327): n is a, c, g, or t
  misc_feature (350)..(350): n is a, c, g, or t
  misc_feature (357)..(357): n is a, c, g, or t
  misc_feature (363)..(363): n is a, c, g, or t
  misc_feature (372)..(372): n is a, c, g, or t
  misc_feature (386)..(386): n is a, c, g, or t
  misc_feature (461)..(461): n is a, c, g, or t
  misc_feature (592)..(592): n is a, c, g, or t
  misc_feature (680)..(680): n is a, c, g, or t
agaaaaaaactttcttgagtgtgcttgtttnctgtagcaccttggattttgtgatcagtcttttaaagatattttttaaaaaattcaacctctgtgttcacatttaggacagggnataagagtgtgttgtgctttcatgnaaatgagaggaaaaatttatacttgcttagtttngagcattgaaagcnctggcgcntaattgtgccatttgctcatgtgccacatgaatnanagggtacagcttagaaacnagggggttgcngcnattgtntttttttntaattannattnagagtattaaacacagttgagtacatcnatgnatanatgagatacggtgatgacatacnggaggcnccaatnaagagcgcngagcaaagctcgtnttcataacatcattaagattcattgtacactgcgtttcagaaaggctttgtcaaagcagataataatggcctgtnagaaatgcacaaacagaaatttatattaaattgtcctttccctccttttaaaatatgggaatctattaatagctgcattcccggtataggggactcaagtcttcagttaaaaaaaagtccccagcttcttnattattgtaagcttattaccaaaataagagtataaaaagttaagtgaaatatatttgagtacataggtgggggtattcctggggaatnctaat

SEQ ID NO: 633295 - DNA, 119 bp, Homo sapiens
tgtagttccactctagggatggacttatcccttgggagaagagtgaagttggtttcatcgccatgtgatgaagaccactgtgatttgtaaaaaagctagactatactgaaaactggcgt

SEQ ID NO: 633296 - DNA, 300 bp, Homo sapiens
  misc_feature (4)..(4): n is a, c, g, or t
  misc_feature (6)..(7): n is a, c, g, or t
  misc_feature (11)..(13): n is a, c, g, or t
  misc_feature (22)..(22): n is a, c, g, or t
  misc_feature (25)..(26): n is a, c, g, or t
  misc_feature (29)..(30): n is a, c, g, or t
  misc_feature (39)..(39): n is a, c, g, or t
ttgnannggannnactctcttntgnnccnncgctacagnttttgcttcccaaggaatggccttactgttcaaattcagatgcactaggcaagttcagaagacaagagtgaagatgagacgccaacagcctcacactgaggacgattctttctccagctccccactgcacaagcaagcttggtattcatcaatatgacatggtctggaagttttcctgtatattcatcagcttgggttactaaacaaagtacaaaataaaagcatggcctcgttggcctcagcggtggagctctgcggccg

SEQ ID NO: 633297 - DNA, 275 bp, Homo sapiens
tggtgaataacactatggctggaaaactacaaggcttgatgaaacgactggatggatggaaagatggatgactacgactaactgaaaagaccgatgaattaaaacgactggactggagggaccaggcacatgttgactcacacctgtaatcccaacactttgggagtgcaaggtgggcagcttgcctgaggccaggagttcgagaccagcctggacaacatggtgaacctccgtctctaccaaaaatatacaaattagccagtgtgtgatggtgg

SEQ ID NO: 633298 - DNA, 158 bp, Homo sapiens
agtcatcaggcctggggggcagcagagcttcaaacagctgcttactgcctcaatcttaaatatgaacacccatccaaggatacctggacatatgaggaaagcttccaaatggagacagcgactcacgagcaaaaagacaccacaacgtccgtggagga

SEQ ID NO: 633299 - DNA, 293 bp, Homo sapiens
  misc_feature (4)..(4): n is a, c, g, or t
  misc_feature (6)..(7): n is a, c, g, or t
  misc_feature (11)..(13): n is a, c, g, or t
  misc_feature (22)..(22): n is a, c, g, or t
  misc_feature (25)..(26): n is a, c, g, or t
  misc_feature (29)..(30): n is a, c, g, or t
  misc_feature (39)..(39): n is a, c, g, or t
ttgnannggannnactctcttntgnnccnncgctacagnttttgcttcccaaggaatggccttactgttcaaattcagatgcactaggcaagttcagaagacaagagtgaagatgagacgccaacagcctcacactgaggacgattctttctccagctccccactgcacaagcaagcttggtattcatcaatatgacatggtctggaagttttcctgtatattcatcagcttgggttactaaacaaagtacaaaatacttagtggctttagcaacataaatttactttctcag

SEQ ID NO: 633300 - DNA, 185 bp, Homo sapiens
tcccggaccaccttgtgctgtgctttacacggagtgctcttcttgcccaggccgagcgagctacatccccgctgcctgcttgccggacagtccggtgcttttgttgctggtttgtttttgcttttttttttcgacggagtctcgctctgtcgcccaggctggacgtcaggggagcgatctcggcc

SEQ ID NO: 633301 - DNA, 321 bp, Homo sapiens
  misc_feature (4)..(4): n is a, c, g, or t
  misc_feature (6)..(7): n is a, c, g, or t
  misc_feature (11)..(13): n is a, c, g, or t
  misc_feature (22)..(22): n is a, c, g, or t
  misc_feature (25)..(26): n is a, c, g, or t
  misc_feature (29)..(30): n is a, c, g, or t
  misc_feature (39)..(39): n is a, c, g, or t
ttgnannggannnactctcttntgnnccnncgctacagnttttgcttcccaaggaatggccttactgttcaaattcagatgcactaggcaagttcagaagacaagagtgaagatgagacgccaacagcctcacactgaggacgattctttctccagctccccactgcacaagcaagcttggtattcatcaatatgacatggtctggaagttttcctgtatattcatcagcttgggttactaaacaaagtacaaaataaaaaggagaggcgacaggtccactcctccgcggggaatatacgcgggagcggagttaggcgaca

SEQ ID NO: 633302 - DNA, 733 bp, Homo sapiens
tcaagattgacccatttgtgtatttttaataaaacaagctacaaatagtttccctctctccttcacaagggaaaaccacacaacaccacctacacacgacgatccgtgggggagacaagatgccgggggagatctcgaagatccaaacatctacaggcaggcgccgctctccagtggtgtgcatgcttcctccaggcctgaaagggggcgccagtgtctcgatgcagggcccactcagctccggcacgtgagtcctctcatgggggctaaggggagaaggcttccttcccacctttccacgtgggggcagggccaccagtcattcctgagataacctctaggactttctcacaggacagcagggacctccttaagccacaagaccccatcagatccggtcccgagaaggtaggtgctcctcccacagggacacgtgctggtggtgccaacagccttcaagacccggaacggggggcggtactcccagggatgtcgggtgggacatacaagatgaggccagaattggcaaaggggtgaccacagacggaggggaccaggcacagggctacccaagctccctcatggccaccacagcggcaaaggggacgggggcgctaagggcccactggcagcatctgcctgaaggccaacttgaataggcacagcaccggggagagggagctgcgcctacagaccaaaaggtgggagccacctaaaatcgcggagaaccgtg

SEQ ID NO: 633303 - DNA, 300 bp, Homo sapiens
tgtgttcagcgtacctttggcggagtactgcctgatcaccaaggctcaatggatcgcaggtacgtgccggatccgaacaaggcgcaggatctggagaagaagcgcgaaaaggcactgctgaaggagttcgagcagtaccagcaacacagcggccgcaagctcaaggagttccgactggaggtgctgcgcgccggcttcaaggacgcttggagcaggaaggactaccagaccatcatcaaggtcgcccagaagatcccggacgaggcgctgcaggaagacgagaagctgctgctctggtat

SEQ ID NO: 633304 - DNA, 92 bp, Homo sapiens
  misc_feature (33)..(33): n is a, c, g, or t
  misc_feature (86)..(86): n is a, c, g, or t
  misc_feature (92)..(92): n is a, c, g, or t
aaaaaaagggggggggggtgtttttttgggggnaaaagcccccccacccccccttttaaaaaattaaaaaggggaaaaaaaagggnaaaggn

SEQ ID NO: 633305 - DNA, 400 bp, Homo sapiens
  misc_feature (63)..(63): n is a, c, g, or t
  misc_feature (171)..(171): n is a, c, g, or t
  misc_feature (236)..(236): n is a, c, g, or t
  misc_feature (296)..(297): n is a, c, g, or t
  misc_feature (323)..(323): n is a, c, g, or t
  misc_feature (354)..(354): n is a, c, g, or t
gagttgagccgagccacaaccttagaaactttcaaatccaatgagcgagagagccactaaaanattaggagagatggagaaactgaggcctggaggaacacagtgacttgcacaaagacctcctctaagtccaagaccaggatgacaggctgtgtcaccttccagagcagnaaatccaacagtgcagtggaggtagccactgaaagctgccaagagcctcttgggacgctctctcncatgccctttcctgttggggccaggatgcctgcccttttgctaagccccatggctctgcnncccgttatgcttcttaaccttgcttncgagagttagctacagctgaaggctcgctcnctgctctactctcccttgggcgtggttttctacacgacctatagcg

SEQ ID NO: 633306 - DNA, 188 bp, Homo sapiens
cggtgagggcagacagttcaaatggcttgtagggagtagaatacagacgtgtactaccgatgctgcaccttacctctatcctcctccctgggcacactccccatcccagcctggtcccaaggacaggtggtcgcgtgagggtctcggcagcgggagaatctgtagcctagacatacacgtgagcatca

SEQ ID NO: 633307 - DNA, 367 bp, Homo sapiens
  misc_feature (213)..(213): n is a, c, g, or t
  misc_feature (242)..(242): n is a, c, g, or t
  misc_feature (332)..(332): n is a, c, g, or t
  misc_feature (348)..(348): n is a, c, g, or t
tggtcaacagactgcaccaatgacagtagtcccttgagcttatgatggagctgaaaaactgctatcacctagtgacatcgtaatgtagtgcaacacatcactcctgtgtttgtgatgatgctggtgtaaacaaacctactgtgctgccagtcaaacagttatagccagacacagtggctcacaactgtaatcccagaactttgggaagccaanatgggtggatcacttgaggtcaggagttnaacaccagccagaccaacatggtgaaaccccttatctacttatacattagctgggcgtgatggcgcacacccataatcccagctacttgnaaggctgaggcatganaatagcttgccccgggggc

SEQ ID NO: 633308 - DNA, 661 bp, Homo sapiens
cacgagctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcaaaagcccgagcggggccgggaaatgctccccgacgtatggtccctctccactctattttaaaaggctgaattctggttctcacctaagaggtttttacaatgggggttcaaattaattttaagaaaaaagggagggaggggacaataaagggaaggcaaacattgctgggacaaatctttaaaaataaaatttggaaaaattgtttatggaaaaatttaacttttaaaaatttttcccaactgggacaagtttaataaaatggtttt

SEQ ID NO: 633309 - DNA, 775 bp, Homo sapiens
agcggaggggccggggcgcgggcggtcggccgtgtggtgcggctagagcggtgggacagcgcggtgggctggagctcaggtgcgcgggcgccgggcggtggcggggggtcctgttacacacggctcgttctcgccctccagatcgagagcgaacgcatggcccttcccgtgcataatcagagtcacataaacgcaggcgaccggggcatgactgtacagagaaccaggtgacttgagagacaggagtgtcggataaagcccgtcaggtagagaacagtgaagttgcaagtgcggccgaagacagaaagatatccgaagccgtgaaagcctcgtgcaccggtcatgggaaaggtaagagtataagaataaaccgtaacttagatggagagagaagggcgagtactgtaaaccattaaaagatgtacgccaaagcacccagttctcttcaaagaaaggtacagttcaggagcaaaaggatcacagttagacacatcctttatatggcagatggtaaaaaagtagaatcacaaaaacaaaacaagaattggtggaaactaaggaacaatagacataagttagggaaattacaatgttactcataaaattattcattcacgtaacagagacaccagaaattaagggtttaagaggagaacggcacacaataagtacgtcgagaccattcaacctggattgccaacgaagggccagcagggggacaagtcgtttcaagagctgaaagaaccaagaccagtaaaatacgcgaagaggaact

SEQ ID NO: 633310 - DNA, 386 bp, Homo sapiens
cgagtcgggactccagtctgggcataagagctaaactctgtctcaaataaaaaaaaggacaagaaatacactaatttctctggtgtactggttgggccacaggtaactggctggcccatttttaggcactacccggggagaagtcccacatcagttggccagtaatctaggccccggatggtgattggtagccagcaataaccttttctaagtagaatttgggcagaaggaacatagagattagcaagtacaaagagagctgagaactcccatggaccttccaggaccatgagggaggtggcttatgtggctatgacccccttagatggccaattcccaaacggtccagaacttgacttcggggcttatagagctcttatggcccg

SEQ ID NO: 633311 - DNA, 143 bp, Homo sapiens
attaaaatactatggaagtgctttcaactcagccacatcttagctattagttcttgtgtgtcttatcaaagtttaatggatacagttccacagtgttgatgtgttgtgtgtatattcgatttttataaagatggtagtaagtc

SEQ ID NO: 633312 - DNA, 283 bp, Homo sapiens
tcccagggccctgggtttttggggggggaaggaaaagggggggaccaaaaagtttggggtttgtcccctgtgggacccttttcccttttacttcctaggctttgatttttccggcagcccaaatgttcggtttttttggcccctttttcccccctattggggtttggttttctttttccggtccttttgccatacccagtttcaggggtcggtcaaatccatcccccccctgggttttttttttttgccccagggggccaaaattaattaccccaattcccca

SEQ ID NO: 633313 - DNA, 1234 bp, Homo sapiens
gtgtgggtgggtggggcgggggggggcggggtgggagtgggagggtgggggggatgagttgggggggtagggggagggggggggggctgcgtgttctggggtgatgaggcggttgttggggcgggcgtgagtggggggtgtgttggccgggcagggggggactagagagggttgggtagatggccgcgttgggggtgagacggggcggggtgttgtccgggggggtgggcggggggggggtggcgggtgggtggggggttgtcggagggggggttgggggagtagggcgccggggcgggttgggtggtgtgaggggcgcggtttagcggcgcgggcaagggggggtgcggtgcgggtcgggggcgtgtgtgcgctgtcgggagttgtgggtcgccggtggtgcgggctggggagggggtggttggtgggggtggcgtggggaggggggctaagcgtgggaggcggtgtgtggggggttcgtgcgcgtagttcgtgggggtggaagcgttgtctttggggggcgcatgggcgcgggggtggtggcgcttcttgtcggctggtgtgcagtggggagggtgtggggcgtcgtgggattcccgttgggggggagcgcttggcgccgtggtggagggtggtgggctgcgggggtgtggggcgggggcggggtgtttcgcggtggcgggggccgggggcgcaggcgcagggtggtggttccgcgtggcgagggcgcgtcgcagggggtgcgtccgcggtgaggcgtggaggggtggggcgcatgtggctttgggtgaagggagttggttttgggacgccgcgcggccctttaccgcgcctgtagaggccgtgctgttggggatcgacgagctgggggcgggctgcgtgggcgtgcgcgatcgacgaagacctagtgagaggctgcgcgccgaacaggtgtcttcttcggatgccttggggacacccttgctgtgaagttgcatgagacctgttttccagaccgtggtacctttcgaagagacatctgcttggagccttcagcctggagaggtgaaaaccgttgctactcccaaatgtggtcctcagagtcagcaactttacatcatgttcgaagccttttataaaatgcagctctgcatagcctgaccgaatcagatgtgttcattgtgacaagatcccccggtgattcaaggcaggtttaagatttgagaagccacccaagttaaacctggacttaata

SEQ ID NO: 633314 - DNA, 991 bp, Homo sapiens
agcgggatcacttgaggtcaggagttcgaggaccagcctggccaacgtggtgaaaccctgtgtctgctgaaagtacaaaaattagctgggcgtggtggcaggtgccatgtaatcccagctagctcaggcgcctgaggcaggagagtcacttggacctggggaggcggaaggttgccaggtgaagctgagactactacgcatgtgtcgactccagacgctgggcatgacaagacgagactctacagaaaacaaagatctctttattcagcccgctgcaggggttcaccccgtataatccgcagcactttgtggaggcgtgagatgggaggattgcttgagcccacggaagttttgaggacctagattgagaacagtctgaggcaaccaaagtgtgacgaatcccagtctcctatggaggatgaaaatggatatatatccggacatacacaaattttctcagccgcggaccatttggggaggggagacgcccccccctgtgtaggagatttctcaccaacataacgggggagaagcgcatggaacggagggagagagagcatacctttgagacacccgtgggggaacacattatagagaggtgttggacaagtagatgcatcgaggggtagttaatgccccccctttaagagagtctccaaaggccctgatgagagcacaagagggttgaaaacccccggttctcagccaagaagacaagaagaaaagaattctgttttgttggacaccaaatagttgactcccgacagaagaattatgaggggaggaattacacatagatacttttcgtatgaaacaatcccgccctgttgttagaatgatagaccacttttattccagctggacctgttggagtcgagagctttacaccagagatggtgtgcaaccaaatttatcacgggtgactaccacatgcgttagcgagaacatttttactcaccgagctgatgtatagaggaccgccttaagatcc

SEQ ID NO: 633315 - DNA, 839 bp, Homo sapiens
  misc_feature (542)..(542): n is a, c, g, or t
  misc_feature (549)..(549): n is a, c, g, or t
  misc_feature (567)..(567): n is a, c, g, or t
  misc_feature (601)..(601): n is a, c, g, or t
  misc_feature (671)..(671): n is a, c, g, or t
  misc_feature (684)..(684): n is a, c, g, or t
  misc_feature (691)..(691): n is a, c, g, or t
  misc_feature (700)..(700): n is a, c, g, or t
  misc_feature (702)..(702): n is a, c, g, or t
  misc_feature (707)..(707): n is a, c, g, or t
  misc_feature (715)..(715): n is a, c, g, or t
  misc_feature (718)..(718): n is a, c, g, or t
  misc_feature (724)..(724): n is a, c, g, or t
  misc_feature (729)..(729): n is a, c, g, or t
  misc_feature (739)..(739): n is a, c, g, or t
  misc_feature (741)..(741): n is a, c, g, or t
  misc_feature (745)..(746): n is a, c, g, or t
  misc_feature (749)..(749): n is a, c, g, or t
  misc_feature (752)..(752): n is a, c, g, or t
  misc_feature (755)..(755): n is a, c, g, or t
  misc_feature (765)..(765): n is a, c, g, or t
  misc_feature (769)..(769): n is a, c, g, or t
  misc_feature (773)..(773): n is a, c, g, or t
  misc_feature (777)..(777): n is a, c, g, or t
  misc_feature (780)..(780): n is a, c, g, or t
  misc_feature (791)..(791): n is a, c, g, or t
  misc_feature (807)..(807): n is a, c, g, or t
  misc_feature (810)..(810): n is a, c, g, or t
cgccacgttcgggttgactattccctgtcaacgagttttctttccctgagattcatatgttcaaaatgttgaccccccccgtcgccgaccctccccatgaatgtggccaagagttgaagagggccagagaattaagcttttcgggcagagcttcagaaacttggtgagtctcccaatcacgcagagagagcttggtgccacagcactgggcaggaaaacttctgtcaacctgaccccttgtgaggacatcttaatccaccggacccgactctgctgaactgcagaacaacatggtgctagtgaaactggaccttcggaagaaggccgcaagtattgctgacagtatcatactgtgttggaaactcccaggcccggtttctgcccaaaagcgccttggtacccacccgggaaatcagccacccaacccaccaccccccgggagagaaacccttccctcgaaatttacttccccggacacccacctgcccaagctcacagactgcagcccttatgcccggatcctacgctcacggcgttccccnttactcnaatctgggccttttggcnaaaagtactaaggctgtggggaaagagaagagcngtcatggccctgaggtgggtcagctactctcctgaagaaataggtctcttttatgctttaccatatatcnggaattatatccnggatgcnatactcagncnctagnttttttcncanttttgnattanaaccccctangnaatnncangtngtngttttttttnattnactnatanganttctatgcacncaaaaccgttatattnaanatattattgttcacattttaaaaaaaaaa

SEQ ID NO: 633316 - DNA, 120 bp, Homo sapiens
agctcttccacaacttccttcttctcctttaaagtcctttgtaggtgatttcggagctgtgtctacagctgcgtcttgactatggtgcgggcatcgccctgagtaaatccgcgatagcac

SEQ ID NO: 633317 - DNA, 312 bp, Homo sapiens
ggcatggctcccaacgtgctggtattacgggtgtgagcactgtgcctgaccccggttgctttttttagatggggtctcgtactgtcacccacgttggagtgaagtggcgcgatccacctcccaggcttaagcaatcctccccatcagcctcccaagtagctggggccatgggtgcacaccaccatgcccagctaagtatttggtagagacggggttttgccatgttgcccaggctggtcttgaacttctcagctcaaatgatccacctgccttggcaaggcatgagccaccgccccatgcgtggattgccag

SEQ ID NO: 633318 - DNA, 305 bp, Homo sapiens
  misc_feature (114)..(114): n is a, c, g, or t
catgatgtgatagtaggaaaaaagttttaaaaagagacaacaggaaacataacttatgcagcagaaaagagtctcctttaaagcaggatctaataaaggtgatatttatttatngatgtcaaacattattgagaagcagtagataaccaggagagagacataagctgctgaggaggaattttcctaaaacaacttcaataatgaacgctgataacaaggcaagggtgtcttcttacaatttcccctcaagttaggaagtaagactgggaagcaagaagatgtatgatttgaacaatcacatcatg

SEQ ID NO: 633319 - DNA, 184 bp, Homo sapiens
gaacagagtgagaccctgtctccaaaaaaaaaaaaaaaaaaaaaaaacacacacacacaaactagggggcaactggggcacagccagaggtgcccatggagccttcgttctttccctgactggtttcctcaggacactaggccctgggcttctagcttctccctgtcccttctgtcgtcttctc

SEQ ID NO: 633320 - DNA, 747 bp, Homo sapiens
  misc_feature (97)..(97): n is a, c, g, or t
acaaaaaaaaaaaaaattggttgggcgtcgtggtggttaccattgcgcattaattcccagcttacttcgggaaggctgagaacaggagaaatttgcntggaaacctgtgggaaggcggaggtttgcagtgagctcgaggctcaatgccatttgcacttccagccttaggcgacagagcgagaactctctctctctcaaaaaaaaaagagaaaaaattacctcccggaattatttgttctccttcaccccttcttcttttagattctcccgagttattcttttcagcgttatttaggcttgattcctttaatataacctcttctcgcatcaacggcgtgtgacattttctacacttttgtgggggaagaaggggggtttacgccgggtaaaaatttgggggagtctcacagacgccaacagaagaacatatctcagagaattctattgggggtataatggagctttacggacaccacaaaacttcttggagacaacaacagggtggtccctctattggatccctagttcaggagagagtctcgtggatcgctgtggccaatttctgtgaaccacggtgggacacataactttctccatctgtgtgtgtgaaagagtctcctgggggaatctaccactcgtgaaaggcatatatattttgtgggactccaataaaggggccttaaaaggcccctattggaattccagttccccatttttgaggttttacccagagggcacacacaaacc

SEQ ID NO: 633321 - DNA, 376 bp, Homo sapiens
  misc_feature (254)..(254): n is a, c, g, or t
  misc_feature (264)..(264): n is a, c, g, or t
tttttcctaagtccttaagacggatgaacttctacaggtaagtaggtagatctactaaacagaagtaaggaatgttggcatgaagaagctccctaggctgctggttggctgacgctctgactggtcatgctgcttaaggatgcgtctgagcaagatcggtcgtgacaggtaggtgtgtagaaaataacctatatgtggtggtccattttcagttctaagtgccttcatataggtttaagcaggctatgtggaantagagaaatnaagaagcagaaatgtactgagtcaccaccctgccctccttcctgctttcactttcaaccagcgaacaaatgcctatcagtaggagccccctcaactaccctcccagagcctt

SEQ ID NO: 633322 - DNA, 148 bp, Homo sapiens
agctcagagacctcagaatgaggtggaaaaatgcactacaatacatgtcataagattgtggcagactctggtgtgaaacatagcttttcaatttctgttccgatcttcaaacagtttcactagaatttcgtcgcgactggaggagacc

SEQ ID NO: 633323 - DNA, 389 bp, Homo sapiens
  misc_feature (7)..(7): n is a, c, g, or t
  misc_feature (10)..(10): n is a, c, g, or t
  misc_feature (164)..(164): n is a, c, g, or t
  misc_feature (166)..(166): n is a, c, g, or t
  misc_feature (188)..(188): n is a, c, g, or t
  misc_feature (197)..(197): n is a, c, g, or t
  misc_feature (205)..(205): n is a, c, g, or t
  misc_feature (217)..(217): n is a, c, g, or t
  misc_feature (377)..(377): n is a, c, g, or t
tcgtcgncangctttgcgatgaggaagctccagagactcaacagctgtgagaccaagtccagcaccagcagctcccagaagaccacgccagatgcgtctgagagctgcccagcccctctgacgacgtggaggcagaagagggagcagagtccgagccagcatgnanaggatcccgccagccatcctgnatctgagcntggtacanctgcacatgcantggatggagaagcgcagggccatcgaggcatgaagaagaagatggaggcgctgtcggcaaggcagccttgaaagctcggcaaaggctgcattcctgcatgtggtgaaagaagggcaaggccgaggcttgccccacccctcaaggcccgggagcacttttncaaaaggaagta

SEQ ID NO: 633324 - DNA, 359 bp, Homo sapiens
  misc_feature (76)..(77): n is a, c, g, or t
ggagcccgccctgctttaatgcgcatgcgggggagccgagacgagagcagtgctggcagggggagccgagacgcgnngcgatgctggcagggggagcacgctgcctggtcgccgcactctgcgcagagcatcttggatggcgctcaccacgtcacgtcttctgtgctttcggccaagcactgggccaggtggctgcctcagcctctcaaagggctgggattacaggcgtgcgaccggtgcccggccttttcttttgttgttgttgttgttggctgccaagtttggactccggtgccttcgcattcccgagctgtttttgcttctgggggcgaactccttctggcacatggggcagctgc

SEQ ID NO: 633325 - DNA, 307 bp, Homo sapiens
aggatcccgcgggccattggggacaccattttgttctgtactaagaaaaattcttctgccttggggtgctgttaatctataaccttacccccaaccccgtactctctgaaacatgtgctgtgtcaacttcagggttaaatgcattaagggcggtgcaagatgtgctttgttaaacagatgcttgaaggcagcatgctccttaagagtcatcaccactccctaatctcaagtacccagggacacaaacactgctgaaggccgaaggccgcaggggcacctctgcctagggaaaacccaagagaccctt

SEQ ID NO: 633326 - DNA, 791 bp, Homo sapiens
gatcgtaccactgcactgcagtctgggtgacaaagcaagactctgtctcaaaaaacaaacaaacaaacaaactttttgaaattgaattgcaatatgtctgctactttggcttgggctggacagtttatctaataagcaaggcagcttcttgtgtgctatggtaataagccttcttaacaggctaagcttccctcataagaactgtggtgtttctctttttttttttttttggttagggttggtttgggttttgggttgggtttggtttggtttttaaaatcagtatccaagtgttttataggggccaaaggtttaacttgtgcactattcccgtgtcagttaaaggccacgttgatattttcctaagttagcaaggctcactggctggctttctggcctcccttgcctccatccctctcccttcctaccttctctatttacctatttctctccctccctctcttctcctctcttttttttccccccgcaatatgcagcttttggatggtcacttgattttatagagacttgccagtcccagcaagatggggagtcaggcatggagcaggcatctcaggctaccagaaagaatgggtcacctagaactttcagtcaggcatcctcgtatggcatggtcctgtaagtcaattagttgataaatagttcccccttaatcccttaagttggttacggtataggtgttaatataggtaaggtgggactctacctaaaattgcgcatcatacttagtggcgtaaatatcttctcatatcttatctctccacgtttga

SEQ ID NO: 633327 - DNA, 1115 bp, Homo sapiens
agtatatagagagcactacatccgacgattctctcgcgacacagaaagacgtagttcatgattgtaatggagaagaaaagaaattagatgattcctgttctggctctgtaacctactcttattccgcactaattgtgcccaaagagatgattaagaaggcaaaacaacctgattgagaccacagcccaacatgaactccagttatgttaaatctttaaagcaggcaacagactaattcagaaatcagttctgctacaaaagtgacgtcagcttaaggctagtaagatctgtgatggctggatattacagaaggctcatcttgacatggcagaagaccttaagcttccgagtagcgagcgatggatgctgtaaacacagcgcccaataccaaagagcatacacagtcatagcatgctaagtagaaacaaaagcagcgaaaaggagaaaaaccttgggctagggaaacaagacggatatctcaaagacagaagcaacaaactacgcaacgaaaacaggaagatagggagcacatgccatcgacaggcccaacagaggaacaaagaaccactaacaagtaacggagcgtcgaactaagcacacagaaagcaacagcaaaacccacaatgaacaggccaacacgtgctgaacgataagacacatggaacaactagggacaagtacacacaacaccaaaaccccgaagaacataaagacgaaaacagtagagagtacaagacacgcacaggagaacatgaagcaaaacagggcacagcacaaaagaaaagcgagccccccagaggcaaaacacccagagagagaaaccacaaaaaaacacaacgcgccgaacagacaacaaaaacaaccaaaaaagaaacaaagaccaataggaagaaaagaagagaaacaatagatgaaccagcacaaacaagaagaacaaaccaaaacagaacgaatacacaaccacaaaaaaatacagagaaagaagtaaaagcacaacagagaaacaaagagagacaatacaagagaaaagaatgtagagatatcacacacaccacaccgtcaacacaccgaatcaacacacgacgcgataccgccccaccactgtattcgacagc

SEQ ID NO: 633328 - DNA, 159 bp, Homo sapiens
ggcagtggcataacgactgctttgactgtaagaagtacacccactcactggtgggaagaaggaacctcacagagagggacgacatcctgtgccccgactgtgggaaagactactgaatacaacacagagaagatactgcttgtgatctcacacacggat

SEQ ID NO: 633329 - DNA, 347 bp, Homo sapiens
  misc_feature (90)..(90): n is a, c, g, or t
  misc_feature (151)..(151): n is a, c, g, or t
  misc_feature (302)..(302): n is a, c, g, or t
tcgctctgttgcccaggctggagtgcagtggcacgatctcagctcactgcaacctctgcctcctgggttctagcgatttgcctgcctcantctctcaagtagctgggattacaggcatgcaccaccactcctggctaatttttgtattttnagtagaggcggggttttgccatcttgcctaagctggtctcgaactcctggcatcaagtgatccatccaccttggtcttccaaagtgctgggattacagacgtgagctacttcacctggccttgttggctctttttcaaaaaaagtttactngactcttgctttattgcaagtcccagaatggatttgatttaggga

SEQ ID NO: 633330 - DNA, 407 bp, Homo sapiens
atcaactcccgattataagcgtcaggaaaagaatctgagtcagttcaatgataggtaaggtcatgtgggtcacgtgtccactggatggggggccttccctgcctggcagccgaggcagagaaggagaggagacagagagaaagacagcttacgccattatttctgcatatcagggactattagtactttcactaattgactactgctatctagaaggcagagccaggtgtacaggatggaacatgaaggcagactaggagcatgaccactgaagcacagcatcacagggagacggttaggcctccggataactgtgggcgagtctgactcatgtcaggccctccacaagaggtggaggagcagagtcttctctaaactcccccggggaaagggagaccaccccgccc

SEQ ID NO: 633331 - DNA, 145 bp, Homo sapiens
cgccgtggccctggactcttttcctatcgttcacctacgaactgctgcttgcatcgcttgctcctcagtcctagcttcagtcaaacactggtttcctgtaaatcctgtgtgatactgtcatcctagattcactgaggaagtcctt

SEQ ID NO: 633332 - DNA, 131 bp, Homo sapiens
tggctgtctcctctttccggcttgatcactttgacgttgtctgtatgcgacgagacttgagattccggtggaaaatacccctcgtccacctaatgatattttcgatatagttttggacgaacctattgaat

SEQ ID NO: 633333 - DNA, 125 bp, Homo sapiens
atccggtgcatgggcagcccacctcatcttgcctgtgttgtctctctcgatcgttcaggcagccgtcatgacgcggtatgtgcgcagcgccttcatcgatgtgctaactgacgatcacatgcaga

SEQ ID NO: 633334 - DNA, 322 bp, Homo sapiens
acacttatgcagaactcacatatgcacacagcacatacatgtacacactacacacatgcctatacacatgacacagcatacacatctcacatatgtacatgtataaatacacatgtgagaacgtataaacttacatatccggagatgggatttctggccatctcaatggtataaccatctagagctcagaggtagagctaccattaacaaggtcccagattccagcccccagcagaaacaacaagagtcacccagagttcactgccccctctccaattctgtctacagcggactcaaaggaggatgcggtgaaggtcgacgc

SEQ ID NO: 633335 - DNA, 635 bp, Homo sapiens
atgaggaagatgaagagagacgaagtctcgctctgtcaccaggctggagtgcagtggcgtgatcttggctcactgcaacctctgcctccgggttcaagcaattctcctgcttcagcctcccgagtagcttgggactacagacgtgcgcaaccatgcccagctaattctttttttctttattttattttattttttttttttggagatggagtctcgctctgtcgcccaggctggagtgtagtggcgcgatctgggctcactgcaagctctgcctcccgggttcacgccattctcctgcctcagcttcctgagtagctgggactacaggcgcccaccagcacgcccagctaatattttatatatcttggtattttaagtaaagacggggtttcactggggttagccaggatggtctcgatccccgtgacatcgggactccgcgtgtcctcggtctcccaaagggcggggatcacgggcgtgagccaccgaacctgtgtcgattaacctctttaaagccggttttctcatccatacaagggacgatatgggcagcacccactgctgggtagggactattcgtgtgaacacaggtgcctatgtggtcctccatttccataattgtaatccttatccta

SEQ ID NO: 633336 - DNA, 440 bp, Homo sapiens
atcagaacggagaccgaaaataggatgatgaggagaataatttgatctaggttaacaagaacaagaagattactcctgtgcagcacattggaagaggaaaatgcatcgaacgtcaataagcacattctagaaactgaatggcatgagtcgagagggtaaaactggcctacaatctataagcacccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagaccccaaaaggggtacc

SEQ ID NO: 633337 - DNA, 1050 bp, Homo sapiens
ggacgcgtgggtcgacccacgcgtcagagaagccatcacgtatgtcgcagcagcatttcacccctgcaaagtctctaatagctctgagaccatgatgagatttgtaactagagatacacatcacattccaaagtccattctggctttcctattctgttccagattagtcgcttgtgttatatgcttcggaggggaacttaagtacacagatccttatctctccccatcaccctagcctcacaaaacaccagttgagagtcattttcaaggtacctgaagctctcgtagagctgacccgagagatctgtaactagacgtcccgcttaccttgaacgactgggttacgcctcaaaacgacgaggccactgcaacgcttcaacttgcgagaatgtctggcctatttcatgcgacgaaagagaaaatcgttttcttcaaagctatctgttgctcaggcacagggagcatgggatgaagtgctttgcctcgcaacttgatcttcctgacatgagaaggacatccggccctatgaagtctgtaggcgacagttagaattcgcagtgcgtggcatcgaatggagcgacaacgaacatctatgcttgttatggtgaatcggcacaccccaggggcaaatcaatgcaaatcgatggtacactaaagtcccaagcagtctgatgtgcacgtagacccaactgaaagggatcatgctcggtcgtgtgaacaggccttgctcagatttcactgtacactttttaagggtcgcaattcctccccgttctccattaaagccgacgtaaccagttggcctggaatacttacaaccaactttaaattgccctctaggaaacgcttaatagagggtttgccttatagcagctatgtaatacaaccttttaaggccacttcacacctggtgcgttggttctcactcgccggacgagtggcccttgcatccttaatagagccttacgctccccaatccttcgcactttccttggggtggcgtagccttgagggttgggaccccgaaattcctaaggctccatttgggtg

SEQ ID NO: 633338 - DNA, 159 bp, Homo sapiens
attagatggtctggaatgttttaattcaatttcattggattttctacatagccaatcatgtcatctgcagaaaagacagttttaattcctccttcccatctttatacccttcactttcttctctctgtcttactccattgctaggacttctagggcgat

SEQ ID NO: 633339 - DNA, 117 bp, Homo sapiens
  misc_feature (58)..(58): n is a, c, g, or t
  misc_feature (97)..(97): n is a, c, g, or t
attaggcaggtgtcacatacctgtagttccagctactcgagaggctgaagcaggaagntcactagagccaggtggtcagacctgcagtgaactgtgntcctgccactgtgctccagc

SEQ ID NO: 633340 - DNA, 401 bp, Homo sapiens
gtcactgctacctctgttacattaacctgacttgaaggacaaatcctactaccatgttttcatcccaaggtggtaactagatgtatcccatggaaatatacttagtgtcctatgcttctggcgttgtacgtatactgaagctgacggaaaagagagaaccttccatttcgtcttctaactgtatatcgtatttgagacggatatcgttgctatgtggcccaggcatgaaggtgcacgtgcgcatgtgatctcggcttcaactgtcaacactcacgtttcccgtgtttcatagcagatcctcctgtgcctcagatacccctaggatagttgcagaattacagggcacattgcgatccaatgtccaggtaatttcgcatttttcatcagagatggggtttcac

SEQ ID NO: 633341 - DNA, 249 bp, Homo sapiens
tctccggccacagcttctcgcatcagtgcccacgtgcttcaccctgtctgggtggaagtcctggggcgcgtcacggatgtcagcatgaaggggctgaaggcggatgttcttcgctgtttgcacagcacgtgaacggcatactcgccaggctcctgtggacagtagcgcacattacaggagccgtcgcccttgttgtcacattcgatcttagcctgcgatgggcctttcaacgagaagctgtggcgggcg

SEQ ID NO: 633342 - DNA, 622 bp, Homo sapiens
attccagaagtaccctcaaagacagagacaccaagaagaatcggaacatacaggcttggtcaaccccaatggaaatgtggggcttatcggagcagcaaggagacacacaattaaattttacagagaaaacccaaaaaaaaaaaaaaaaaaaaaaaaaaaaaaaatgtgtgggcggcgcccggcccgggggccccggaaaaggtttctataaacccctatccgtgtgtggggcgcgcggggggcccccagtggggtaatgtgtggaacaccggggggcccaaggcgtggtccccaagggaacacccggggccaaggaaaaaggggtgtggggttccccccccaaataaaaaaaacgcgcggggggggaacgccggcggcggttcgtgagaaccaacatcccagagaggggaggtccagggggcgcacatagcgggagtctttaacacacacggggagcgcccaaggcggagggccccgataaattaaaattaacccgcccgcgcgatgagggagaccaccacgagcaaaacgacaaggaagaagcgacacaaaaaacgcaaacaacagagcagacgagaagaaccaaagggaacagaagacgacagcaccagacgagtacacg

SEQ ID NO: 633343 - DNA, 550 bp, Homo sapiens
cggtgttacactgcaatctgtgctctccatgggccctctggatctgtgccagagccaacccatggagacagagcagggcccctttgcccattggaactcatggctgctgccctatacgtgatccaggggtgtctgagagcctcttggattgtcgagccgtttcctgcaatgaggattgggaaacagtgatgatccatgaggacagaagttgggagcaaccatctccgttctcactctttttagacctatattttggcattatttggccactgccgtcaaaccagtggaatggaggatgcagagatggatgggagctggctgcaaatcctgcactccaggggaaggaagcagtccagacagacccctcaatagagtggccttgttacctacacccatactattagtcccaaagctgacaggcctaagacgagtcataaatgctccaatgagcttcccgaatcttccaaaagccaactctccattgctaaatccctggtctgtttttctgtttgcctccaggaggcaccgattgcaggcggggctcctctag

SEQ ID NO: 633344 - DNA, 733 bp, Homo sapiens
gaacagcgagaagtcccagaacatactgtcgtcatccgtggcgagcaggctgtctcggtcatcctgaagcttggacgcacgcaagtgcgagagcggaacctgaatcccaaagcagcctgttcgaagagcggctgagaagaggaagaaggtgtcaggtgtggcttggagacccccagatggtgcttgtcagcgtcccgcacccaggcgctgagcgagagcccacgaaccccgccgggcacatgtgaacaggtatgcctccgtgggacgagccacccgacgtttcagccctgtgctctggccccaggaacggccactcgagaccccggtgcttcatccacatccatgacctcagcacacctgttgtcagcactcgagccaacaccgaaccgtgacaaggttcggagctgatgcggcggcgggcaaggctgacactgggtccaggagctccctggggccctggcctaccagtcactggcctcgcgtccccctgtccccgaactctcagccaccgttgtcactctgtgacctgtcccatggagtcctgatatctgcatcttggacctgttgcctgggctgacaggagcattaacaactaggaccacttaaacagcacccgtgaacagcacactgaacagaccatacactatggctgacacaacacaccagatgcctacctatcaaaagcgagcgaacgggccccctatcactcaagggggacgcagtggaaacctga

SEQ ID NO: 633345 - DNA, 379 bp, Homo sapiens
acaccaaagacgccgccatgggaattgcataataaccgtacagtaactgccgactcgtatcagcagcacccggatcccatggttcgcaaaactggtaaaacgcgccaagggtaaatgttggccaccactcatattaaagtaatggtcagcaagacgcacgatggtttgtaatcgaccaaacaacaagccaccaaatgctgcgaccaccgcaataaccttacgtgagacccctgaggccagaaaatggccagcaaatcagcaaatgatcaggcattaccattatctggcatgataaagacaagcagcaacctcaaagctggtaccccccaaacatcaaaacgggcaacagcttgttcgcgtattggcacatgtctttccc

SEQ ID NO: 633346 - DNA, 568 bp, Homo sapiens
  misc_feature (37)..(37): n is a, c, g, or t
aagcgggtgacgcccggcggtgattataccgcgcaanccatattggggtctcttttcgggagggacgagaggttattttgccccttttacacgcgggggcgtggtgtgcgcgaccccaaaggggggggaagggttgtttcccgcgggtttttttattttcccccccactcgacaaaggggggtgtttttgcgcccacaaaacagggggttttttaaatggttgtaatccccccccccccttccacaaaagggggggggggggggggggggggggtttttaaaaaaaaacccttttttttttcccccccggtcgcgggggggccccccccccctttttttttcccccaaaaaaaaaccggggggggcccccccccccggttttttttttgggggcgggggggggataatttttttccccgggaagagattttcccttttggccttttttggggcccccaaaaaaaaattttttttaaaaaaaagggggggggcgggggggcatttcccggggattttttcccccccccggcggtcccgtttttaaaaaaaaaaacccccttttttttta

SEQ ID NO: 633347 - DNA, 369 bp, Homo sapiens
agacattccagctgatcccccagaaattcaaaggatcattagagggtactatgagcaactatatgccaataagttggaaaacctagaggcaattgttacattcctagacacatacaacctagcaagattgaaccaggaagaaacccaaaacttgagtaggccaataataagtaatgtgatcaaagctataataaaaagtctttcagcaacaaaagcccaggacccatcaacttccctcctgattttttttttcaaattaaaattaattttttcaaactatttcaaaaaatagaggaggtgggaatatgtcgaaacctattttatgaggccagtaataccctgataccaaaatcagacaaagattcatca

SEQ ID NO: 633348 - DNA, 151 bp, Homo sapiens
  misc_feature (27)..(27): n is a, c, g, or t
  misc_feature (65)..(65): n is a, c, g, or t
  misc_feature (97)..(97): n is a, c, g, or t
  misc_feature (140)..(141): n is a, c, g, or t
caaaaacataataaagtcaccaagcanccactcacaatctgaatgtatataatgatccagcaggnaaggcatgttgcagtggtctgtgactgacttnttggaaggggtgtgaaggagcttttacccctcccaaatccaannaagcttcatc

SEQ ID NO: 633349 - DNA, 282 bp, Homo sapiens
agcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggaaaaaaaaaa

SEQ ID NO: 633350 - DNA, 800 bp, Homo sapiens
ggtttcttggagctaccacaaacttaaaaccatgaaacatctattatgctactatgtgtgttactagttaagtcccaaggctgtcaacgacactgaggagggtttcttcagtgcccgtggtcatcgacccttgacaagaagcgagaagaggctccagctgaggcctgccccagtgaatgggacatagggtttatttaggacttaaatacagatgtggtccagtggcagtgggctgtgaaggaccgctactattgtaaagagtatgtagtttatatcacatttctacttagacactctccactttagcaactctccattataacccaaaatcacaaggccttggttccttgcacatcctgagttccaacggacaggcagcgagttcaaagtgtccttcacagatcagcacgtgaaatctctctgggtaggccatacacggcattcctaagacttagaatctgaaacgcatatcttacttagaccataagatacttctcaggttatgcttgaggtacagctgccggaatgcatcactgcactcaccacaaggtcaacacatatcacgatatcatgcacggccaaatgcactcacccagaaatcacggcaccccacgatagcaacctctacaatcaacccgaaacccacaaagaacaaaaacccaaccagacaaacacccgagacctcagaacacactccacccaccacgcaaaggaccaagagcgaaacacacccacacgcaccacacaccgaacaaacaatgaaacaacaacaaacagcggacgcggcaaaaacacgcgac

SEQ ID NO: 633351 - DNA, 192 bp, Homo sapiens
aagtgtcaggtgcatctaagctttattaatattcactcatttactcctcccttgtcaagcttatcttctgagatacagatcacggaccatggtgtctaatcattcctccattgcatccattttttgcaagtctgtgtcttaccactaatctcttgtaagacttgtgtctaacctattttcatattcttaatg

SEQ ID NO: 633352 - DNA, 820 bp, Homo sapiens
gtgcggtgctgtggggggggtgtggtggtggtgtggcgtgtcgaccagtttccgagtgttagcgccggtttctgggggacgccggttcccgccctttcttgtggttgacgcggtcgccccgttggttcgtggtagagcgcctccctcttagggctcgtttctttctccgcaggcggtggccgggcgcccggattctctttgtgcgggaggagccgtccccgcttatatttgcgtgtgcgcacacccttattccggatgtttctcactctgccgggtcccgggcacatatttcgccgcggtattctcggcccccttactcgctgcccgcggagggctacatctgctccgcgacaccgcgagactgcgtgcttatggaggataacggctttataatagctcgcaccacataaggtgggtcgaatcggcccagtagtaaatgttgttgcgtcacacttgaaagagaaattgtataaatgcgctgttcttcgctagagttttctttgttggagaatttttatatggggaattattaactgagaaacccgaggagagtgacacactttctcagggggacgccagcataatacttttgtaataagcagcacacccacacgtgtagcgccagtccccactacggcgggatatgcggatattttatgcccctcgcagcacgtcatcacaataatttggctgggaacaactccaacccctcttttttctaggtcatttaatcccctttgggaaaacctacatccaatttaaattttaacctttttggaaaaaccccccaaaaaatttgggggcccaaaaccccaaaaaa

SEQ ID NO: 633353 - DNA, 732 bp, Homo sapiens
tgcagtggctcaagcctgtaatcccaggattttgggaggccaaggcgggtggatcacgaggtcaggagttccagaccatcctggctaacaaggtgaaacgccgtgtctactaaaaacacaaaaaaattatccgggcattggtggcgggcacctgtagtcccagctactcgggaggctgagacagaagaatggcgtgaacccaggaggcggagcttgcagtgagccgagatcgcaccactgcactccagcctgggcgacagagcaagactccatcttaaataaataacataaatggctgggtgcagtggcttatgcctgtaatcccagcactttgggaggccaaggcaggcgggtcacctgaggtcaggagttcaagactagcctgaccaacacggagaaaccccgtctctactaaaaaataccaaaaattagccgggcatggtggtgcatgcctgtaatcccagctactcgggaggccgaggcaggagaattgcttgaacctgggaggcggaggctgcagtaagccgagatggcaccactgcattccagcctgggtgacgagagcgagactctgtcgcaaaacaacacaggtactggtgctatttccattattacaaaccaaaaagcccaaaaagacactcacccaaaaatcagtccctcttggactacaatctaaatgacattcatttataggtatattacaactttcagataatgacacatttacatgtc

SEQ ID NO: 633354 - DNA, 147 bp, Homo sapiens
  misc_feature (109)..(109): n is a, c, g, or t
  misc_feature (135)..(135): n is a, c, g, or t
  misc_feature (137)..(137): n is a, c, g, or t
atttcccatataaaaccttgtcatttaagcaactgggatactttgtaatctccttttgaactatgatagactctaaaccccttaatgttgaaagggcagttatttgtgnaatttcctgtgggtttttaaggatgntnccccgtttcc

SEQ ID NO: 633355 - DNA, 271 bp, Homo sapiens
agaggcacaagggaggaagcagagagggatagggaaggaggagaggaagggacaaaaccttcaaccacttagtgatgaaatccagtgaagggaaggtgtggggggagttcggagggtgatacaacagtgcataaattgtgcctccccagaacgctcctcagaaggtggaggggacagaggctgcagccttggggcattggtgtgggctccagccggtctcctcacccagtgaacccacacaggaactgggcacttgcctgacgactgccag

SEQ ID NO: 633356 - DNA, 963 bp, Homo sapiens
  misc_feature (268)..(268): n is a, c, g, or t
  misc_feature (377)..(377): n is a, c, g, or t
  misc_feature (397)..(397): n is a, c, g, or t
  misc_feature (422)..(422): n is a, c, g, or t
  misc_feature (482)..(483): n is a, c, g, or t
  misc_feature (512)..(512): n is a, c, g, or t
  misc_feature (516)..(516): n is a, c, g, or t
  misc_feature (524)..(524): n is a, c, g, or t
  misc_feature (535)..(535): n is a, c, g, or t
  misc_feature (537)..(537): n is a, c, g, or t
  misc_feature (544)..(544): n is a, c, g, or t
  misc_feature (558)..(558): n is a, c, g, or t
  misc_feature (567)..(567): n is a, c, g, or t
  misc_feature (574)..(574): n is a, c, g, or t
  misc_feature (585)..(585): n is a, c, g, or t
  misc_feature (597)..(597): n is a, c, g, or t
  misc_feature (610)..(610): n is a, c, g, or t
  misc_feature (613)..(613): n is a, c, g, or t
  misc_feature (634)..(634): n is a, c, g, or t
  misc_feature (638)..(638): n is a, c, g, or t
  misc_feature (642)..(644): n is a, c, g, or t
  misc_feature (656)..(656): n is a, c, g, or t
  misc_feature (659)..(659): n is a, c, g, or t
  misc_feature (669)..(669): n is a, c, g, or t
gtggaggggcagcctgctaaggatggaaaggagttggtcagcccttgcttgtctcccagtttcaacggacagtggtaacacgcagaagtcacgtacagggtttcaggccagaaagcagcgtgcatagcctgcacagtagctgtgtgctgccagtagtgtcatgaggtccttctagatacatgagtgcacaggacaggagtgaacgttgaagcatgtggacttctatgctttctcctactattacgaccttgcagctggtgtgggcctnatagatgcggagaagggaggcagcctggtggtgggggacttcgagatcgcagccaagtacgtgtgtcggaccctggagacacagccgcagagcagccccttctcatgcntggacctcacctacgtcagnctgctacttcaggagttcggctttnccaggagcaaagtgctgaagctcactcggaaaattgacaatgttgagaccagctgggctnntgggggccattatttattacatcgactcnctgnacagacanaagagtccagncntcatagnggccgagccatccntgtccccgncagcagngtctgtgtgtntgcataaccctnctgtcctggacgnganttcatcctgaggagccacagnacangccnnngctggcactttntgnacactggctntgggacttgtaaaaaggcctgggtgcttgcccttggcaatagagctttttaccagtcacaattttggcccgaaggggctgtctgggacctggagccctgctctaatgtcacccttgtctgcctgggcctccaaagttgggcatgggacccagcgaacagaagcaacaggcaacaccacttgcaggggtgcagttgttgatacctgacatgtcccatcaccaatgaccccgtaacgaggggctgctgctgcttgctgtgcattgtccctggcaatgggaaggtctggccttccca

SEQ ID NO: 633357 - DNA, 348 bp, Homo sapiens
actacagacaccagactttggatagctcagacgacaggaccagtctattggctcatgtggctccccctgctggcgggaggccttcgagaatgagatgaggcatttctcatccctccctcttgcttctttctgtgcatcatcttccttctctcgagcagctccctctgcacacttaacggagcccagctgctcctgtttcacaccctgcagcttcctcaccagccagctgccccaccaaccagcggtctggtccacggaaacgtgtcctgagtggggtctgcttatcaacgtctgcttcacagagctatccctggaaatccctgctgcgacgggcgaagatcaccagcc

SEQ ID NO: 633358 - DNA, 443 bp, Homo sapiens
tgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttttggataccaaatcaaaaacccaacgggtaaaacagggcagtatttgtgttcctaattttaaaaagctttttgtaaagtttaataatatagatgcatgtacaacacttccccttgagtagcacatcaacatacagcattgtacattacaatgaaaatgtgtgagttcatgcgcagaaatttgtagtaggcaaggagccctttgtaacctttatactgtaaataaaaaagttgctttagtcaaaaaaaaa

SEQ ID NO: 633359 - DNA, 186 bp, Homo sapiens
  misc_feature (114)..(114): n is a, c, g, or t
tgtcgctgagagtcatcgatagacatggaggacgtctctgcccggaccctcagatcgtgtgcccagaccttccctgccaaacagagctgtccgtggcacagtgcacgcagcggnccgtgacatcgtcttcctgctggacggctccgagcgactgggtgcactgtgctacgaccggtaccagctcga

SEQ ID NO: 633360 - DNA, 308 bp, Homo sapiens
cgactctcgatgatcccccgccattacaactatctaatatcactgcgcccgctcattaggggatagccatgctaggtttatagatagttgggttgttacgtgtaacatacgtaggcaggagtccgaggagcttagttagtggctataaaaatgattacggatactattattagagatcaggttcgtcctttaatgtcgtgtatggttatcatctgtcttgaggttcgtttgattactcattgttgggtcgtgattagtcggtccttgatgagatagttgtaaatggcgagatagttgtaaatggcgag

SEQ ID NO: 633361 - DNA, 155 bp, Homo sapiens
tgaggtgggttgaccctttgatttccgtttcttctcaccttgtgagtagaagtcacagacgggcacacacgcacaccacggtcaggagtcccgagacagcacgaggtggaggcctggtctcaccgcctctcacgctatgtccatcacctggcagg

SEQ ID NO: 633362 - DNA, 101 bp, Homo sapiens
cgcggtggctcatgcctgtaatcccagcactttgggaggccaggcgctgtatcacaggtccggcaatcgaaaccatcctgcttaaacaggaaaccgtctta

SEQ ID NO: 633363 - DNA, 180 bp, Homo sapiens
gcggcgtgcacttatatatcactgtgaacttctcaagagagagtataaacgaagcacgaatgataagaatggcaggtgaaaagagatgggtcagtgaaaaactatagctaaaatatgtaaacctttctaagaaaaccgcttgccttcatcttgagttggaatatatttaaataaattgtt

SEQ ID NO: 633364 - DNA, 222 bp, Homo sapiens
gatcacgaaggtcaggagttgagaccatcctggctaacacagtgaaaccccatctctattggcaataaaaaaaacaagccaggcatggtggcacgttggccttgtagtcccagctacttggggaggctaaggcaggagaatcgcttgaacccgggaggcagaggttgcagtcagccgagattgtgccactgcactccagcctgggtgacaagagcaagactg

SEQ ID NO: 633365 - DNA, 354 bp, Homo sapiens
tatttaaaagaccacctttttttggaacaaatataaagtcttcaaggttttacaaattggcaaaaaggctttaagcccaaaaaaatacctttgaaaaaggaaaggtttggtgttttattggggatacccttaatcctgccaacatgcataacatttgccaaaaaagctcatgcttttttggaaaaaaaaaaaaaggggaggtacccgcttttttggcggattataaattcatggcttcagccagtttttttttttcagggatcccatttacctggagtcgggtgggggggaatctgagtctgatggggcaagttcctgtccccctttaggggggctttttactcgacccctggt

SEQ ID NO: 633366 - DNA, 902 bp, Homo sapiens
  misc_feature (303)..(303): n is a, c, g, or t
  misc_feature (386)..(386): n is a, c, g, or t
agtacttatcttgtagcactactgctagtttctgtcgcatacatgccactcaaccaggatcgcttaagtgcgccagagtgtgtgatgactgtcgtgttgcactcattctaagtgactgacactgggcatgaggcacggccacaagactacacataggactatggccgtggtcccatgacaatcatttcggcatcgagagcagcaatcagaacacaaacgtatgtgttacagtactacattcctgcgctgactattgctgctacgtagcatcgataacgaattgtattgcgcacttgtagattncgaaacatgccgataaacgcattgcgacgcgcgcgtaatgtggcggcgcgtgccagagttaactctcggttgattgcctgggncttctgcctttttcctggtggaactgagccatcttgccagtgggccggggaggatgacgcattctaaatcttactagggggattcaagggtatgcgtacttaaacgtacccagaaacactcgtggcacaacgatcggttgccatatacatcccgttcgcatcgtttttgctataacacttgtgcttggcgaaatatgcaccctttctactatgtgcgttagtgcttgcgtcgcctgtcgtaagggcccaccaattagtccagtctcgtgagggtgtggcccagcagtgtgaagtaacttggcattgtagctcactactcgggggcaatctgccgagttactgcttggggagtcgcgtgaagcattagcatctgcatcattgtagactccttgcacgagatgcgtgtgacttccaagataggatctagatcacctatccgctcctccaacagaattcgtttgaaacgtatctactgtctagaccttgtggctgtcaattaatcggaaagcaatgagt

SEQ ID NO: 633367 - DNA, 346 bp, Homo sapiens
ttcgattggcggcacttagggagaccctgcttctgaaaaatccaaaaactagctgggcatggtggcttatcgccatgccttcccgctacttgggaggctgagacaggaggatcacttgagccaaggaggtcaaggctgcagagagctgtgatactgctactgacttccagcctgggtgacagagtaggaccctgtctcaataaataaatgaatcaggtctgggcgtggtggcttaatgcctgtaatcccagcactttgggagaccgaggtgggtggatcacttgaggtcaggaattcgagaccagcctggctaacatgatgaaaccccgtctctactaaagataca

SEQ ID NO: 633368 - DNA, 138 bp, Homo sapiens
aggattgataggttgctcagctcatagaaaagtgcagatccctgctgggacatccagaaggacctaaaagaccgtgtgactagtgagctctagtgctgtagaaatttaaaaactacaatgtgattaacccgagcgcta

SEQ ID NO: 633369 - DNA, 922 bp, Homo sapiens
ctgcagcaaaaatcagaaaagagaatccagttgttgtggctgaacaataattcagagaatataaacttacttcttgtgaagagactgaaactttgtttctattctctaatatactcgtaggaaaacattagagagcagatgcggtggccattcttctttgaatgttctccagagttctttacatcacacttgtctgtcttataaattgactatctctacggatgtcgggggtgttagttacacggcagaattggatagatacagccctacaaatgtatatgccctcccctgaaaaaaaattggatgaaaatctgcacagcaaagtgaaacacacagataataggaacaaaatgtagtctcccatgctgccaaacaaaataaactgaccatctctgcatgttcgcagcactatctgccttttgggaactgtaatcaacggtataactcttctggctagttgttatgtgcctgtattttttctaaaaatggtacaccagaaaaggactggcagctctaccttctaccatagcttaaacttcaccctctttaatttcacaacatattctttggaaagcaggaagaaatgctcataaagaggatcagaccttcttcccgtgaaaacaggtattggcgccatatattagcctggttaaatcggtcatctaaagctgcaatacgaccttctgtgcacaggctaacatccgacactgctataagtaaaccctcaagcacaacagggtctgagataccttgaactatgactgccggcccaacagttgcttaccacgcaaagctccacactgccccatactggccaaaaacaacccctcggccccacgcacacgaaaaccccacaacgcgcgccacacaccccccccgggaagacccacccccacccacaacccaacaccgcgcccgaaaa

SEQ ID NO: 633370 - DNA, 145 bp, Homo sapiens
agcttgttaactttgtaagatgcaaagaggtggactcaagtttacatgactgtgctgcccctttcacatcaaagaactactgacacgaaggccgagcctgcctttcccatctgtctatctatccggctggcagggaaggaaagaa

SEQ ID NO: 633371 - DNA, 534 bp, Homo sapiens
aagatacgagtagacatcatggagaaccagatcatggacttccgcatgcagctggttcgcctctgctacaattctaaccacgaaaacctgaagcctcagtacttggaacagctacctgcacagctgaaacaattctcattgttcctggggaaattcacatggtttgcaggagaaaagctgacctttgtggattttctcacctatgatgtcttggatcagaaccgtatatttgagcccaagtgtctggatgagttcccaaacctgaaggctttcatgtgccgttttgaggctttggagaagattgctgcattcctgcagtctgaccgcttcttcaagatgccaatcaataacaagatggccaagtggggtaacaagtgcttatgctgagccagagctcgctgctgctgagccatcttgccctgaggggcccacactcttagctcactgtcagtcttgttccatcctgtcctgagggcccccactctgtctcctctgctctttctaataaacagcagttgcattaaaaaaaaaaaa

SEQ ID NO: 633372 - DNA, 121 bp, Homo sapiens
tttccaaagcgagatgctgacccccacagaaccaccaccctgccggtggagctcgagtgccctgacggcgaggtcatgaacgaagaacatgatgttcatcaagacctgtgcctgccattac

SEQ ID NO: 633373 - DNA, 947 bp, Homo sapiens
  misc_feature (340)..(340): n is a, c, g, or t
  misc_feature (815)..(818): n is a, c, g, or t
  misc_feature (823)..(824): n is a, c, g, or t
  misc_feature (826)..(826): n is a, c, g, or t
  misc_feature (828)..(828): n is a, c, g, or t
  misc_feature (835)..(836): n is a, c, g, or t
gtccaataaataaataattcatagagtaagccatgtggtgactacattaattaagtcttagtacatccttaatcctattcctgaaactttgacttaagtacaagagaaggcctggccaatgacttctgtcttgactagttcatttctgcatagcacctaggccaagaaaacagaccacatcagtcatcatcacccaacaccatatctgccttacctttgctggtattcttgtgcattttatattttcaaaaatgaaaattttaaaaattggttatcttttcctaaaattctgaacagttactatgttgtgattttgtaggactttggaattgtcattacnaaaatcagttatatagttttataggagtagtcaagtcggactaattgttttcttctctgagaggttactcagcagttatttcagggaaatgtgatagatgtagtgtatctaaacttctgtagggctttaccaggctatatataagagaaaaaatatggcctcgatcaggaattgttaaactttttctttaaagggccatatagtacatattttaggttctgcagactatgcagcccctgtcccaagtattcagctctgtcattgtacatccacagacaggacagaaaagaatgagcaagaatatgttccagtaaaactttatttacaaaagcagatggcagcccctgggccttagctttctgccccagatgggtaaataacaagggaaactattctatgtgttgatttttagttcagtttgggtagagtttcctagtggccacaagactctcttaacttgtgctgttttgtgttnnnnataannantnctgaggnnatatgaaaggcttgataattatatgtgagaatacataaaccaaagttatataaatagttacttacagtaaattgaagtacggttgtgatatgttggtaccgtctaaaggga

SEQ ID NO: 633374 - DNA, 951 bp, Homo sapiens
gatcgtgagcgtacttcgtttacttcaaccaccaacaaggagacccgagggatcatactgtagatcatattggtcaggtaagacgtaccacgactctgaaagagaccctagtctgcattcatagtgactctacatcctactcatgagacatgtccacgccgggacaaccctgcggaaccacatcatccatgtatgtagtgctgatgcgaccaaagacgggatatatcgactcaacattgcattactccgtcaaagtggaaacttcgctaaagtagtcatactattgtcatatgacctttgtagggccagttagtatatcagtactgaagacatggaactcattgggagagagtcgcgatcctagacgtaaatagtcctgtaactggagacccaagggatgcaatgaccccgagaagggtaggccgagaccttgcgtgagagatgtttactaatcgcataggtccttcgtcgtaaaactcgaacttaagcacgcccaggtaaccctgataaagctcacacgtaatggttggttttgtttaaccagacacggaaattgggcgaaaaaaaaaaggggggacttacggggtttgcataggaaggctcgaagttttgggtaagaacgaggaacgacgtgtggccgaaaggtaatatggggaaaggaatagggggagaaagggatgagggttaacgtgtgaaagggggcgccggaattgtgggtcccttttcaagcccattgtggaatgcgacactaattgacaccccatttgtgccagaaagttcctaaggttgcaatcgcgaggggtacgaccattccttaatcggaaagacgcgggggggccacacaaattacgccgatgggcgacaacccccgtatcacacgcagatggggccacacagggaaacgaaagctctgggtttggaatatagcgcctttcccaaaaaggctttaac

SEQ ID NO: 633375 - DNA, 452 bp, Homo sapiens
  misc_feature (18)..(18): n is a, c, g, or t
  misc_feature (249)..(249): n is a, c, g, or t
ggcactagtgtgtttatncagcactattcacaatagcaaaggtatggaattaacctaagtgtccatctacggaggactggatgaagacaatgttctatatacatgtatctcacattccatgtagtatagtattttagatacatatgtgtgtgtgtgtgtgtgtgtgtgtgtgtgtgtcacggtgtatatatatactataaaagtttggaggtgggagggaggtgagggttgaaaaatcacctactgggnacaatattcactattctggtgaatattctaaaaattctaagaattctggtgaatcactaacagcccagacttcaccactatgcaatatacgcatgtaggaaatcagtacttgtgccccctaaatatctgaaaataaaaatttaataaaagaggagtttgaggctgcagcgaactatgatcatgatactgcactccagcccagg

SEQ ID NO: 633376 - DNA, 768 bp, Homo sapiens
ggcggagctcgcgcaaagggaggtgtgtctgcgctcgcgtggtcatggaggcgctgccgctgctagaccgtgacaactccggaccacgggcgtcacgcgaaggctggttctgctgccgatactgtgtgttcctgctgtcggttggagctgtgcagggctgggagacatgaggagaggcccctggactcggcgaagaggagtgcctaccttctactgctgggtggactataagtgtacctcgcgcgtgtatgacggcatctccaggcgtactcgtgtcgccgcaccacgtccctctgacaccctaaagcaaagccgaaagattctccaacgccagggctctactgggaaggaacatgctgtgatcgatgtggagaacttgtaacggagctgaatgttatacatgagtgagtctgtgtgggaatattccgtgggtttgacttgtctatcttaacgcgaggtgtgagattgaagcaatatgtgttgatccgaagctgaaacataaagatcgattatgggtagatctagaagtatgataggattctccaaatctattcaatgacatggaacgtggtgatgcatgtctcctggtcggcagttcgaccatctatataaacgcgatatgttggacctgtgcattgagtaactccgtcgcaagcacataggaaggagcttgtggcccgactcaatggattccaactatcttttcaggatttggaccgatcgaggatctgtcataaggacctaatgggtgttatcaccgtagaggga

SEQ ID NO: 633377 - DNA, 236 bp, Homo sapiens
  misc_feature (210)..(210): n is a, c, g, or t
ccctcgaaacccagtatggcaaaatgtttactacggactctgtgtgagaggttacataggtgcttactatactgttttgtttctgaatgttggaactttctctataattaataaaaatatctactgagtgagcttttctgttttaacgtggtgttttccgaggggggtatccgacgctcgatcttcgctgactcgtcgttcatagccttntttccttggtctgtaaatatcccttg

SEQ ID NO: 633378 - DNA, 134 bp, Homo sapiens
ggcgacaatccactttcttatctcaggaatcagcatatttcagaaatatgggttttgtgtattttctaaaatcaagcagcagtctgtttcaaccaagatgattttgatttggaagttagagtcaacagaagctg

SEQ ID NO: 633379 - DNA, 122 bp, Homo sapiens
ggcccggctacggggatccgggatttgctttattcagcaggaactgcaaagtctgtgtttattcttgactgggggacacacacacggacacacacacacacggatccagaggagggggggct

SEQ ID NO: 633380 - DNA, 332 bp, Homo sapiens
gagcgattaagcttgatatcgaattaacggccgattcgattacggctgcgagactcagctagaagggaataggtttggtccaagcctttctattagctcttagtaagattacgcatgcaagaatccccgttccagtgagttccccctctaaatctcatcgatccaaaggtccaagcatcaagcgcgcagcaatgcagctcaaaacgtttagcctagccattaagctatgctaaccccagggttggtcaatttcgtgccagccaccgcggtcacaggattaaccctagtcaatagaagccggcgtaaagagtgttttaaatcaccccctcccc

SEQ ID NO: 633381 - DNA, 373 bp, Homo sapiens
cggacatcacactcacattctcacagggacacacactgacgagcactcacacgcgcgaatcgcatatgtacaacacactctgaattactctctgttaggtgtcgtgcctgtacatctccagaccttgtgtgcccttccctttgtacagaagagtgttccctctcttcatgcgctaacaccacagagtgtatatcatcgcttgagagtattacacattgaaaatccccccctgagtgtgtctgaggttcccgatatgtgtgcttacatagcaccctctctgcccagagcatctctcatctcgatgtgtgagtatgtgaagattacttgttttctcctcagggactattgttcgctcccagcagagtaagccccc

SEQ ID NO: 633382 - DNA, 625 bp, Homo sapiens
accgagcggtggcaggtcatggcatctgcgatgtaacgacgacatatacaacgctcatcgtcacagccacatgcatgcgaaatcatcttcctcagagtaatctccatcataatcggaggctccgtcaactgactcacgatgccccgtaagtaatcggtgcccgcggagtatggcagtctcccacgtcatagacacaatcactgtgccgggtgatccatacatagaggtcgacactgtcaatagctactgcaaagtcttgggcatcctggctcgtcggttttacactggcacgatcggtctaggtcattcgtactctgtgaaaatatggtgatgatgatcacaaatgcagttccgttagaggagctgaaataatgtctttgagattatatgccagctggtagccatgacaattcatgggcgggtggaattgctttgatcagaagtcatctctttttgctgtctccatgccttcattatcagtctctccagattcttgtctccgtgtctctcctgtcctgtgatgttctgcatactatattggattacctgcggtatgactagctaaaatgtagtgtaactcagatagaatgcattcttctggtcctgcagcattgaaaccttttct

SEQ ID NO: 633383 - DNA, 1111 bp, Homo sapiens
ggctgggcgagcgcgagcgcaaggcaccggcaggcatggcagctgctcgccggtatggagctcatgctaatacttgagaacgacatttcatcgaagataacctctgggagaaagcagaaaaaccctttgcccagggccaccgcgaacaagcataggcagcaaggaacggttatccacgagattttttaaaacccttgttctcagcaatattaacaagcattatttttaatcagaagattcaatgtggctaatgcagggacagatttcactcaaatattgactctgacgttggagttcgtggggggttcgcccaaattttggcattctatcagccaagggtgctatggcctgccgggaaattgcctttaccagaatattccagaagtacaggcttgccaaaagactggacaccttccagaatttttgcccccttcaaaagcttgggagggcttctcatccgttgaatggcaacgacttgccaaaggaagcactcggtttgcaccaacatacagacacaaagaacccgaggtttgggcacaaacacgcccttcaaaacacttgagctgcacaccaccttgaacggcgcttcataaacttctatatccgaagaagtgtgcccttgacaacttttcttggccattgttttggaacacacggaactttacagtggggatacctgggtacatcccttgggacgcactattttaacttcctggcgctgcgcaaccctgggtggctacaccattttggccacgccccttaaagccacgcccacttgtggttactcttttcaggcattaaactttgcgctgttcggagcacttgcctcacttccactttttgcatttgcccattgtacttgcatgttccccacgggctaaggcctcatataaaaagcgccacgggtatatactttcccaaaatggtccacatgtaacgggacccagcgggtttgtacgcacgatatctatccatttgtgttctcacgagcaacagaattgctctatcaccaccgcttgtgctttgtttatatcctccaacaagaaaaaatatcactgtgttggcccacttggggcgacataatataacgccccgcagtgcatatttcacc

SEQ ID NO: 633384 - DNA, 349 bp, Homo sapiens
  misc_feature (280)..(280): n is a, c, g, or t
tccagggggaaaagggaccccgcctaaaaccccaaagggaaggaaccccaaaaaacccattacccccaaaagggaaaatttgggcccccccgggggaatttaagacaaaaaaaaaaggaaaggggacccccaaaagggaagccccagaagggggccccgtaaaaaaggggaaaaaaaaaacccccccgggggaaaacggaaaattaagatcggccccccaggggagaaaacaaccgggaccaaaaggggcccaaattgggagagggcccccccccacaanatccctccttgggagtggaaaaaacccctttccccggggggggggaacacccaaacccccccggggggg

SEQ ID NO: 633385 - DNA, 406 bp, Homo sapiens
  misc_feature (392)..(393): n is a, c, g, or t
tatgatgtaaattttgcctattcgattttcaccctcagtttcccttaaaatgcaaattcaaggctatttagctgacaaccgccttagagtagtaaaacaggttatcaagaattcgaaggtgtggctgggcacggtggctcacgtctgtaatcctagcatttgggagctgagccgcaaagatctcttgaggtcaggagttcaaaaccatcttggccaacatgttgaaaccccgtctctactaaaaatacaaaaaaaattagccaggtgtggtgcaggtgcctataatcccagctactcaggaagctgaggcaggagaatcacttgaaccaggaggcagaggttgcagtgagtcgagatcaagccattgcactccagcctgggcaacagaagtnnctctgtctcaaat

SEQ ID NO: 633386 - DNA, 533 bp, Homo sapiens
agaggatcatagtcactatctaaaaattcttcctatttttttgtaataatctgtctaaaataacgcttaggatacaatgaaacttttcatgtctatggttccatactccatatttttactgattgaaaatagtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcatagggactctctcagtacttgaggctggcgtgtgcatcagatagtcttccaagagtatttccagatctaa

SEQ ID NO: 633387 - DNA, 216 bp, Homo sapiens
gcaatattcccgggctgcgaaaatgcgtaccagcaaatggaagaattactcttttaaggtgaaataagggtatgctgcattaactcaatttctctaaattcagcataagttgttatggcgaaatcagcactgttcacggtgcgtaataatgagtcctgcccaaagtgcggggctgaactggttattcgatccgggaacacggtccgttcttggatg

SEQ ID NO: 633388 - DNA, 581 bp, Homo sapiens
gttctgcttaccctgattggcctgctgctgtctggagacccccgggtgaagccacctgtcatcatgtctgaccagtgtacctgtgtgctggtgagccatccaactgtgctgtgttgccatgtggccttccctgcatgtgtctgcctgcctgtctagtgctggaggtctggggagtgtgatgtgctgctggtggcgaggaggaagctgctggaactggggggaggggggcgtgcctgtgtggtgggactatgtggcagtgcgagtgggagatgtgatgcctggactactgtgccgtgatggttgcctgtgtggccgtgcttgctgtgtgtgctccctggagccctggcctgccccctctcctgtggctctgctcagtcacccccggtacacccgagaacggcacctacttgaggttgtgcagagaccttcccgctacatttgtttagtacccagcgttttctttctacacacggagtccgagctaagggtgcaagatgcacacctgatatcacaagcaatcgccttgggaaggggtcatctaggaggaaacccgatcggatctccttccagagactaatccg

SEQ ID NO: 633389 - DNA, 199 bp, Homo sapiens
tcatctagaggatcccatggtgctcatcccccactagattcagctgagcaggagcattctgaatgaaccagtagtactgctccagaagaagaggtctcctccgtgtgacacagtcccacttggccttgcaggattggatctgggatccctggatttaaactcagggccatccttcataacaggcctcacaaagggttgg

SEQ ID NO: 633390 - DNA, 692 bp, Homo sapiens
aatgtcacattcccagttccagtgaacggttagacgttccatattgctaaagtgtcactgatgcatgtcgtaagcaatcatgatcatgcattgattggtggtagtctgatcactttccttcatactgcggatgcatgctacataagcatgggtgagcaaatcgtagtgagtacacgctcgaccatctatggctagtggcatgctagtccagactcggtccgtgaccgtgatactttcattaacgttctcatggatatcttgcatcgtaatgaaacaatcatgtccttcataatgtgctaatcttgtttctgtagacgatcaggtcccagtacttcgagcacagctcatcatgcctatggacttaccgggcaatacagtggtatactctcaatcctgtacaagccagtaagccagatcttgtgataggtctagcatgttcctaatctcgattccggtatagtacaagagtgtgagaaagtcacggcggatcacctgcgatctatttccaagggggtgtatactcccaagtccttgagtcattaagttatatcctggtgtaatacctgcactagttaacaggttcccatgatcaatcaggatttccttcaaagcgtgaaagccatgattcaacgccatgggattcacgccagcatgttaggtaaagacagccccatagactctaaagaacgtgt

SEQ ID NO: 633391 - DNA, 506 bp, Homo sapiens
atgttgatttgctgcagttgactctgaccctaatttcccggcgctgactcaaactcatcaggaacactgctttcactgagtgtatgaagtggtttctccatccgtgtggtttacctgaactcacaccgtcccacggcccaggtgtggagccgagcactcccctctgcctcctccctggactgcaggacctgtgtctcgctttatgaaagagatgccatttggggaagactcgcattgtcgggagcgctgtggacgctccagaaggagatcaacacgatgatgatgatgccgggtggagggaatgtgcgcttctcgggagccagaaaagaataatctgaatgtctccagcatcaagaaaagaccagtattgaaggtgatggatgccttaattacgctgattggatctttacaaattatattaatgtattaaattattacatgtatgcagaaagtctgtacacctattatgcaccaataaaaaagaaattttttaaagtgaaaaaaaa

SEQ ID NO: 633392 - DNA, 163 bp, Homo sapiens
ttcgatgtgtgatcagagtgatgtacatcaccaaccagaacgctgtgcaacatctgtggtcatgcctggctggaccctgcacaccttacgaggtcatgctggtcctgggacaccgtgctaccccaatgcgcagcggctggcgacggccttacatgatcttgcg

SEQ ID NO: 633393 - DNA, 464 bp, Homo sapiens
tgcgaatgtccaaacttaaccttgttatagaatggttttatctagagcgagtacatgacatgcaatactatgtggatagcatgtgggactgtgctactgagctgtgaaatactgggaatgtatgaatagcttgttactaggaagagccacttagtggagaggaagcactaacagataggcaatagagtgctctgattgaaataatggtcgtaccattagcacaatcggatgaatgtcatcctcccgtgggaagagggacaggaaaaagggtgcttacgggcaaaggagaagaaagacacagttggatgataaggacaaaaatccactgagcttattgccgtggaccttcctcagttatcagcaaaatactctgtagatgcagaaaaggtgactaacttgaagacagagcctcagtacttcgatacgcaactatataccactggacgattacaaaagcatctgga

SEQ ID NO: 633394 - DNA, 896 bp, Homo sapiens
  misc_feature (612)..(612): n is a, c, g, or t
  misc_feature (896)..(896): n is a, c, g, or t
ggactgtgttttagatgttcgtgggagtttattctttctgcgttcactcaacagatatttatcgaatgcctatgtgtgccaaacatggtgccaggtatggagattcaaagagaaataagaagcagtcatgttgatgtactttcaaaaacaaaacaaaaacaaaaaaaaaaagaagaagtagccttggccttcatttggttcacagtttggatgagatggacaaggaatgttagatcagtaaattacaacattacatgtgtagtaacagatttgaacaaagcataggggacaggggtctttttttttcctaatgcaattaaggaaagttcctagaagaggtggattggagctggctcatgtgagctccatgaaagcaaggacccttggtttgggttgctcttagtgcctagaaaagggactgctctagtaggtgctcactaaatgtatcgaatgcgtaggaatcattggtgatggaggacggacagcatttctaggctcagaaccattacgtgccacggctatgtggtatctcccccatttcctcctaattaatatctattccttacccagggttcccgtaaacggcagaggctggtgtgggcagccgggatnctcaactttatgtgaggaatcctggaagtggtataagggaagtctagcctttcacaagacaattggaacaggctcagagagaagtggacggcatataaccgcggagtacaaggggcccctgggcccattgaacattcacaggggagaacaggggggagagtaggccccatagacaaggtggtgtcgcgacaaagtgtgccaccagctggaggaatagagccccctagaataacaacgtagggctgtagaaacaagaagtgctagtagtatgggttcgtcaatgn

SEQ ID NO: 633395 - DNA, 497 bp, Homo sapiens
  misc_feature (262)..(262): n is a, c, g, or t
  misc_feature (314)..(314): n is a, c, g, or t
  misc_feature (340)..(340): n is a, c, g, or t
  misc_feature (351)..(351): n is a, c, g, or t
gggacagctgcccttcctgagccggaagcctctggtaggagcaggtcaggcgtacacacctgaggcctgagggatcagacatctccatggatctgtcaaaggcaggtaggatgaagaatctggaactcaggacagtaagtggctacagacatgaatctgggtatcattcgcaccgagacaggacttaaagctttgaggctaaaggagatgtgtaagggagggagggagttcatacacatgggctttaaacaagacaaaaagnaccgtaacaaagaggaacagaaacttcaagcaaagtagaaaagaacagaatnttcttactctgacaaaaacacagcanacaccctactncacagtgaaatacggactctgacattcaccactgtgctgcaagtcccagccagcacagtaaggcaggagaaagcaagggtttaagatgggagaagtagatcgtcatgatttacaggtgatacaactgtatacgaaggaaatgcaac

SEQ ID NO: 633396 - DNA, 89 bp, Homo sapiens
  misc_feature (23)..(23): n is a, c, g, or t
  misc_feature (65)..(65): n is a, c, g, or t
acttggatgagctgaagattttnttgcaggctacaggcgagaccatcacggaggacgacatccangagctcatgaaggacggagacaag

SEQ ID NO: 633397 - DNA, 382 bp, Homo sapiens
cccttcctatcatgcagaactgtcatgaatataacaatagcgtttcgagctgatcttccatcctcaaatgactctttttgctttatatgttaacatatataaaagtggccaactgatagtcaatttagattctttattcgaggaactatcgtgaaatctgctcagcatcctcatgtgaatagactgaaactgcttgtttaaagaaaaaggttgtttaatcaggtatatctaatttaactaagttatagctacctagtctttaaagatataggtacgattttacatttatgtaacatgagtatgtcttcagataatgttaaggaagctgcgtgtaaatcatatctatcatatacgttagttaccgcagatacaggttttttgt

SEQ ID NO: 633398 - DNA, 491 bp, Homo sapiens
  misc_feature (43)..(43): n is a, c, g, or t
  misc_feature (68)..(68): n is a, c, g, or t
  misc_feature (75)..(75): n is a, c, g, or t
  misc_feature (132)..(132): n is a, c, g, or t
  misc_feature (135)..(135): n is a, c, g, or t
  misc_feature (145)..(145): n is a, c, g, or t
  misc_feature (177)..(177): n is a, c, g, or t
  misc_feature (192)..(192): n is a, c, g, or t
  misc_feature (195)..(195): n is a, c, g, or t
  misc_feature (198)..(198): n is a, c, g, or t
  misc_feature (203)..(203): n is a, c, g, or t
  misc_feature (260)..(260): n is a, c, g, or t
  misc_feature (485)..(485): n is a, c, g, or t
tggagctggttatttttggcacttttaggggttgaggattggntgggcagacaattttccaggccatntgaagantccgacaggggcttttataagaagcaggctatggcaaagaagaggacgcccagcacnttntacaggagcnccatgatgattatttagcggttcatggccganttctgttacaccaancanganctctnttggccacactggtcctgccacagcagacaggccttgtcgatcacccagccgaaganttgggccccgggatgccccctagtattctaactacaatccactggattcccagggcaaaggatctctgagggtcacggacacatctgcaatagaaaaccacagcgtcacaccccacagaagtggggttgcatgccaagtcaccccctaggccagtggcctcctggaccagtccccagccacatcatcaccccccccaagtgggaagccctcgtcaaaatcagaanagtgag

SEQ ID NO: 633399 - DNA, 531 bp, Homo sapiens
ttttttcaggagtttacaatttagtttttatttggccccattttgtttggccctgcctgccacaggaccccgggacagacactggttattctctgacttgcatcaccgccagatgtcaattgtagaaatgcataatctcctaattaccatgaccagggacaccgcagtactgtatgaacaacatatttgaacaaaacctgttcccgtcaccctgtgaaacccagaccgtgaagagtacgaattacacaaacacagtctgaaagaccccagccgcttctaaaagaaaacaggggccccggactatggggagattgcaggccgccacacttcggcaggtcttgagacactccttttcttggacagaaattgtaccgctgccaaaggcaatggccgtcctggaaacttttatttttttagcgatggcccacaccttaaggtaggggtcgcgtttccccatgcagggacccgcccattaaccccatcttggcaggaattctcttttctggggggaacttcagttaccgcgcggcg

SEQ ID NO: 633400 - DNA, 280 bp, Homo sapiens
tgactctgagtatccctccctatagacatcatgtagtcaaccatctatctccaacgggatgactatccagactatataaagaactgtaactcaaacaacaaaaacaactcaaatgaaaaacgggtaacggactagaattgacacacctccaaagaagatatatgactggctcacaagcatatgaaaagctgctcaacttcactcatcactagggaaatgcaaatcaaaaccacagtgtagtaccacttcatgcccattaggatggatgtctaatagggca

SEQ ID NO: 633401 - DNA, 912 bp, Homo sapiens
gggagctttcgggacactttgagaaccagaaggtgatgtacggcttctgcagttgtcgaaggactcccaagactgctctgccaaaatacgtgcctcatcaacatgggtgggcagaagatgtgcctgatgcccgcaatgtgcagcttgtgccagtcctcagttgacctatggcctggcaagcgggggaaggggcctccacactccagggtgagcccagggcccccacgcacagcctcgggtactgagagtcaccctggcagagtgtgccccttgctagggattgaaggtggctccggaagcccacttggttggccaagcaaggccaaaggctgtgcctacccgttctcaacatttagatgagctgcctgagcctggcagccaccttctgtgatccccagaggaagtggaaaggggagccacctgagtctgacccctcagagtcactcaactctgacccgtcaggccacttgcacggaagctgggagccaaagacgtcgagggatggccgtgaagcccaagcagctagataaaggcagatgcgcagaaggacccaagccagacaacggcagggtgaccccaggcccaacgttgaggggggtacttccaagatccaaagtctacacgtgcagggacgggacctgttgccccagatccgggaaaggagcctcttggttgccaaacggggcataccgttcgttccatggtgatacgtaacatcataaatgtcctacccatagaagcgaagtcagatgcattcatccattgccatgtgcgaactgctagaaatccccagtttaccgagtaaaaggaagggacgcagcgcgcgatacgaagggggtgcgtcagataaggcaggacatggccggccacgagccctgggcataacccgcttggcaacgggcgcgcaccacc

SEQ ID NO: 633402 - DNA, 939 bp, Homo sapiens
gtcatcctcgggagcccacccggacgagtggggagagtagacagcgagaaccagcggcggtggctaagcagagactgtagatagtcggcgacagcgactgacgcgcagcagatggctggtgaagcggggccaggaccccgaggagctccctgtggtgcagtgaggacgccgtgtgtcccgtggtcctggcgctggcatcccgggcaaccagctgcgaggaacgcttgaaggagatggaggcggagatggccctgtttgagcaggaagtactgcgggctccagtacctggaatcccaattgctgtgcctgcggtgcccacgtgtcccccacggtccccacagtaggaagcgagtccaggtccgcagcaggctccttgatgaatcgcgtcctaatttatcgctgagcaactacatacgctaggtcaggtccagctaagactctggaggcccgatgcaagctgctgcaggccacagtagttcctcccaatgtgttggtgtggcccatcctatttgtaggccctgttgtgctttggtccctgtgtgatcggagtcaccttggacagagcccataatggctcggaagacagcccagtgtttcccctgtctgcgaggcaaggccctgttgactcccgggttgctattgggcaccttaacaggtccacttactacaagcagagagcacatcaatgggtgacccaacattccgtagacacttttggggtcgcgccattggggagcctcttggcccctagcctaggaaatggctcgttacagcgctagagaaatctcgagtacaaacgaaagtagaggccgcacttcgtgtagggacgaagcgaccgggctttccaactttggtagacgcgaaactctgtttatagggcacttataggttccaccggggaaaaccgaatgaataactattaggaagcataccgcctgg

SEQ ID NO: 633403 - DNA, 176 bp, Homo sapiens
tagaggatcctcaggacttgagaaaggcagttcttttgcatttctgtgaatactccaccgcaaatgagctgggggaggactgacattgtgacacctccctgactgcagatatgcatgtgacttgttttgaaatgccaaaagccgtaatgtacaaagcaacgaaggcaagcgcagag

SEQ ID NO: 633404 - DNA, 357 bp, Homo sapiens
cacgagggaaacggtggggcctcgtgcgcacgcgccttggctggcgaggagctagggaagggagtcacggcggggcgcgaagggaactgcggatgagatagatgggggaaaacgtttgtcgggaggcgactccaacagagccccagggtgcagaacacaaggaaggctactgtcgccctcggccgcttgccagtctccctgggcgctgcggcggcgcggggcgctgggcctgcggcgcggcgtcgtgacgtcacggtggcggcagccgtggttggcgcaaggtccgcggctgcaaagtgtgaattacgccgggctcgcgccggcggcggagtgaagtcaggctccgggggaggggag

SEQ ID NO: 633405 - DNA, 1192 bp, Homo sapiens
  misc_feature (267)..(267): n is a, c, g, or t
  misc_feature (273)..(273): n is a, c, g, or t
agcgggctgggagcgggtgggcggccgggaggcctggagcaggacggccgcacgacctggagctccggctgcgtcttcacgcagacgctaaccgccatgcgcctgtctgcgccgcggccgccgctatggaggctcctgccgcttctgctgctgtctgcctggccgtgcctggacggctcggcaagaagcctgacttgcctcgtgtccatccgtgtgcctgggggcttggtggacaatgtttaactcaggggtatggtggatcaccgntacaangcaagcaactttcggcggacgcggacatcactggtcttcgtgcgtatgcgagagagatgcaacgccttgttacccatatctatcgatgctcgcactcgaggaatatcggcctggcgtggatgactacctgcggagggtgctgtcgcgatgaggcacgccggatctatcgagagtggcgaacttccatgacttgacgtaagaagggtctgccaagggtacgggaagcatcccttgtgaatgagtccattggtctagtgctttggcacgacttttgaaacgttaggctgaaagtataccatagtatgctttaatatctgagagtgcgctatctatgttgcttcgatatgaaccaactagtatacatgctggtgatcgtggccttcttaccatggtaaactctggaacgtgttcgctcgttatctgttgcttcgacctagtggaccagaggacggaaaatcccccagatagagttctctctgaaccagcggcgggtgaaacactgggctcccaacctgaggccaagtacgggagcacattgggggaaaagccatagaacttagcgggacgaaacggggaggggttcacccttgcggcgagaggttagctccaacagaaatggggggagcgatagcactaagggggagttctccgcgacgtggcgatgttcaactttgggacacttgtctccattgtggtaatccgggggttctatatctattcaacgagggttccgggctctccccgggagaaaaaccggacgggaaactctcaaactaatggccatttcattgactagccgagggcgccgtggtatggtaacctgtaagcgctcccccttgggccagaatcgtcaacgaggtgtgccttccggggggacaccacattgttaacacccagaagccaggcagagatacactgg

SEQ ID NO: 633406 - DNA, 488 bp, Homo sapiens
agacggggtctcgctctgtcaccaggcaggagtgcagccgcaatcttggctcattgcaacctctgactccctggttcaagcaattctcctgcctgagcctcccgagcaactgggactacaggcacgtgccaccacgctcggctaatttttgtctttttagtagagacagggtttcaccatgttggccaggatggtctcgatctcctgacctcgtgatcctcctgccttggcctcccaaagggctgggattacaggcgtgagccaccacgcccagccctaaaaatgcatttttttaaagaaaattaaaaaacccggaaatatttgttacggggatctgaaaaaataatgtacaaaatacaagtttttgcaaattttcagcccaccccggccgcgaatattaataaaagtggttcgaacccgggaatttcggacccggtccccgcagggggacccaaatttccctaaagggagacgcctctaatctttgg

SEQ ID NO: 633407 - DNA, 701 bp, Homo sapiens
  misc_feature (13)..(13): n is a, c, g, or t
  misc_feature (71)..(71): n is a, c, g, or t
  misc_feature (229)..(229): n is a, c, g, or t
  misc_feature (240)..(240): n is a, c, g, or t
  misc_feature (249)..(249): n is a, c, g, or t
  misc_feature (259)..(259): n is a, c, g, or t
  misc_feature (296)..(296): n is a, c, g, or t
  misc_feature (303)..(303): n is a, c, g, or t
  misc_feature (323)..(323): n is a, c, g, or t
  misc_feature (365)..(365): n is a, c, g, or t
  misc_feature (384)..(384): n is a, c, g, or t
  misc_feature (449)..(449): n is a, c, g, or t
  misc_feature (510)..(510): n is a, c, g, or t
  misc_feature (521)..(521): n is a, c, g, or t
  misc_feature (566)..(566): n is a, c, g, or t
  misc_feature (570)..(570): n is a, c, g, or t
  misc_feature (584)..(584): n is a, c, g, or t
  misc_feature (589)..(590): n is a, c, g, or t
  misc_feature (594)..(595): n is a, c, g, or t
  misc_feature (597)..(597): n is a, c, g, or t
  misc_feature (600)..(600): n is a, c, g, or t
  misc_feature (612)..(612): n is a, c, g, or t
  misc_feature (615)..(615): n is a, c, g, or t
  misc_feature (617)..(617): n is a, c, g, or t
  misc_feature (621)..(621): n is a, c, g, or t
  misc_feature (639)..(639): n is a, c, g, or t
  misc_feature (685)..(685): n is a, c, g, or t
gaccagccgagcncccctccccacccgccccgtaaaagtgctttcaatgaacagggattcttttctttatnaaagacccaaagatacgtggacaaaaaaagaaaagcttgaagtttcaatgcctaatgtgtgcacataaaacaggcacgaagaaacaaacgtgtgtttcctcttaattcctatatcacaaatatagcagaagcagcaatctgtacagtaaaatgcagtnatggaaaaacnatctctctnaagcatctgnaatacttaacaatgtttaactttaaaatgcatagtgntcagganaggatacttaggccagagangcagctgaactcccacgttcacatgaagcatccccatcgatncttaagcatatgttaagtnggacttaattgggttacaaaccacaagaataatatacaactggctaaggggctatgtgataaatnatcaggagagaatctattcatgctctagtttgatacagctaaattcttttcagttcacaanacccattaatnatgttgtatagagaccaaaatgtaaagagagatagaatacattantgangtgtggattaattnaagtnnaggnntntanttgtgttaaagnaangntgtnaaaaggagataatgagtnaatactaaaaagggtttgtttattaaaaaattattatataaatggnacaagatgggtagtga

SEQ ID NO: 633408 - DNA, 489 bp, Homo sapiens
gcgctcatccaccgttcttaaccggttgtcagactaacgtagggcggtacgcgcttcattcgctgcggcgacagcctcttcttccagcttctgagcctcggcggccgtgatgctgacggattcggtagtgcgctcagccatggcttcaagctcttggatggtagacttcgccctgctcttcctcgaggtgttcccgccaggaagagatgtgggtctccatgaccctccgttcagctagacgagactctgcctgctccagaatcgccacacctaagtcctcgagttgtgacaccacggtttggtgggccttctcggcatcgttccctacggtcatgacctcagaagtgggggagattcgcaactcgccaagcctcacccatctccatgacgagctcgccatttacccggcgctgattcgtcgtaccgatcggtacatcgaggtcggcgccgtccatgcgtagcgaaaccccgtcggcgaggtgttcgatg

SEQ ID NO: 633409 - DNA, 944 bp, Homo sapiens
  misc_feature (39)..(39): n is a, c, g, or t
atggcgtagggatcgagggccccgcggctgggtattaanttcggacgaggctcagactgcctctgagtggggctggctggccaccagatcctgccaccatgccgcagcatcgtcaggaccctccagcaggcatgagctgggcagagctttcctggccatctgtccatgcaagtgctccagcagtcctttttgcacactcttggattccttaccggatattacaaagaggctgccccctttgacaggagggctacatcacttggtcgtggtcgacccaatcgtcaccccagcagccgtggcctgtaggagtttccaaaggtgggagatatcatgctctggaattttggcatcaaggtacaagaccccaccttcatcacagggattggagctgggagggagcatcactgggctgaagtttaaccctctcaataccaaccagattttacgcctcctcaatggacgggaacaactatgctgcaagactttaaaggcaacattctacgagttttatgccagctcagacaccatcaacatctggttttagtagcctggatgtgtctgctagtagccgaatggtggtcacaggagacaacgtggggaacgtgatcctgctgaacatggacggcaaagagctttggaatctcagaatgcacaacgaagacagtgacgcatgtggttccctgaacccatgctgtgattggttcctggccacagcctccgttagatcagaccagtgcaaatttgggactctgcgccagagtttagagggaaagggcagcttcctctaacgtcgtctgccgcagcaggcatcctgtcctaacgcagcttgtttcagtcccgatggagccggtcctgaccacggaccaaagagcgaaaccgagttactctgcttccagagggactgccctgggctgatcccgacctcaacgtcttcagactgaaac

SEQ ID NO: 633410 - DNA, 619 bp, Homo sapiens
  misc_feature (68)..(68): n is a, c, g, or t
  misc_feature (207)..(207): n is a, c, g, or t
  misc_feature (549)..(549): n is a, c, g, or t
  misc_feature (592)..(592): n is a, c, g, or t
  misc_feature (609)..(609): n is a, c, g, or t
cttcgacggtctgtccagtacatactttatttcagtttccataaactaattcttggctttgagatttnttattatacatttagcaaatatttacttgtgtaaaatacagtcacaagtcacttaatgacagaaatgctttctgagaaatgcatcgttaggcaattttgcccttttgcaaacatcatagagtatacttacacaaactanttgaacagcctatgatacacctaggcaacagggtataggctattgctcctaggctacaaagctatatagcatgtgactgactatactgaacactgtaggcaactataatagtatgtatgtaactaaacacatctaaacacagaaaaagtacagcaaaaatacagtataaaatatttaaaaatggtatatctgtacagggtacttaccatgaatagaacttacaggactggaagctgttcttggtgagtgactgagtgagcagtgagaatgtgaaggacaaggacattacactactatagacttcataaacactgtatgcttaggttacacgcaatttataanaaaatttttcgtcagtaaattaaacttagcttacagtaatgtnttatttataagctttanatgtttaact

SEQ ID NO: 633411 - DNA, 122 bp, Homo sapiens
gtacgatcaggagtcgggcgtcttaaccattcgacaaggatcatggcggttgctggggccgagcagttcaaggcctgcctcatcagcctgggcctacgacgtggagaatctgaccgagcagg

SEQ ID NO: 633412 - DNA, 1119 bp, Homo sapiens
  misc_feature (251)..(251): n is a, c, g, or t
tatgatccaagaaatttgatcagaagctgtagcgtaaatcctcttactgaagccaacaatggtatatatagatataatacaaatgtgggacttcacatataacgtcgtctccttcttacctctgccgtatataaggatctctatatagaataacgaagagcttaaaacgtgtaatggattgcagttcgcacctaatatatatcgttacaccctttgttagactcaatatgagtacaaagtacggtttatcnggctatctatttactctaactcactgtgtattcgaaaatgtacctttgtcaactatacccacatgacatcaggtcgtgctcttgattgcggcaggtataacatttggcacacgttgaagcgtttccccgtctatatataataatgtaaattttgtttgctcaatggcattcatgaaatctatgtcggaggctcaagcatgtcacgggtaacatcggcacagaatgtgctggagttggacaaatatgcttgccagggtgacaccccaatttccttgtcgtgacgtaaaatttggaagcctctaaatcttggaaagttctccttaacggaaagttcctggatgcgtcgcaaacaccgtaaagtggcaagctctggagttaatccccaagcattttaccactttcacaacgcaaggcgacttttacaaactttgaaccttgactttttaaattcgagctcctttggaacatagggttcctttatcccacgagataacatgcgaagcgttatggtagttcaaggacggtcttgggaatgggtcattcgtgccactaaaaggaacgcggggagcgttatgcgaaacagttaatagggattggtttaatcgttcacttggggtaaggtaagagtaggcccggattatgttcgggtcgacctgaaatgagattccgataggcccgttttaactacggccaagacaacgatacttgggcttaacgagagtctctgagccaaattgacattagggaacaatattaaggggggtatcaccccccgtttaagcacggggcccaatcccagaaatttggcgtcctagacaaatctagggcgacaaattgtttgcggaaacacccaataggaggtaaacca

SEQ ID NO: 633413 - DNA, 914 bp, Homo sapiens
ctcctggagagcaaggtacgcgggggagcagagatgatccgcgccgcgccgacggcgctgttcctgctgctgctgctgctggtgctattgtcctgggcgtcccgaggcgatggcagcccccgagcaggacgagatccagcgctctccccgggctgtgccgaagtcacgaccgatcattgtacctggcgcagctactccggtcgtacctcatgaggctccggtctctgaagcgacctccactagctggtttgtggagctccctagaaggtatccggacgaatcagccgctgtggtgctttggcatcaagtggggtgatcccggggctgccaagcttcacttagatgaggctacgctacgatgatgagacagtaggctccccattccctggtctctagctccagtatgggattgtctaccccgtgggaagataacgagagctcgccttagtatctttgggaaagttcctgaattgaccgagaatgtggtatagtagcccttgtgaagttccccccaaagcctggggtggtgggcgctttcagtccataccttccgggaaattgaccaagggtaatataaggttgccaagcgttaaatagaccaacttggagggttcggccccaggatgccaaagttattcgaaggggccccgtgtccaaattatttgtcctttccccgccctccttgtccccgagaaggttaccaaggaaaaccaaagcaaaagcgttttcccctagaacccggggggaggaagcctaatggcctgtgccatccttacgatcccgccaaccctggggcacggtgcctgggtccatgccaggggatccccaagcaatggaaccctttcagggggggctgggctggtggggccaactggacttcctcctccctatgagccagaatggacaagctcccc

SEQ ID NO: 633414 - DNA, 347 bp, Homo sapiens
tgagagggagtcttgctctgtcgcccagtctggagtgcagtggcgcgatctcggctcactgcaagctccgcctcccgggttcatgccattctcctgcctctttctcccgagtagctgggaatacaggcatccaccaccacgcccggctaattttttgtatttttagtggagatggggtttcactgtgttggccaggatggtctcgatctcctgaccttgtgatccgcccgcctctgcctcccaaagtgctgggattacaggtgtgagccaccgtgcccggcccacttttgaaaaacagtttcagtgagtatcgaattctagggtgactacttttttcttttgctact

SEQ ID NO: 633415 - DNA, 171 bp, Homo sapiens
tgagggtgcggtcgtatatctccaagaagaactgaggttgtggagcgggcaggtaggactattgttcccgttgcgtcttggctgctgtgggatgctgttgattcctcactacgtgctgagagttgtggagctgtcagggacagtgtgcttgttgcagttcacgaccgcggg

SEQ ID NO: 633416 - DNA, 668 bp, Homo sapiens
tgtatggtgggaaggaggccaggacggagggagatgaagtggcggcacgtggtgcggacgagcatgggcatggatgcacccgatctcccccaactgtgtaccgcacgcccaccgaggctctggcgtcctttgatctaccacttgtccgcgcagggggcataggttccggcatgccggtgtgcatgcggtgccgatgagcccaaacgatacattggtgggtagcagtcggagcccaagtgtatccatcactcaagctaatgcgagactcacagcagcaggtgcactcggccgtccgagtgacacacgatgctgcggagggaccatctgtagtgaaggcttgcctgacgaagtgtggcgatggcttgccatgatgggcgagaggcacctgggccctgtgtcactggcgggcgccatgagagccagtaatctcctcatcagtgagatatctcgagcccgagcttggatggtcggcagtttgcgatgcggcctcgatgtacactggagacgggcgggtctatggaatgtgcaatgtctcggaactgtatccatctgatctgtcaacgccaacagcgggcaaacaaatcgcgaatgacaccctagtgggctaccccagtgccagggtagctgcggaccgccagggggcccgacatcaaacgcgggaaggtgcc

SEQ ID NO: 633417 - DNA, 481 bp, Homo sapiens
  misc_feature (4)..(4): n is a, c, g, or t
tcgntctagaggtcccctgtctgcgtgatcgttatacccaggacatcttttgccacataatgggaaactgcatacaatagacaaactgtcctgggctataggagggagctggaatctctgactatcttacaattgaagaattggtgaagcacttgtagagacagtttcatgtggaggaaatcttttgatgaatgttgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacaatccaagcctaaagaaaaattagtctatgccatttttcttaaatggcccacatcaggacagctgttccttggacatcccaaagctattctgcgggcaacagaggtgaaactactgggccatggacagccatttaggg

SEQ ID NO: 633418 - DNA, 1057 bp, Homo sapiens
gccctaaaagccaaagggggaagggaaagagactcgatgatctaacatagtcgtgcgataggacagcgtagattcgggcaagtccagcactactggccatctgatctagtaaatgcggtggcagtcgacagaaagaaccattgataaagatttgagagcggaggctgctgagatgggagaagggctccttcaagtatgcctgggtctggtgataaaggtggaagagctggagcgtgaagagtggtagtcagacattgatatctgcctggtggagaatttgagaccatgcaagtacgtatgtgagctatcagttgatgccccaggacgcagagactttatcaaaagacatgattacagggacgatctcaggctgagctgtgcggtcctgattgttggctgctggtgttggtgaatttgaagctggtatctccaaggaatgggcagacccgaggagcagtgcccgttctggcttacacactgggtgtgaaacaactaatagtcggtgttaacaaagatggattccactgaggccaccctacagccagaagagatatgaggaaatcgtgacggaagtcgaggcacttacattgagagaactggtaggaccccgaaagagtagcatatgtgccagatttctggttggaatggggacgacatgctggagccaagtgctaagatggcctggtcaagggatggcaaggtacccgtaaggatggaaggcagggggaaccacgctgcttgaaggtctggaaggggtcctaccggacaatcgtccaatgagaagccttgcgccaggcgactccaggatgtctaccaaacgcgaggccaggacggcctggtggcagaatgtgaaacggggactccaaaacgggcaggcggcgcacctgggcacaaaaagctacacgggagcaacacggcaacggcccagcaactcgagagaacccccgggaacacaggcacggcaaaggcggcaacaatcaccgacaaatgcgacaaacccacgcaatcaccgcgcggaagaacaaccaaacaccacgagcacccccacgactaaaca

SEQ ID NO: 633419 - DNA, 874 bp, Homo sapiens
cttcgtcgatccgacgtcgcgtatctctgcggtcgcaatggaagaagagatcgccgcgctggtcattgacaatggctccggcatgtgcaaagttggttttgctggggacgacgctccccgagccgtgtttaccttccatcgtcgggcagcctccgcatactactcagggcgtccatggtgggcatggtgcctagaaggactacctagcgtgggcgatgaggcccagtagtcgaagctgtggacatcctgactcctgaagtatccccacttgagtcatggcatcgtcgatcaactgggacggacatggagaagatctggctccacaagcttctacaactgagactgcgtcgtggtcctccggagtgagcaaccacaggtgctgctgaccgaggccccccgtggaacacccaaggaccagactagagagaagatgactcaggattatgtttagagaccttcaactagcccctggtgcatgtacgattgaagtcatccaggccgtgtcatgtccctactactgccgtcgtggtggcggcaccactgtggctattgtcatggaactctggtacgacaggtggtctagcctaacgatggtgcccatttacgagggctacgccctcctctaagcgattctgggtctggagctgggtggcgggagctgagcgactagctcatgaagatcctcacgtgagcgagagctagagcttcaccacctatgggcgagcgggaaatcggtgcgcgacatggatgcacacggtgtgctacggtcggcctggatgttcgaggcaggagatggccaacgtcggatccgtgctcattctctggaagaagagctatgatggtggcccgatggccaggtcatagctttggcata

SEQ ID NO: 633420 - DNA, 728 bp, Homo sapiens
ttggggaggggcgcgggatcagtaaagctcccggaacgtggtctctggttacccgatagcaatagctgggtggtgactaccgggttgaatcctccgcaatcatgatcatgacccaggggggcaaaccgcacgtctgctaaccttgaagcgacttcgcgaggaggtagtgaaggttcggaaggtcgatataactgtgtatctctttcaaaacgatgcgtggcgcaacagcgaatgacgtcagatgatcatatctttctccacccgtgcctgtgacaacacatctcaagaaactcaaagaatcatactgtcaaagacagggtgttccaatgaattcactcaggtttctctttgagggtcagagaattgctgataatcatactccaaaagaactgggactggaggacagaagatgtgcattcgacagtttatcaggaacaaacggggggtcattcaacagtttagatattctttttattttttttctttttccctcaatcctttttctatttctaacaaatagttctttcgtactgtggtgttcaaaacggaattgaaaactggcaaccccatctctttgaaacatctggtaattcgaattctagtgctcattattcattattgtcgtccccatgtgctgatatccggtgatcaagcctcagtccccttcatattaacctctcctttttaaaattaccgtgtgcccagagaggtcccctttttcaggacct

SEQ ID NO: 633421 - DNA, 242 bp, Homo sapiens
gccgccgccaatcaccgccacacgcttgcccttgaacagcggccgtcgcagtgcgggcagaagcacacgcccttggccttgtattcttgctcacccggcacgcccatctcgcgccagcgggcaccggtcgccaggatcaccgacttggccttgaggctggcgccgctttcgaactggatctcgtgcaagccgccgacttccttggccggcaccagggcgctggcccgctgcaggttcatgat

SEQ ID NO: 633422 - DNA, 351 bp, Homo sapiens
ccacatctcccttctcaaccagacacctgaaagcgcctgtgtagcggtagtatccctctatgctgctgggttcactcaggtttaggcttgacaccatcatcagcttacagagactggagtctctcttagacccaggggcacaacctgcactgaactattcgtcaaatgtccagtggttgctcttattgtagagcaggcccatgtggatgttccagccagcggttctgccatctcccgtatggcaggacttcatgcctttcagattgtcccaggtaaggtcagaagctgatttcttcccccctgctacagctgccaagacaggctccagacctcacatgcccgctatgtacg

SEQ ID NO: 633423 - DNA, 228 bp, Homo sapiens
ggagctgaagcatcctaacagtagggtcacgctcttatgagaatctaatgcttgcgactgatctgacaggaggcggagctcagtctggaatggttgctcacctccagctgtgcagccagtacctaacaggccatggactgctactggtctgttgcctgggggttggggatccctggtataaagaggagaaggggccgggctaggtggctcatgcttgtaatctcggca

SEQ ID NO: 633424 - DNA, 985 bp, Homo sapiens
tttttatggtgagaccattgggagaactaacttagattttaggctctaatatagttctgtggtaaaaataagatcatgtaacacttatgctttagaaatttccatagagaaggatcatgtcttaaagccaaaatttatttggtagacacaaggatacgggaaagtagaacatctaaatactgtgtgtgtgtgcgtgtgcgtgtgcgtgtgtgtgtacaccagtgaaaggaatcaggcagtctaagagaactagctatccatccagcatgaccactgtaagaatgaggaatgaggcaggacaacagagaactcttaattgttcagagaacccagagaactttgtcccctcccccgaaaccctgcagaatgttgagtctgaaagtatgagctggttaacatgtcaggggcccatgacctgtggaggaggaaacgatgatgtgacaagcacagaaccggctgagccactgtagatgcagggctcatctccatgaatgtcaaaggaacttaagcaacactgaagctcctccacttgaaagaagcccctgtgctgcacatatccaccaaggccaggagaaagaaaggagagagacacagcctgagaccgcacagtttcttgggaagctccccagtaaggcacgggcacaggtctgggtgcctgggtctggaaaagcagagagcactgccggttgatgacagagatcctccatcatcagcagttgttgagcatgtcagtggcaggcgcgggaagggttgcccagttggttcccaaaataggggaaatccgtaagaggtagaacctctatttgggggcgctgacttggctgcaaaggcctgtgaacagcgatggggaacatatataccgaacgtggaatgggttattatccaagagacccgaaacggagggaaccggagaggtcttatgacagtcttaagagaaaatacacgtgagcacgacagagttgggcacaaactccgtaaggttggg

SEQ ID NO: 633425 - DNA, 100 bp, Homo sapiens
acgagctagcaccatgacttcaataccctagtcaggggggaggcttcagtgagccaagatcatgccacttcactcggcaaaatagcgagattctgtctca

SEQ ID NO: 633426 - DNA, 492 bp, Homo sapiens
gtgagtatggttaaaatttgtcttaagttgtattttctgctcattttaatgttaaccaatctttgattcctccatctagtcctatgaaatagaataatagttctgcagctggtacagtaataagaaataccaaaaaagtttgtttccctacagcttatacccttgaatcaaagaactatgcagccataaaaaagaatgagatctgccaggtgtggtggctcatgcctgtaatccctgaactttgcaaggccgaggtgggcagaccacctgaggtcaggagttcaagaccagcctgaccaacatggagaaaccccatctctactaagaaatacaaaaattaaccgggcatgctggtgtgcacctgtaatcccagctatttggcaggctgagacaggagaatcgcttgaacccgggaggcagaggttgcagtgagatgagatcacaccactgcactccagcctgggcaacaagagcgaaactccatctcaaaaa

SEQ ID NO: 633427 - DNA, 117 bp, Homo sapiens
  misc_feature (50)..(50): n is a, c, g, or t
ttacaggatcttcccgactagccgacagggctgaggggagtgaggcaggnaggatgcattgggctgtgggaacagaggacaaatccctgtaccacctgactgtcgggctagtcgggg

SEQ ID NO: 633428 - DNA, 332 bp, Homo sapiens; identical to SEQ ID NO: 597440

SEQ ID NO: 633429 - DNA, 695 bp, Homo sapiens
  misc_feature (676)..(676): n is a, c, g, or t
ccatccttcatctttagcttgggtacaacactgggcatctgaagctctctctctcttttaatttaattgtaatgacactttctatcagatgttatttactctaacctacaaatgcaatatgtagtgagcaacagttcatctgggcaattatatccatattcacttatgctaaatagttgaccagggagagggtaaacagcatgatgattaagcaagcaagtgatggcttctacccgcctgggttcatgttttcactcttaaatgtgtgaccctactccataggagagctatccatccacttccagtttcagtgatctcatctgtaaaacaagaataataatagctaactatattatgcaccatgcactgctacatgcaatctacatacagcaatttatgtaatgctcactaccatgcttgaggtaggtatccgtataacatcccattctacagatgagtaaaggtgctttgagaagttacataactatcctaattcacagctagacaatggaagtctgttgtctcaagccatgctctgagctacactttatgttgtagccctacctgagagatatcggtgataactgggaagacacaagatgattaacgaggtatgcatatggtgcataaacgttgtgctaagcttataacatactaaagattggtactgtgcagntttctgtactgacctgttt

SEQ ID NO: 633430 - DNA, 385 bp, Homo sapiens
tctaaggtccgggagtagtcattggtgtgaggagtcagtatatgtgggattttaggtagtgggtgtgagcttgaacgcttcttaatggtggctgctataggcctactatgggtgttaatttttactctctctacaaggttttcctagtgtccaaagagctgttcctctttggactaacagttaaatttacaaggggtttagagggttctgtgggcaaatttaaagttgaactaagattctatctatggacaaccagctatcaccaggctcggtaggtttgacgcctctacctataaatcttcccactattttgctacatagacgggtgtgctcttttagctgttcttaggtagctcgtctggtttcgggggtcttagcttcgcgc

SEQ ID NO: 633431 - DNA, 262 bp, Homo sapiens
gctactcatagaggatcccgtgttctttgctgggactgagaggctcacgaaggccatccgcaactgttggttcactgagagctgctcctggtctcttcaccactgtagttctctcatttccaaaacatcagctgctttaaaataagatctcttttgtagccatcctgttaaatttgtaaaccaatctaattaaatggcaccagcacaagaaacacacgaggcaagaagttatcagtaccagcacaaagaaccagcacaagaa

SEQ ID NO: 633432 - DNA, 275 bp, Homo sapiens
tcccaatggcagaaatttattcaaaacttccgatttgaaaacacaatgccatgtaccagaaccccgggttagcacctgacaggagttgttccgcactaggtaggaaaaccgtccaaaaataaagccacccctcagcaaaaataaggccaatttgtacggtaagctttccaaaactgaaaacccatttgggttgaaacacatccaaatccggagacaacattggggggatccatcagcaccattggttacagctgttgggggggtacgttcttgga

SEQ ID NO: 633433 - DNA, 989 bp, Homo sapiens
gcgaagcgccccgcctgatccgtgtcgatcatgctgcgccgcgctctgctgtgcctggccgtggccgtcctggtgcgcgccgacgcccccgaggaggaggaccacgtcctggtgctgctggaaaagcaacttcgctggaggcagctgggggtccacaatgtactctgctggtggtaagttctatgccccttgcgttgttggacactgcaaaggcatcgtggcccctgagttatgccaagagcctgactggagaaacgttgaaggcagaaggttcccgagatccaggttggctcgaagggctggacgccacgggaggagtctgaccttggctccagtcgatgtacagggggtgcgcaggtttatcccacacaatcaattgtttcttcaggaatgggagacacaggcattcccccaaggcaatatacaaggtgggcagagaggctgactgacatcgtgaactggtctgaagaagcgtcacgggcccggcatgtgcagcagcctggctgacggcgcagctgcgagagatcctgggtggagtccagcgaggtggctgtcatcggcttcttcaaggacgtggagtcggactctgccaagcagattctggcaggggtagcagaggtcatcgaggacatagcatttgggatcacttccaaccaggtggacgtgttcttccaaaataccagcgtcgacaaagatggggttgtcctctttacagaacgttgatgaaggccggaacacctttgcacggggaggtcacccagagaacctggctgcacttttatccaacacaacagtgccccttgtcaccgaggttaccgagcataaagccgagaatttgggggaacccaactccctcctggtggtctgcccaacgggttgcatgcgggactggcacttcaatgcgcgagcttcggggcagctgccctcaccccgcgaccgaacagcgctctgttttcgaagagagcgcgggcaccgcgagagcacacccc

SEQ ID NO: 633434 - DNA, 666 bp, Homo sapiens
  misc_feature (16)..(16): n is a, c, g, or t
  misc_feature (62)..(62): n is a, c, g, or t
  misc_feature (75)..(75): n is a, c, g, or t
  misc_feature (79)..(79): n is a, c, g, or t
  misc_feature (89)..(90): n is a, c, g, or t
  misc_feature (99)..(100): n is a, c, g, or t
  misc_feature (104)..(105): n is a, c, g, or t
  misc_feature (108)..(108): n is a, c, g, or t
  misc_feature (131)..(131): n is a, c, g, or t
  misc_feature (143)..(143): n is a, c, g, or t
  misc_feature (161)..(161): n is a, c, g, or t
  misc_feature (167)..(167): n is a, c, g, or t
  misc_feature (187)..(188): n is a, c, g, or t
  misc_feature (190)..(190): n is a, c, g, or t
  misc_feature (194)..(194): n is a, c, g, or t
  misc_feature (210)..(210): n is a, c, g, or t
  misc_feature (232)..(233): n is a, c, g, or t
  misc_feature (235)..(235): n is a, c, g, or t
  misc_feature (253)..(253): n is a, c, g, or t
  misc_feature (261)..(261): n is a, c, g, or t
  misc_feature (284)..(284): n is a, c, g, or t
  misc_feature (301)..(301): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (339)..(339): n is a, c, g, or t
  misc_feature (343)..(344): n is a, c, g, or t
  misc_feature (359)..(359): n is a, c, g, or t
  misc_feature (366)..(366): n is a, c, g, or t
  misc_feature (379)..(379): n is a, c, g, or t
  misc_feature (410)..(410): n is a, c, g, or t
  misc_feature (435)..(435): n is a, c, g, or t
  misc_feature (502)..(502): n is a, c, g, or t
  misc_feature (504)..(504): n is a, c, g, or t
gagttggaggtctgangccctgtgtgtctgtggtgtgtagatgggctctttgggggattgtnatttctcaaggcntggngagggatagnnaggtgcagnngttnnagncttggggtgggtggggcggtctnattccggggagngctccctgtgcgcgcggntgggtncccaccgcctctacccggtnntnaggntcctctgcgctcaggnagggttggtagcgtgtagtttnntngggaaggtgttacacgcngccgccancaggggctgtaagagggaagctnatacttacaggatttgnaggttgggctggagttcgcnttnctgnactttatcttnttgnntgttgggagatatanatagaanaagaagataggantatagcgggtaggatatggatgaaagctagnagaggaagcggagggtgagggagcncaggaatgggtcgcacttactgatgatgatgaggatatccagcaggaacaagatggttgctagagtnangcccacagtctgcaccgtgttgtagtcatagtaaaatgggtcaggttcctcaggagcctttgtgggggtctgggtcggggtcgccatgctgggccggagcagggggctgctggatgctttggcggcgaaggcgcgctgcagcagctggaacagggacggacc

SEQ ID NO: 633435 - DNA, 405 bp, Homo sapiens
atatgtgcataataaaactccataatgagagctggcaagagcttagccatcttctagaccacgcttctagccagaacaaacctatgctgaagagggcttgggggatattccgagagggtggctgggcccatcctattaacaaggagcactcaagccccaccactgtccaccagtgaacagctcagattccttagaaagagctttctgttgagtaaaatctggttctcacaatttcgggcttgaattctttaattccaggatctaagattctgcaaagcttgggaaacttctgagaggctggtgcctggaaaacctctggagacagttgttaaacttcagaaagatgcagagattttagacattcagaagaccagggctggaaaagcaaatcttgactggcccaaa

SEQ ID NO: 633436 - DNA, 304 bp, Homo sapiens
tgcttggggttgggggtcgtgggcacaggggacaactctgggaacaaaggtggccctcggtgccgtcctgcccaaaatctcccgtcccacggaggcccccggggtgggggctggggggggtcccccccaccgttccgcttttccggccaggggcttttctgtcaatttttatggaaaccaaaaggaggtttttgttttattttgtttttttgtaaagcttaaaaaaaaattttccttttatacttgagcccccatccttaaaaaaagaaaagaaaaggaatccataaaaagaaactggggcgca

SEQ ID NO: 633437 - DNA, 975 bp, Homo sapiens
ctgggcatctcgggttagagttcatgtaccaaggtaactcctgcaaggtccatgcggagcctctgctgggaaattacccttgcctgtcttgtccgttcctagtccctcactttccatgcttgaaagtttgcccggctgtggcaagttgtccgttccgggtcggacgcattgacagcctgtgggtctccttcgggatgggtagtcctaggcttggacctgtgaggtagtgttgaatcagcaggatgactgtgagcttggggcgatgccctcaatggcttgtaccgagtccagtgaccacgggacttttacatagatagcatggcaccatggagcacctgggagcccggaggcctggggaaactctcgagcactgggacctataccgaacgcgagaataccagcatcggggccagactacacacgcagccagagagtggagcctcatggtgcacagccactgctcctccaaggccactccctcctaacgcacactcctcgtgctacgttgatgtaccatgggactctgtgggagcagagtaggactgtgcctggcgtcatcttgggaatcctttctgttacctgggactggctggataggggttcttggcactggggctctggagcgtccaaacctgtagaggacccaggagggcttcggcagattccacctagtgattctgtcttgctggtgtcggatagaaagccacggcaggagcagtagactccctatggttggatctcagctgggaagtctactgttttggagcccatttgtgtgagaccctgtagtttcaaatttgacagctggaaggtgctgtgtacctctgatctcaccccagagtaggagttctgtctcaaggaatcgtcgtgtaatgtgcacatctgtgtccatgtgtgacccatgtgtctgtgatagtcagggaacatgtattctctgcaatgcatgtatgtaggtgcctggggagtgttaccccc

SEQ ID NO: 633438 - DNA, 118 bp, Homo sapiens
  misc_feature (5)..(5): n is a, c, g, or t
tggtncttgcagacaactccacccctctttgatgtaaaagtgctttattgggagacttttgtcttacagcctgccaatcaaccctcctgggtgtggcaccaatatgtgttgttgctag

SEQ ID NO: 633439 - DNA, 292 bp, Homo sapiens
ccccccccaaaaatggggggggggggggataaaacccccggttttttttttttccccccccccccccgcccccccccgggggggaaaatttttggggggcccccccccccccccccggggggggggggggggggccccctttttggggtctctttttcccccccccccccttttttttttttggggggggggggggggggggcccccccggtttccctgggggggcccttggggggccccccttttttttttcccccccccccccccgggtttttttttttttttgggggga

SEQ ID NO: 633440 - DNA, 349 bp, Homo sapiens
  misc_feature (3)..(3): n is a, c, g, or t
  misc_feature (7)..(7): n is a, c, g, or t
gcngtanggcaggatctatgatagggacttctgtgtctaatttagtctgaacactaagttccacagtggaaaaaaaaaaaaagtccaaataccaccaacgtggtcaaaatccggggcttgctgcttatttaaaaagcacacggtgatgatcaggggccaagaggtgaggcaaagccggaccagctccggtgaggcccatcaggacggtgcgtgactctcaaactcccgcacacctgtgtgacccggggcaaatttaagtttatgccattcactcacacagggggagaggaacgaaaaaacctggtgcctacagggcttggtctggtacccgggccccccggcattgggg

SEQ ID NO: 633441 - DNA, 2121 bp, Homo sapiens
tgtgagttgtccacgaggatacatgcataagtatgagaatatataccccttcctcagcaattagcacagagaattgaattaagcagtacaaaggttttcagttttaggtttacctgattaccccttactatactcaaatgcatcccaatacttctgtactcttaaatcaactgacaacctttaagcatatgctcttttgctaggtcttgaagaggaggcacaactgccttcatatgagtccagtgtgtgttgtcaaaatgtaacttttgaattgttctaaagccacagtaagagaagtaagtggttcaagtttcgtgcctttacatttccaccattgtgctttcctctccctttaccccacatacaaaactgagccaggcaatgcctagtttttgtgtgctgaacacagctgtacttacatccaccatcctctggacgtgtttgctaatggtttttggatcaggtttgggagacactccagaagcccagtccactactactggtggctttgaaggtgttagtggctaaaatgaaatatttagagaaatcctcatgactacaatgcaatattataacctatagctctttcttttcccactacctgacggttacatttatggacaatcttcaattatgttcagtggcaaggagcagagaacccacaggcaattgaaatctctactaataattttggctaacaaggcattgtgcttacggtttccagagtgctcttcacatacattatctgcagctacagataatttgaaattctcaatctgcctgagttgcaattccctctccattaaaccctttgtcagagctatcaacaaagagtaaagtggatcatttatgtttcctctctattctccagtcacattttgcagtagaaatgtgaataaggaaaagcttagctaaaaggcaggaaggcacaagaaaaatcatcggaagcctggacaagctcttttctaaatacagtcatgcatcacttaatgactgggatatgttctgagaaatgtgtcatgaggtgattttgtcattgtatgagcaccacagtgtgtacttacacaaacctagatggtatagcctgctacacacctaggctatttggtatagcctactgctcctaggctacatacctatacagcaggttattatactcagtactgtaggcaattgtaatgatggtatttgtgtatcttaacatatctaaacatagaaaaggtaaaaatatggtatagaaatttttttttaatgttacacctgtatagggcacttaaccatgaatagagctttcaagattagaaattactgtggcaagtcgtgagtggtgagtgaatgtggaggcctaacattactgtatactcctatatactttataaatactgtacacttagactacactaagtttcttaaattttttcttcaatgataaattaccttattttactgtaaaagcttttaatttttttaacttttactcttttgttatgacacttagcttaaagcacacattgtatagcttatagctgtaccagttatttcctttatagccatattctataaacttttttctattttaaaaatgtttaattttttaaatctttgttataaactaaggtacaattacactcattggcctatgtctatatagagtcaagatcatcaatatcactgtcttccactccacatcttgtcctattggaaggtctttaggggcaataacatgcatggagctgtcaccttctggaggacttgcctgaggctgttttacagttaatttttctaagtagaaggaatgcactctaaaataatgataaaaagtattgtatagtaagtgcataaaccggtaatacttactatcaagtattatgtactgtacgtaagtgtataacctagactttttacagctcagtaggtttgtttacaccagtataatcacagacatagtaatgtgttgtgctacaatgttacaattgttctgtcactaggcagtagtaatttttctgctccattataatcttaagggaccactgtggtatatgaggtctatcactgaccaaaatgtcattatgtggtgcatgactgtatttgaaactcagcccaaattaaaatctctctgaa

SEQ ID NO: 633442 - DNA, 299 bp, Homo sapiens
  misc_feature (11)..(11): n is a, c, g, or t
  misc_feature (217)..(217): n is a, c, g, or t
  misc_feature (258)..(258): n is a, c, g, or t
tcagcggacanccaccagtgccatggcctgagccccagatgtcacacctgtccgcacgcacggcacatggatgcccacgcatgtgcaaaaacaactcagggaccagggacagacctgctgccaagtgagcctgatgggccacaggtgtgctcttctaaatggcctgtgagccaggctgtgggaactctagctgctgtcagcccctcctgtaggagcntggccctgcccaaggctcctgacttccctcagggaagtctnactgtctttctccattcagtctgaaaagcctttaagtttcc

SEQ ID NO: 633443 - DNA, 118 bp, Homo sapiens
cacgttaacccacagagcctgccaagctggaagttaactggggtggcttcaccttcgatttgattcacagttccatcagctctcaactcctggtttaacactttgatctttccgtttt

SEQ ID NO: 633444 - DNA, 776 bp, Homo sapiens
  misc_feature (542)..(542): n is a, c, g, or t
tatggagcccttcccgtctttgcccatcacacagaaggaaaaatggaaactcgcagcaatctttttcaaattcttcctgagaaatgtatccatcctggtcgtgatcatagttcttgaagacagaatccaccatcctctggacgtgtttgctaatggtttttggatcaggtttgggagacactccagaagcccagtccactactactggtggctttgaaggtgttagtggtggagctctgtggttccttggttcccgggcataggaaagctcatagatttcatcctcagtgtagtaaagatccagggataacgtcagcaagtgtaccaagtccttgttagcctccaagggtggggccacctcttgcagctggaccaattcactgatatgattgtatagggccagtagcttatggacgttcactttcccgtcctccagatagtcaggcatggcttcatacagggagatgaggtccttgagatgcacacccagaatggggatcttgaagtcggtgcactctccataggctcgccggtaattgtcntagtttctggaggaggacagcagctcagtcatctcaccgagaaccttattgatttcatgtgggacatgcgaacttgtctccttgctggtatttgattttatcctttgagtaagtttcctggaccagtcacgggcattgatttgagttgtgtcaatcaggcggcaatgtaactcctcacccttagctttcaccagttcctgaaactcctccatagtgtctgtcaagctggcgtcc

SEQ ID NO: 633445 - DNA, 184 bp, Homo sapiens
actcggaccccagtggcggctgcccaaagaggagaagtgacgaccgtcactaacaattactatctcacgttgtacgagggccaacgggttatcccgccggccctcctcctcttgtcaagggcgttctttgcgtcgcactgctcggatggctgctgctacagctcgccaaccgatgagggtaaga

SEQ ID NO: 633446 - DNA, 263 bp, Homo sapiens
tatgatgctgggggggtggtgtgaggagactggagaaatatgtgcggggcagagtcccaggtggtgacaggaaagtgttgaagcctggccactactgggcaggcaagacagagttgccactgtatgcacaggggatgagcagctgccggtactccagtggcaggtgccgctccactagcacgtgcagtgagacttggtcagtgaccaggccctgccgccgcgtcagcagctccaggtcctctggcttcacagtcttgtggcca

SEQ ID NO: 633447 - DNA, 1019 bp, Homo sapiens
  misc_feature (837)..(837): n is a, c, g, or t
tgtgagttgtccacgaggatacatgcataagtatgagaatatataccccttcctcagcaattagcacagagaattgaattaagcagtacaaaggttttcagttttaggtttacctgattaccccttactatactcaaatgcatcccaatacttctgtactcttaaatcaactgacaacctttaagcatatgctcttttgctaggtcttgaagaggaggcacaactgccttcatatgagtccagtgtgtgttgtcaaaatgtaacttttgaattgttctaaagccacagtaagagaagtaagtggttcaagtttcgtgcctttacatttccaccattgtgctttcctctccctttaccccacatacaaaactgagccaggcaatgcctagtttttgtgtgctgaacacagctgtacttacatccaccatcctctggacgtgtttgctaatggtttttggatcaggtttgggagacactccagaagcccagtccactactactggtggctttgaaggtgttagtggtggagctctgtggttccttggttcccgggcataggaaagctcatagatttcatcctcagtgtagtaaagatccagggataacgtcagcaagtgtaccaagtccttgttagcctccaagggtggggccacctcttgcagctggaccaattcactgatatgattgtatagggccagtagcttatggacgttcactttcccgtcctccagatagtcaggcatggcttcatacagggagatgaggtccttgagatgcacacccagaatggggatcttgaagtcggtgcactctccataggctcgccggtaattgtcntagtttctggaggaggacagcagctcagtcatctcaccgagaaccttattgatttcatgtgggacatgcgaacttgtctccttgagcctcgagattgagctgtgacacagcccacctatcacagccatcagtgtattgaagttctgtagttggtggagcttctgagccacctgggatgaact

SEQ ID NO: 633448 - DNA, 593 bp, Homo sapiens
atctcttacataggatttcgggggcaccccaaggttgatcttatcgggacctttttcttcccataggcaaccctcgcaccctcccctacttgtggagaccaattttatttcccataatttctccgcgaaggactcccaccctgctttggcgtcgcatattattcgtagatgaaaatattctgggcgatcattgatgataaacaccgcgtcccctgcatgattctttcacaacaaaaagcttctttttcgagtagatctttctcctcgcccactctttagattcttcacacaccttgggaacactatgtttgggggtttctttacaacctggtcacacaatatgtccacctttgttccactactcctcctctgaaaacaaccacttgtatacacccaaccactcacgctttcaaatgtaagagtgtgttatttcagtcacccccgcgttgtattcatgctgtctgctatgtttctgcacttctttttggcgatcaagcactcctccgtctttcaacagttttctgtctcccaacacattactgccaccctgttgtctgcctaacaatatcaacaaaaatcaagaacaataaaaa

SEQ ID NO: 633449 - DNA, 875 bp, Homo sapiens
  misc_feature (10)..(10): n is a, c, g, or t
  misc_feature (141)..(141): n is a, c, g, or t
  misc_feature (172)..(172): n is a, c, g, or t
  misc_feature (213)..(213): n is a, c, g, or t
  misc_feature (238)..(238): n is a, c, g, or t
  misc_feature (346)..(346): n is a, c, g, or t
  misc_feature (366)..(366): n is a, c, g, or t
  misc_feature (375)..(375): n is a, c, g, or t
  misc_feature (400)..(400): n is a, c, g, or t
  misc_feature (414)..(414): n is a, c, g, or t
  misc_feature (442)..(442): n is a, c, g, or t
  misc_feature (504)..(504): n is a, c, g, or t
  misc_feature (530)..(530): n is a, c, g, or t
  misc_feature (533)..(533): n is a, c, g, or t
  misc_feature (538)..(538): n is a, c, g, or t
  misc_feature (585)..(585): n is a, c, g, or t
  misc_feature (589)..(589): n is a, c, g, or t
  misc_feature (607)..(607): n is a, c, g, or t
  misc_feature (618)..(618): n is a, c, g, or t
  misc_feature (640)..(640): n is a, c, g, or t
  misc_feature (659)..(659): n is a, c, g, or t
  misc_feature (684)..(684): n is a, c, g, or t
  misc_feature (714)..(714): n is a, c, g, or t
  misc_feature (716)..(716): n is a, c, g, or t
  misc_feature (749)..(749): n is a, c, g, or t
  misc_feature (857)..(857): n is a, c, g, or t
ctggccaggnccatctcttaccggctcctggtcaacccccagggagcgggaagagtgccagccaaaccacgagggtgaggaggacgacagcgacgtccgggcccagcaggcctgcgttgaggccaagcacgtgagggtgcnccccacccacatgtgggtttgtttgtgtgcncgtggcgtgggagcgtccccgccttgtgtggggtctgtgcnccagggaggagggagggggggtgtntgccccaagcacagcactgaacttttcacaggacaagttcatggcggacatggacgagcttttttctcagggggatgagaagaggaaggtgagtgtgtgtggcttgcngccgagggctgggaggggcncgtgcagtnccccttttcagcctctaaccgtgtncacctgttccacanaagcaagacaaccccgactacctgtgtngcaagaccagctttgagctgaggcgggagcggtgcattaagcccagtggcatcacctacgancgcaagggcatcgaggagcaccttcnggngaggntgcggctgggggagcagggccagttgcatggtcctgggccccatganttcnctttgccctttttgttanttcagcgtgtnggttattttgaccccgttaccnggagccccctgacccaggnacagctcacccccaacttggctatnaaggaggttattgacgcatttatcttttanantggctgggtggaggactactgaggttccctgcnctacctggcgttctggtccaggggagcactgggcagaagcccccggcccctatacatagtttatgttcctgggcaccccgaccgctttccccaagttctgctgttggnctttggactttttgccct

SEQ ID NO: 633450 - DNA, 470 bp, Homo sapiens
cgaaataatagcacatgcgagtgtgcctcatctacagatccttcagagattcattagccatgtacaatctaatgcatacacaaaggccgtctctccgataaatacatcagcacatttactagagtgtacgaatgatataacgactatgccaacatttatttgatcttgccactatatcaaagcatcattgccaggttgctagttgaggggaaaaaaaggttggatatttgttccctcgctcagctccagatattattctacctaactaagtccccaggtttcttccaggcatgtaagaattagtggtgtctacatggatgtaggcactagtcattgggcaatatctcctgtactcagacatccctagatgccatactgagtttgaagttccttaagtcctaatgtaaggcttctagtgaagcctcctcacagtaggcttcactaggcccacagtgcccctagacctctga

SEQ ID NO: 633451 - DNA, 227 bp, Homo sapiens
aaaaacagacacctcaaatcaagagtacactaccactattgccacatattctaacaccatcttcgctctgatgggacattagttacccttattttcatagtgaaattgtgtttcgtgcttagtctgacctttctggtatcttcatttacttccattgactttggatagagtggaaactcccactacactttttctttgttgttacagtcattgctgcttccttggta

SEQ ID NO: 633452 - DNA, 661 bp, Homo sapiens
gagacttcggttgaggaaacgggtattcatgtctcagggagtaggttggtgcagttacagcttctctgtggtatgcataattaataatgggagctgcaaaggaagaattcgtgacaatgagattggcatggtcagaacgaacaaatgggaaggacacggttgtagacctcttggtgtactgagagacattaagaaagactgaagtggattgtaggtggccaagcacttagttcctgctggttttcatttggccagtactccagccattggtgacgcgtaacagccctaccatggcctgtggccctgctctctggtgacccatcagctttaggcatctccacgggtggtgatccaagctatccagacatcagatgacaggcaccattcagggcatactctgcacctctgacagtggctaatatcctgaggagttgggttccagcacgtcccagttcactgctgatctgtggccattgtgaaccttgcacgattacaagcgaactccaagggcgcatcctactagtggatgcataagttgacttctctgacgttttgcatgtttgcatgtgggtattacctatgttggtgcgttgtctaatggtcctgcacactatggctttgggtctccattaccatcttcgggtcctgtattatgaaggca

SEQ ID NO: 633453 - DNA, 190 bp, Homo sapiens
cagctgttcccaaacactcaaagctcagatggctaaacaaacaaaaggaaaaagacagtaaggagtataacactcccctgatgcaacttaatctaacactctacactttaaacttgttctaaagcatacatttgaattcagaccacatacattctgcagacacatttatactgtgtataaaagaacagcc

SEQ ID NO: 633454 - DNA, 1564 bp, Homo sapiens
ggtgagacaaaacaagtatccgagtaacagtataggcgatagaaattgaaacctgtgcgcaattagactatagtaccgcaagggaaagatgaagagagagtggatgaggcgaaggcagtaccagtagtagcacaggacggtaacccgctataccgtctctgcgatcaatggaacttgagagcgtagaagagtaacgagtagcaaggcagcagcccaagcagcgtgcagcaggcacccccgcggagagaccgagcacggcagctcacgcgtaagcacaccagcctcacacacagcacgccacaacccagatcatcatggtgaggcaaagacataaggtgcgagcaagcatggcatcacggctcagcacggccggagccagaagaacaccgtcacccagcaagaacgcgtggcgatgcactacgccactggactcgggctcaccacaagcaactaagaacagatacgtgaaagcactacacacacggcgtgcgcaacacactctcctggccaccaccacggacacaccaccctcttaaacacatcccaacactcgggctcacaacgaatacaaaaagcccatggcgtacaaggagataaccgacacaaggcaccggggcaacaaccacggagcgtcaatatagggacgcaaccagccgtcacggcacacagataccacaccccactcatgggtgacagaacgacaggcaacgctacacacaccacacataccaaaacaaacacagcagcataatgcctacagggactccactaaccacaacgagacccaaaggccccaacgcccaaaggtctgagcagggacacgaggcaggaccgccccacagacgctccaacagacaaaacaccaaggctaaagcgccgtaacgacaagacacgtcgaccacaaaaaacgacgtaagtacagcctggaacagctccgctcaaaacacgccccgacaaaaggaggaacacaaacgtcgttactgcaacgcccaataaacaggacaacgaacaccgtacaacgggcacaaggataacacacagggtacaaccagccggacaccacccacactggcgtaacccgtacacggcgaactaacaacgaacctagggagcgaacccagcagctcacaccagcagctcgaccccccaggacacaaactacacacccacgcgacccacagaccacgtcccaacccaaggtcaaacgccaaaaaagcaacgcacccagtgaacatgcaaccccagtccaacacggaagacaaacacccaaacacaacacgacactggcatgacaacatagggtcaacgggacatacaatacaaagtatacaacaggtgtatactctcggagcaaaaacgttttaccccccagtcagcgtgtctacacacccaccgacagacagttcaacagtactatagataccttaaccaagcactattacatatatgtacccctgagcatgctcacaacagtagaccacaagtagttataacagtcacagactaatcacctctaactcgatgatactagctcatgcacgacttatctacttattatatacgt

SEQ ID NO: 633455 - DNA, 199 bp, Homo sapiens
cccagtgaccctgggccccagccagcccctccagggctttcagggaagcgccatcccttttcaaagatgtccaacgtcccttcttcctgtaggggccgagtcctgcctcctatcagggcccgatcatagaaggctattttttattttgggggacgattataacttaaatgattgttttaataaaaatttttagctggga

SEQ ID NO: 633456 - DNA, 306 bp, Homo sapiens
tatatatacagactcctgacagataaacagtcaagcctgtctgcaacagggtctgacaagcaagatgctgagtgaatacttaggcttcattctaccatggacttcatgagtgaaatgtagaacctacaagaagcttctctcaccaagtaatgacaaacttacgatttccaatggacccaaaaaccactcggtcaatgaagaagagcaggaagaacaaggtgaaggaagcgaggatgaatgggaacaagtggtcccccgtgaacaagacttccgtcacccgccaggcggctctagttcagactccat

SEQ ID NO: 633457 - DNA, 119 bp, Homo sapiens
gacgaccgttatagaccaggcatgagatgagcgagtgtatgtattctacccaccctggaatgacaagggtggtgagcccaggtgccggatgcccagcccctgaggcgggccgtactcca

SEQ ID NO: 633458 - DNA, 162 bp, Homo sapiens
gttgcctcaggtaacaactacagaagtgaatttgcagataaggggattactgctcctctgctctaacttggtgtttgggtgatcagagcaggtagccactgggagagcacttctgagtgatactaagcagtttctctggtggcctttcacatctccactgtc

SEQ ID NO: 633459 - DNA, 296 bp, Homo sapiens
tttatttagggggtaaagttatgttgctatatccccatgtttgctgctgctgttgagtttctgtgctttgggagtataataagaaagttatttctttgtcttaaagaatttttaaaaaattagtcttgtgatttattcttctttccagggtacatactgtttggttttaaaagattagacagtttagttaaagttggtttgatcatccttttttttacaaaacttgaaaattgtatctggttcttgaagaattttcacttttattaaatatgtgtatgcataaataaaatataata

SEQ ID NO: 633460 - DNA, 258 bp, Homo sapiens
  misc_feature (12)..(12): n is a, c, g, or t
  misc_feature (44)..(44): n is a, c, g, or t
ttacccccccgngggggttaatccttttttttacccccccgaanggggggcccccccccctgggggggggggggggggggccctttcctttttttccccccttttttgttgtttttttttggcccccccaggggggaaaccccccccccccaaaaagcccaaaaactttggaaaaaatgggggggggggtcccccggaaaaaattttccaaggggtttttcccaaagacccggtttttaaaaaggttctttttttcca

SEQ ID NO: 633461 - DNA, 186 bp, Homo sapiens
ttctagaggtatcccccccttcacgactaccacagctttatctgtcttgtaataaatgactattgtgccgggcacggtggcttacgcctgtaatcccaacactttgagaggccgaggaggacggattacctgaggtcagaagtccaagaccagcctgatcaacacggagataaccaggctccaggt

SEQ ID NO: 633462 - DNA, 144 bp, Homo sapiens
agttccttacaaactgccgacttggctcaacaaactgcattaccttatccatgactgcctacccgatcgcacacctaaaatgccaggcacacgtagcactggagcttgctgcatagacgcccaccggtgctgtgtggaagggag

SEQ ID NO: 633463 - DNA, 183 bp, Homo sapiens
aaccttatggcgcatctcatggatgctagtcagattcgctcactgagccacaatgggaacttcgtagatctgcattttaaaatcactgctgtggccacgggaatggagaatggattggagaggaagcctggaggtggagagattagggaaggctgttacggtcgtttgttttgagatagtgct

SEQ ID NO: 633464 - DNA, 368 bp, Homo sapiens
gccgcagtgtgcctggattcgtggggcccagggccagagggccctggtaagatgcaagaagggtggggattcagaccccaaggaagagtctgaaggaggatttgtgggctgggcctggcactttgggaggctgaggtgggcggatcacttgagcaggagttcgagaccagcctgggcaacatagcaagacctcatctctactaaaacaaaactttaaaaataaatttagcctcacagtggcacatatttgtggtcctagctacttgggagcctgaggtggatcacttgagcacagtttgagggtgcagaaagttatgactgcaccactgcacttcagcctgggcaatagagtgagaccctgtctcaaa

SEQ ID NO: 633465 - DNA, 91 bp, Homo sapiens
gccatccaggacttagggaaggaccccggaaacttaggggcccacgtgagccacggcccacggcctcattagctaagcacctgaagcatcc

SEQ ID NO: 633466 - DNA, 424 bp, Homo sapiens
cgggttcttaggagggtcaaagccagcccaagcttcaacggtggagaagtggatgactctgttatagtcagagcagaccacttggcgttcagtgtatctcagcacgcccttgaggggtccccacgacgcttgattcgcgactgtcttgatgtcatcatatttggcaggttattctaggcgtcggctcaggtccaccgctgacacgttggcagtgggtacacggagggccatctcagtcagcttcccgtacagctcagggatgcccatgcgcacagctttggcagcgccagtataggcagggatgatgttctggagagccccccggctatcacctcacagttccccgtataggccgtccacagtcttctcgctgacagtcacggcatggactgtggtcatgagtccatcctcgataccacaggtg

SEQ ID NO: 633467 - DNA, 460 bp, Homo sapiens
acagtgtcccagtgaactgagagagcctctccataaagcattgtcaaatgctcctgagaccaggcagtgacatatcaggcatttcgggaatgtacgactggagaccacagttcatgacagcggctggagtaagattttggtgcctctggtttcgctaggacaaattggtttcggaatggacaagaggtggtcaagaacctttgagcgcacgtgttgggagtgttggctgtagacattaccatggaggactagttctggcaggaagtacatcattcagcaaggtggctggggcactggtgtattagctcttgagtcaaggaaggacggagggaagtaccctggagatcactgcagaagatagcaatgacattatacatcctgcccagcgacaacgtctggacaagtcagtcccccagagtctccaactgtgagcacttcctggcagtctgagagcttaccc

SEQ ID NO: 633468 - DNA, 144 bp, Homo sapiens
cctttctgcacattccagattttggcttttatttaacattgactatacaataccctgactcccaaagttagttacagtgggttatattgtttttgtgtactgaaggatttattcagactgctgtactactgtagtgtgtaagcg

SEQ ID NO: 633469 - DNA, 606 bp, Homo sapiens
agccatgacccctaacaggagcctctcagccctcctaatgacctccggctaggcatgtgatttcacttccactccataacgctcctcatagtaggcctactaaccaacacactaaccatataccaatgatggcgcgatgtaacacgagaagagcacataccaaggcctagccacacaccactctgtcctagatagaagggccttcgatactgggagtaaatcctagtttattaccctcagtaagttttgttctcgttcgacaggactttgttcttgagtccgttttacctagctccagaccttagcacgcgcttacctccctcaacttaggatggtgcatctggtcctcccaatcgagggcatcagctccggctaatatccgcctagtaagttcccatttctctaaatcatcactcctgtattagctcggctatcaaggaggtagtcagactcaccgttgaggctcacgcataagtctaactagaagaacaatgcgaagacccaaactgattcaagcagctgggttattacaagtttatactggggtctctaattttagcccttccttacaaggcctcagaggtaacttcgaggtctcccttcacc

SEQ ID NO: 633470 - DNA, 457 bp, Homo sapiens
  misc_feature (11)..(11): n is a, c, g, or t
  misc_feature (18)..(18): n is a, c, g, or t
  misc_feature (68)..(68): n is a, c, g, or t
  misc_feature (171)..(171): n is a, c, g, or t
  misc_feature (271)..(271): n is a, c, g, or t
  misc_feature (299)..(299): n is a, c, g, or t
  misc_feature (347)..(347): n is a, c, g, or t
  misc_feature (443)..(443): n is a, c, g, or t
  misc_feature (455)..(455): n is a, c, g, or t
cccttttaaancctatantttatttatgtggggatctgtcaaaagaaaaccttcccaaaaagatttantaatttaaacccagcctctgttgccaaataagttaatgttttcttgttttgtaatcccacacattcaatgagttaaggctttgcacttgtaaggaaggagaancgttcacaacctcaaatagctaataaaccggtcttgaatatttgaagatttaaaatctgactctaggacgggcacggtggctcacgactataatcccaanactttgggaggccgaggcgggcggtcanaaggtcaggagttcaagaccagcctgaccaatatggtgaaaccccatntctactaaaaatacaaaaattagccaggcgtggtgcaggtgcctgtagtcccagcttacctgtgaggtggagattgcattgagccaagatctcaanactgcactccancc

SEQ ID NO: 633471 - DNA, 459 bp, Homo sapiens
  misc_feature (299)..(299): n is a, c, g, or t
  misc_feature (334)..(334): n is a, c, g, or t
  misc_feature (394)..(394): n is a, c, g, or t
cacccaatgtatagatatgagctggggctgtccacatgtagttttagcagctgcagaggaaactggctgagtctaaggctacatatttctgctcagggggggtatccatggtgaggactctcatggtgacggtagtcatcctgttaaccatcctggcatccttggtggtaactatggtaaccatagcctgcatactcatcttctgggcagcgcatccccagtgactgctgaatcgccatttcctgtctccgaagttgcaccgaatcaattaaatcgtacacaatcaccatggaccacanttgggaaggataccaggatttgacatttccgtctnttccgactagaagcatggaggagtactccgggctcacttgaaaatagctacgaatgtctntcaccatatgggctggtacgtcttctcgctcaacaacagagctcccattaattgggacagttcta

SEQ ID NO: 633472 - DNA, 868 bp, Homo sapiens
ctgcttctgtggtataaagatattgttgaaactgtcagaaaacgcctgcagacatccctttatcataagactaaacgagtcataagaaaaaaatggaagccatttatgtttatctatagcgaagacaggctattagtgacgaaactagacggggtgtgaagtgtgaaagtgtcttacagaagactatggtgttggagtgaccaggcatgtgtgactgaagaaactgaagcataagctattcacctgttctgtgctgaagagagatgaacatgaagttaatgacgtacatatagaaataaccctgcgatcaaagctaaaagggaatgatcttgatcacgtccttgaccagagtagatccatcagtcattgcagtgaacacatgccacatcaatggtatgcagatcatgaagcaagcaaagatttatcacaaagggaactggtgaatattcaacgaggctggttgcacgaaatttaaagaagaagacgaacaatgaaagtttttaaagatctcgtcagtgataggctgggcagcagttgactcaacgcctgtaatcccagcgactttgggaggcccgaggtgggtggatcacgaggtcacgagatcgagacattctgacgcaacatggtgaaacctcggtctctactaaaagtacgaaaacattagctgggcgtggtggcctcaccctgtaagttcccaagctactccggaacgctagaggccaggagaagttgcttgaaccccgtggaggcgagaggtttgcagtggataggagatcgtgacaattgacatccaggcctgggcacacaggaacgggagatacaatctccgcaagaaaatcacgaaactcgaaacctcagcaagacaacc

SEQ ID NO: 633473 - DNA, 322 bp, Homo sapiens
gctgtgtgtagcacaacctagggtcagttttgcaggtgttaaagcatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 633474 - DNA, 501 bp, Homo sapiens
tctagaggatctctgccatttactccatggctgaggcaggagaatcgcttgaacccgggaggctgaggtagcggtgggctgagatcgcaccatgcactccagcctgtgcaacaagagcgaaactctgtctcaaaaaaaaaaaagaaaaaaagacggaaggtgacatcggcagctctcagtataccgagaaatagaaaaagataaagcacatgtagcagagacggggggatctgagtgaagaacataggggaaggagtgtttctcagggtggcaggttaggggaatacctctactaggatggccacttagggccaatggatagatgctaagaaaacaaaaaaaacaatataaaagctagtctaggccgggtgctgggggctcacacctgtaatcccagcacttggggaggctgaggcggagggatcgcctgaggtcaggagttggaggccagcctgggccaacatggtgaacccctgtctctagtaaaaagacaaaatttgg

SEQ ID NO: 633475 - DNA, 887 bp, Homo sapiens
tgcccggagggacgcactgcccgacacacaatacggttgggggcccccaagaggacaaactgcgggtggtggaaaaggtgtcccccccgcaagggtggcgcaagggtgtatcctcgccccaaggtcgcccaaaaggggaatgtgcgccaaacgtgtgcgccagatagagccgaatagggcaccaccgtgggtaccaactttggccacctggaataacacctggttcctgccaggcgataccttcatacggggcggggatgtggctcccccacgacataggtgcgcaaggtcaacaacatggttacacagggaggagtgcgcagcgcaccccgggatgataaaaaggggcgcgggaaatggtcgtccagacattattcacgacacgcgcctctgagagaggagccacccaggacaggaccactcgggggcggcatacaccagacgaaaggcccgtcaacacacacagaggaggcctggggcatccccacgcagccactcttctaacgaagagagagcacaggagtattaccccgaccgggcgcttgagacggacactcggtgcggacgacacatctacaaccccttgggggaggccggcagaggcggggcggtccgcggcacccagccggtagagcgcacctacggacgcgacgactgaggaaacaccacggcggtggagccacgcaacacaatgccttcacgcccggcgttgtgtgcaagagaatactcaggaaagtacccaccttcgaactgggggggcaggaagaaggggacgacgggctatggcaaccgccgggggcgcagaacgggtccccatgccgccccgaatccgcccatatttgccaccccaccggggggcacaagggggaacccccttccccatgaca

SEQ ID NO: 633476 - DNA, 111 bp, Homo sapiens
cacgacgtgtgtagatggatcttacaatgtagcccaataaataataaagcatttacattaggatacaaaagtgctgtgaaaacaatgacatcccaaagcaagatctcaaag

SEQ ID NO: 633477 - DNA, 401 bp, Homo sapiens
gaggctctcacattgctgaagatgccgacgcaatatacagaggtggcccgtaagctggtcatccttgagagcggactggaacgtgcagagagagcgggctgagctctcagaaggcaacatgtgccgaagcttgaaaaagacttgcaccctgtgacgaccaacttgaaagtcactggaggctcagggtgagaagtactcgcagaaggacgacagatatgaggaacgagatcaaggtccttaccgacaagctgaaggaggctgagactcgggctgagttagcggcgaggtccgtaactaaaattggcgaaacagcatttgatgacttaacagagaaagttggtcatgccaaagaagaacacctaaagtcatggccatcgattgctggcatcagactttaacta

SEQ ID NO: 633478 - DNA, 96 bp, Homo sapiens
  misc_feature (28)..(28): n is a, c, g, or t
  misc_feature (42)..(42): n is a, c, g, or t
aattcaagacttctaacgaatgtacggnggacatgaataggntccaaccagcctgtacatttggaaaaataaaactttattaaatcaaaaaaaaaa

SEQ ID NO: 633479 - DNA, 402 bp, Homo sapiens
  misc_feature (19)..(19): n is a, c, g, or t
  misc_feature (401)..(401): n is a, c, g, or t
atgggccaggccagggctntgctgctttgtgcggtcttggaacttggtgccctgtgtcccagccatggctaaaaggggccaattacagctcaggtcattgcttcagagggtgcaagccccaggcccttggtggcttccacatggtgttgggcttgtggacacacagaagtcaagaattcaggtttaggaacctccacctagatttcagaggatgtagggaaatgcttggatgtctaggcagaaatttgctgcaggcatagagcctcatgttagggcagtacagggaaatgtggggtgggagccctactcacagtcttcactggggcactgcctaagtggaactgtgagaagagggccaccatcctccagaccccagaatggtagatccaccaacagcttgna

SEQ ID NO: 633480 - DNA, 245 bp, Homo sapiens
  misc_feature (4)..(4): n is a, c, g, or t
agtntctacatacattaacatatgggcaagtagctctaaatttagatatcctatcttggaggtgcatctttaaacacacaaaaacaaaaaaggtcataagaacaaaaaaaaaaagacacaaagtcagttcaataactctcctctctaaagtcaagcttaaaagaaagacccccatcttctgtctataatagacatcatgaaatccgcatctggggttctccccctctgtagaagactctaccaag

SEQ ID NO: 633481 - DNA, 126 bp, Homo sapiens
agaggatctcgagctgtggaggagctgatgttgctgggaaggacccccaagttacctcttctgcatcgtcctcgggctccggttggtgctcacgcaccaggaaagtcttcagcttctcctgcaggc

SEQ ID NO: 633482 - DNA, 171 bp, Homo sapiens
tgcatacgcaccgaaactagtgggggaagatcctggcacagcatgctggtacctgagctgtctgtcttcatacccgtgaaatggatgggtgtagtaaccgctgagggaataccccgggtaatgcacttcctcgggacacggccggacaaccggaggctacctgtgcggccg

SEQ ID NO: 633483 - DNA, 186 bp, Homo sapiens
  misc_feature (119)..(119): n is a, c, g, or t
cggcggcctcggtggaggttgccggaggtagcagtggaagctactactccagcagcaggtgggggtgtcggcctaggtagtgggctcagtgtggggggcctctggcttcagtgcaagcntgttggcctgagggctgggcggtgggccttgcgcagtcgcgggggtagcatgctccagcgttcaaat

SEQ ID NO: 633484 - DNA, 502 bp, Homo sapiens
gccgacatactgcttgtaagacgtagcagtatgtcaggcagtaggttacacaggtgaatgcacttcatcatcacaacgaccctttgaggtagaatctgtcattactgctgctttacagatgaagaagctgaggcacttttcaaagttaaataacttgcctggatttgaactccagttggataatacctgattgaactgcctcctacaacaaatatctcttaaatgaataaatgaattcccaactctgagacaaggaggagacagcagactgcagaggcagggctcatgccacagtctgttcacctggacagccatcttttaggaagaacagccctggtaatatgagctgccttatccctgttagtgacatcgtgacatgtcacaaaacctcaattactaaggaaggacatagcacgttgcctaggcttggttttttaaaccagatagatgtgaatcctgagtcccagacccatcagaagtgctcgtggtggagaatggaaac

SEQ ID NO: 633485 - DNA, 146 bp, Homo sapiens
tacaggatgccaccatgctggtaagtttttgtattttaatagagacaggttcaccatgttggccaggctggtcttgaactcctaacctcaagtgatctgcccgcctcggcctcccgaagtgctgttcttcacccagcccggcccgg

SEQ ID NO: 633486 - DNA, 428 bp, Homo sapiens
taggaccccggccattcctcctcctcctatggaacctcaaagagcaagacccactcttttccagaagccctataagtcagagttggacaggggaatgtaaatttcatgggaaaatccttgtacctgatgtctgagccactcagaactcaccaaaatgttcaacaccataacaacagctgctcaaactgtaaacaaggaaaacaagttgatgacttcacactgtggacagtttttcccaagatgtcagaataagactccccatcatgatgaggctctcacccctcttagctgtccttgcttgtgcctgcctctttcacttggcaggataatgcagtcattagaatttcacatgtagtataggagcttctgagggtaacaacagagtgtcagatatgtcatctcaacctcagacttttacataacatctc

SEQ ID NO: 633487 - DNA, 357 bp, Homo sapiens
tgatgacgaatgtacttcggtggagagctggccagtctcacctgggacaagcatagaaccagaaacgattccgtcgactccagtgaaaccgcagctcataccagttgaaccgcagtcctcaatcagaccggatctgccaccaaccgcaccgattgctgtagcgatcccagatccagatgcacagtcgtccagacggaagatcagcccggcggcagaggctgcggcactgaaagccttgggtgatgccaccccggacttcactgctttcgttcagcctcggaagaagaagaaatcggtgttgaacaatatgaaccgaattcgagacgctgtcgcacgtcaagttatacctgtgtgtgg

SEQ ID NO: 633488 - DNA, 200 bp, Homo sapiens
ctggagcttgtattccctaacatagcctggaagaccacccttgccactcggccacactcgcgctctacccacacttctacatttgtgttcacaaatatagttgacagatctctacacagaatacaaactctctctgctctaaacacacacatctctgggacatcgactctgtagagacatttaaaccttcttggtgaagg

SEQ ID NO: 633489 - DNA, 1592 bp, Homo sapiens
  misc_feature (455)..(455): n is a, c, g, or t
  misc_feature (1078)..(1078): n is a, c, g, or t
  misc_feature (1133)..(1133): n is a, c, g, or t
tacgctgtgctggttcagtcacgctgctgctctgctgtacttaagctagcggcttgcgactgctgctgtcctgcgccgagatggggtggggtgttgatttacgtacctcttcctaggaacatccccgtggttgcaataaagatacccgggctatcctctccccggtttatactgtagccccgggggcaggtaacatatgtttcaaccgcgggaaccgtttggttgcccttggcctcattttcgggaacccaaataggagaacagggtgtgaaccaaaaaacacggggtgtgttcaccgggtctcgggtaattttcccggcgggataattgtttgggaccccacgccggttccccaggaacacgcgcgtgcggctatcaggggacccgcactgctggggggttctttttagcacaggggaagactcttgcgtctgcccccgtgtataaacccgcgngttgagaagattaagaccttcgcccaccttctcgggtggccgtgaagaaaacttgtgccccattaaggttccttgttttgtttcctggctatatatctggcccccgctcaacgttcggaaaatttcctgtgtcaacatccttgaaggggaggggcccaaagaagaattttggataaggtttgttcctgcgccaacgagaaccgcgccccctgcgggggggagtttttcagccccgcgacaccaaaggtgaacacacatctgggggagggtgataagacccaccttggggggggaagccacaacacacgggggtgttggccgcttctttatggaagagagcttttgtccccaccagtgaagaaacaattttgggggggtttatacaacccacaaaagggggtggcgcccacacctcgggtgtctttgaaaacctttctctgaaagggtggaaaaggccacaaattccgccgccccacactcttcaaggcccttccccccgcagaagtggcgctcgagggagattacacacagagacgcgggagagcccacttcggcgctccctatagccctctgcacaaaagtgttggtgtgttgtttgttgtgagaacacagagaagataagnctcattatgtcacacagaaatatgtgtccacggagactctctcgtgtgaagtgtnatattccaagcaaaggctgaaacaaaagccactatctttggagtttgagctcgagtttctcttgagcacatagagctatatcttggagtgaaccacacggagaaggaatgcacaatttcttggcgccttggagagaggagaaaaccttgcacaaggaaaaagggaacacatggtttgaaatttcaaagatggtggttctcctccaatgagaatcaccgagatctttcacagggaaatgtttcacggtggaaggaaaggggctcttggtcaaatgaggcctgacaagactgcacatggcaaacctttgccacgcttttggcctgaaaaactcaaactttttcacatttgaagagtaaattcctgttttaaaaaactttcatttgagaaaattcctggtgtatcaactggaaccaaatttatgaaatatcagattcaccaaaactaccttttgaatattga

SEQ ID NO: 633490 - DNA, 126 bp, Homo sapiens
tcgaccccataccttttaaaaaaaataattttctttcaaaaaatttttatttgagaccaggtctcgctctgttacccaggctggtgtgcagtggcacaatcacagatcactgcagcctctacttcc

SEQ ID NO: 633491 - DNA, 873 bp, Homo sapiens
cacctataaagcaagaacaggccaccatgaaaaagaatcagctaaaggacaagaaagaattcatggaaagaaaaaaaactgtatgcttgccaacaaatttgtttattaaagaactagtgaaaaacattaaggagcttctctaaacatggaacaagaacaacaaaaaagcatatggagcaataaggataaggcaggaaaatatgagacacaaaagtcaatccagaaagggcaacatctatcaaaagaaaggaccagagcaaatagcaggaggaataacataaaaataataagaaaaatctttcccataacatagtggagaatacaagtttcctgaatgaaaggcttcactgagcatcactaagaacagaaggacaacggtccacaccatcagttcatttcggtcaatttcagaacattaaaaaaaatcctaagaaaagggtacatcctttcaaataacgatatcaaccacataatataccacaagtagataattaagaccaaatagatcattataacttgcaaccagaaatatgagggctgcatgcttacctttgtgtgtatttgtgccctcacaagaaaacaggacatccgattcccaacatattcggagcaattcagtctgagcaaacagaatgtgtctcaaacatgtgacttccatatttcgcatctgttcagaaaccgaataaactatgagaaattgccagatataaagtaattccaagaagagcgtttctatcacagctggaataccagccttttggggtgcgcctcaccatggaactcagggtacaatgccctttaagccggaattagtacaaaaccccggctggaaaatctcagagacctgacggggcaaacaaaccctaggaaccc

SEQ ID NO: 633492 - DNA, 120 bp, Homo sapiens
tacgctagtgtcacagcgcatcctattctagagtccatatcatcaactagggtttacgacctcgagtgttggagtcaggacgatcccgatggtgctgccgctatagctgagcacggtggg

SEQ ID NO: 633493 - DNA, 430 bp, Homo sapiens
cagtggtatcaacgcagagtggccattacggctggggggggacaaaaaaaaaaaaaaaaaaaaaaaaaaattgttggttgggccggccactgggccctgaggaaaaacgctttcgaagacacaactccgggttggggcggcggcgggccccaggagggtttaggagtgacaccggtggggccaatagcgggctccctgaaggagaaagatcccgggcgtcatgtaggacttcagtgtggtcgaggagttttctctcccacccaatttaaaaaaaagcgcgccggggggaaaaccacggaggctgtttctgagaacaagatttccacaagagtgggagtcccagaggggcacataacaggggattcttattacaaaggggtggtcacaagggaagcttccaatattccaatttaaggcccggtcttgtgcg

SEQ ID NO: 633494 - DNA, 264 bp, Homo sapiens
gggttgaccgtggttcagccccaaggatgtgctggttcgctggctgcggggtcacaggatctgcccgcgagaagtacctgacttggggcatccggcgaggagcccaggcagagctaccagcaccttcggtgtgaccagcatactgcgcgtggtagccgaggactggaagaagggggacaccttctcctgcatggtgggccacgaggccctgcctgctgggctttcacacagaagacttatcgaccgcttggcgggtaaacccag

SEQ ID NO: 633495 - DNA, 149 bp, Homo sapiens
gcggccgcctactactactactgctcgaattcaagcttctaacgatgtacggggacatgacccaggagtctgaggctgcagtgagctatgattgcaacagtgcattccagccagggtgatagactaaaactacatctctttaaaaaaaa

SEQ ID NO: 633496 - DNA, 367 bp, Homo sapiens
agctctcacagaaaatctgacctcaaccacagctaggtcctgactgtaaaaaacacgatactaagtaaactctcaaaacatagtaagtcaagccatactcaacctagtcatactccaagaactatcaattaaacgatgtgcaccattaagccaaacttttgtaaaaattatactatctagtgcaagccaagatgctgaaattggtaccttcacgcactgctggtggcatcatacactggtacaatcctataggaaagcaatttagcaatatccattgagagccaaaacaataattgtgcccttgaacccagaaatcctgctcctaggaattcaccctaaggaaaaaatccacaataagcacaaggac

SEQ ID NO: 633497 - DNA, 311 bp, Homo sapiens
tttctctgcttcactttctgacaaaggctatgtcattcggttgtaccatgaggccacaacagacacttacaaagccatcacttacagtgttgtcctttcagaaaaaagtacagtgtttcaccagaacgatgtgaaggttccgaacagcacacatgtgtttaccacattttacgctaaaacaaaatcactgttagttaatccagcgctctttccaaaccctaaagactatgaccatctaatgggctatgacaaaccattcacttttgatatggaagaagacagtgaaaagaaacagcttaaagaagacaaat

SEQ ID NO: 633498 - DNA, 430 bp, Homo sapiens
gtaggtgtttcagtgtgggggttgatgtatggcttgggctagtgctattatatgttgcagtgtgcttttactgcaattctgagcaggcgctgtatacttagccctcctaggtatatgccgagataaggcaagtagagcttctgggaacggctctgtgggacatcatggcgtggaaggtaccagcaggggaggtcaagtgatgtgttctacagggatggggatatggagagcgttggcccgaagttcatcgctggggagatgagcctccaagcggctggaatgttggtcttttgtgaatggggtttgccgatgaccaggacttacaggcaattctttctctggtgtgttctcacattgggcatcatgcacgtgagtgctctgcccctgagatggtgacaagggttgtaccatatcccctgaagattgttgg

SEQ ID NO: 633499 - DNA, 790 bp, Homo sapiens
tatgaggaagttctgctgtgtctgcagctgatctggaagcaggatttgggcatccatcaagtagaacgtttactcaactttaatttttcagtcagaattgtgtaacctgaatcaattgaggtgtctatggtgttggctatggtttctgctgttaatcattgatcttcttcagttagggcatgaagaagatgattttttttcctcacaaattgatgtgaacagtctgtcactgtgggcttcatctttaatatcgtctcatcccttcttaaactgagttatccatttgtaaactgctgatttgtttggggcattgatctcataaacttgttgtaaagtatcaatgatttcaccattcttccacccacacttcaccataaatgtgatacttgttcttgcttcagtttaattggggctcttttcaaagtgatgtcttaaccttgttaagtggcttaaactagatcctattcagagatgttataacaagtgagtatgagttagtatcagtggcaaacattttgaactacatgcatagatattttaatatacaaattttccatgaacttttgagaaccctaatttttggaattaggtcacggtacggagaaatagagctcggcccgaacctggaccttagataagtagacacttcccgcgaacccctacggccgttccagccgaacggtcaacggaaccccatttcaacacggttggatcagctcacaggaacacatcacaagggaacaatcaacgtccataagcacttagatctgcgcgcgcgacgagacctcct

SEQ ID NO: 633500 - DNA, 119 bp, Homo sapiens
tgtgatgtgaggagcgctctgctggtggaccccgtctggaggtgaggagcgtctctggctggccgcccgtctgagaagcgaggagcccctccgcccggcagccaccccgtcgggtggag

SEQ ID NO: 633501 - DNA, 122 bp, Homo sapiens
gatacgacttttttttttttgaactgatgaattcacatagatcacaaagatttgcatgggcttgaacaagctgtggggcctcaataaaattggaggcctcctttcccttctgtcgtcttctc

SEQ ID NO: 633502 - DNA, 111 bp, Homo sapiens
atgacaaagtccaccatttgtcaggttgacagttgggcagaagctctggttctcttctacgtggtaatgcttcataccacactttcccaaagtagcctgaatggtccgtcg

SEQ ID NO: 633503 - DNA, 120 bp, Homo sapiens
aagccctggcatccccggagggggccgtgaattactcctaggtcggctcttttagggtggcccttgtgttctgtcaaaacacttggttccattttccggggttaaaatccttggtttcca

SEQ ID NO: 633504 - DNA, 240 bp, Homo sapiens
gtggcttcctcactagagagggacgacatcctgttgccccgactgtgggaaagacatctgaattcaacacagagaaggttgctgcttgtgatctcacacacaggtttttatggtttcttctacccagggaatcttgcctcttggttcttccgcacaattaggcttttctctaggtctttcaggtaatctctacgcgtttcttaaacccctagggtgctttgaatgtaacgccccgggatg

SEQ ID NO: 633505 - DNA, 179 bp, Homo sapiens
gggtctgcaaagatgaaaatatttaccatttggtcctttaagaaaaagtttaggctgggcgcggtggctcaagcctgtaatcccagcactttgggaggccgaggtgggtggatcacaaggtcaggagatcaagaccatcctggctaacacagtgaaaccccgtctctactaaaaataca

SEQ ID NO: 633506 - DNA, 120 bp, Homo sapiens
cacacacctgagtccacacatcacctgagtcacaccactgagtccacaccacctgagtcccggccttcctggagtccctgaaagaggaagaagtagggtggtgtagactcaggtggtgtg

SEQ ID NO: 633507 - DNA, 949 bp, Homo sapiens
tggctgccagctgcatttatggtagcttgtacaaaccactcacagccagcgcctggtcaggggcccaggacacgtggccaggggggccaaggagccacatttgcggggcacatgccccatacccgtggccacccggcagcagtgcccagcatccctcaagtgacagagcagccaggaccccaggcggtgactgtcccagagggacctacaggggcagtggggccaaagcgtgggctccgtgccaccttgtttgggccgtgcagaattgtgattctcgtgaatttaatttcgtgccaacaactttagaaaaatcgaggacattctcacattacaaatcgtgtattctcgtggctttctccagaatttcgtgtcattgaggcctgaatttcccacagccaggaagcaatatagtctaccaccgtgaattagtggcaggcggcccacgtgtcagaagcggggaacccggtgctctccgccccaatccccacgcgagactctctgaggtctcaaggaaaagtgggtcttgttacaccgactagattggggcagaacttatctcgtcatcacgatgtcttggtgctccagcaacagtgggaaaatgtcaaagtgaagcaggtctcccaatctcaaggggcctgtttcatccatttaccccaacatacgttggccccaggggcactcgcgagttggaaatctcgggaacaagcccagggaggggggcggcaaggaatcactcccagaagagacccctttcacaatagctgaatgaggagacaacttgagggacagcagcacaggcttcccaaggcttgagccattgggtctctgagaaattcccaaatcttcgaaaccccaaagcgctaatagggcaggcacagggctctaatagagctgaggctgcgggaaagacatacaacacccgaggagtttgaggactaggatatcccgt

SEQ ID NO: 633508 - DNA, 615 bp, Homo sapiens
  misc_feature (545)..(545): n is a, c, g, or t
  misc_feature (555)..(555): n is a, c, g, or t
  misc_feature (557)..(557): n is a, c, g, or t
  misc_feature (594)..(594): n is a, c, g, or t
  misc_feature (597)..(597): n is a, c, g, or t
tcccagacacagtctcactctgtctcccatgctggagtgcagtggtgcagtcttagctcactgcagcctcctccttccaggttcaagcaattctgcctcagcctcccaagtagctgggatgacaggtgcatgccaccatgcctggctaatttttgtattttttatttttagtagagaccgagttttcactgtgttggccaggctggtctcgaactcctgacctcaggtgagctgcctgccttggtctcccaggagcttcatttcctttcctgtgagaatctggatgactccaatgctttggcagtagtagcagaggcattccgaccttttgaatagctttctttgaaactaaaataaattgttccttagatctatttcttatccagagaaatccaaagcctgccctgccagccctgaatcttacaaccgaaaatgagcacataacatgtttctttgtttgcttattgtttttaacaggctccaagcctatgccgtcctgaagagcattatccaggccggatgcacagtggcgataaatttatcanaaagattatnanagtgtgtccaagttttgcctgtctataaaagatgatnggnatttaccaaagtgacatt

SEQ ID NO: 633509 - DNA, 183 bp, Homo sapiens
ccccccccgccccaggggccctttgcccccagtttgtttttttaaacccccccccccccccccggtccaatttttggcctcccccccataaatttaaattcccctggccccccccctttttttcttgggttgggttggggcccctttttttttcccgggggcatttaaaaccccccccgggga

SEQ ID NO: 633510 - DNA, 177 bp, Homo sapiens
taagaagctataaggctctgaggaacatacttagaaaaacatactttaccaagtcaggtaagaaaagacgaggaaaaagatgcattcaacatatgcagtctgtgctggcttagattaaattagatcaggtgtggtggctcaggcctgtaatcccagcacttggggaagccgaggcag

SEQ ID NO: 633511 - DNA, 112 bp, Homo sapiens
cttcaaatggtccacttcttcactggaaatgttgcgggcggctgtggcaggtctttgctgtgctctaatactgggtctctgggtggtcctcgaagtccaacctgacagcccg

SEQ ID NO: 633512 - DNA, 114 bp, Homo sapiens
gatttcttccttaaactgctggacggagctattctcgggcacggcgaatccctcctttctcttcggggtcttcacggtgactttcatgattttggctccgcggagcagcggtcc

SEQ ID NO: 633513 - DNA, 150 bp, Homo sapiens
accccaggctctggtaagggtctacgggggggaggtggagggtcgggcctgagagcaggagtactcccttagagaacccaatcccatctagccacctctggactagtaccctatctttcaggcctgagagagagcaggccgtgcaacgag

SEQ ID NO: 633514 - DNA, 974 bp, Homo sapiens
  misc_feature (43)..(43): n is a, c, g, or t
  misc_feature (91)..(92): n is a, c, g, or t
  misc_feature (111)..(112): n is a, c, g, or t
  misc_feature (114)..(114): n is a, c, g, or t
  misc_feature (126)..(126): n is a, c, g, or t
  misc_feature (148)..(148): n is a, c, g, or t
  misc_feature (158)..(158): n is a, c, g, or t
  misc_feature (212)..(212): n is a, c, g, or t
  misc_feature (230)..(230): n is a, c, g, or t
  misc_feature (239)..(239): n is a, c, g, or t
  misc_feature (242)..(242): n is a, c, g, or t
  misc_feature (248)..(248): n is a, c, g, or t
  misc_feature (259)..(259): n is a, c, g, or t
  misc_feature (261)..(261): n is a, c, g, or t
  misc_feature (281)..(281): n is a, c, g, or t
  misc_feature (288)..(288): n is a, c, g, or t
  misc_feature (291)..(291): n is a, c, g, or t
  misc_feature (300)..(300): n is a, c, g, or t
  misc_feature (302)..(302): n is a, c, g, or t
  misc_feature (322)..(322): n is a, c, g, or t
tgagcggggtgggagggatggagaggggaggggggagcggagngagcggagacagccgcggcgctgcagagcggctggggcggcggcgcgnntcccggtgctccccccggnngngcgccccgagtnggtgagggcccggctctgcggnccccggagcnatgggctgcatcggctcccggactgtggggaatgaggtgattgcagtggattgnaagggcctgaaggatgtngatcaaatnaanatgganagcaccagctnantgcacgggagcagctccatnggccatngantgagcaaantngaactgatttctcctggganggcatcaacctctaccatggaggacagcatatccattctttccgaagcttaatgcgaaactctaacgcctatggcattggggccctgggcaatgtcatcaattctcagggatctcactggagcatgaaggaccatgtgacaaatgccacagccatgcggcaaggcctggtaggcccaacatgattgagtggcaagggcatgcgggaaagacaccagctgtacagccacgaagcacaggcatgagtccgtgcgcagggatacggatgcgtactccgacctcagcgaatggcgagacaaggaggcacgtatctaacaggcgtcatggcaccagttcgctactctcttgagggccacagctcattgacctgggctatccatggactggtgaggaccatggagggtgaaggtcggacctagtaagcccctcgggcgagcaactacagtgacacacgtaccagtgcaccatgattggacaggtccagagatgcgccatgaggtcagaggcagccccaggtcgcatgcgcaggcccgcagcttcatatagatgtaccccgggtgactggaacgtggcaagggggccagacaggaatcgccttggatagagcagagagccagatccccacgtagacaccaccgcacggagcgaatcata

SEQ ID NO: 633515 - DNA, 408 bp, Homo sapiens
gaccctgaatactcagggctccccctatttctttttgctggataaaggattcttttcaaagctctcagcagatctgtatagttgcttacctgatataaatgcatatcaatgcctttaaagtatgaatctatgccaaagatcattttttgtcttactaaagatttcttagaggaactaagaagaatcatgtttattctccaagttccttcagttctggagacacatgtccaccagatgtgctttctagtgtcagtgcttacagtacaaggaggcaaaaggaaacagtccctgaatgacgtgttagagatgccaccactaaaaactatgtttataagctaggacttatatgtaaatgtttctgcctcttcttttgttctgtttaaaacaataaagtacatttatatgaaa

SEQ ID NO: 633516 - DNA, 422 bp, Homo sapiens
  misc_feature (43)..(43): n is a, c, g, or t
  misc_feature (91)..(92): n is a, c, g, or t
  misc_feature (111)..(112): n is a, c, g, or t
  misc_feature (114)..(114): n is a, c, g, or t
  misc_feature (126)..(126): n is a, c, g, or t
  misc_feature (148)..(148): n is a, c, g, or t
  misc_feature (158)..(158): n is a, c, g, or t
  misc_feature (212)..(212): n is a, c, g, or t
  misc_feature (230)..(230): n is a, c, g, or t
  misc_feature (239)..(239): n is a, c, g, or t
  misc_feature (242)..(242): n is a, c, g, or t
  misc_feature (248)..(248): n is a, c, g, or t
  misc_feature (259)..(259): n is a, c, g, or t
  misc_feature (261)..(261): n is a, c, g, or t
  misc_feature (281)..(281): n is a, c, g, or t
  misc_feature (288)..(288): n is a, c, g, or t
  misc_feature (291)..(291): n is a, c, g, or t
  misc_feature (300)..(300): n is a, c, g, or t
  misc_feature (302)..(302): n is a, c, g, or t
  misc_feature (322)..(322): n is a, c, g, or t
  misc_feature (346)..(346): n is a, c, g, or t
  misc_feature (356)..(356): n is a, c, g, or t
  misc_feature (381)..(381): n is a, c, g, or t
  misc_feature (384)..(384): n is a, c, g, or t
  misc_feature (386)..(387): n is a, c, g, or t
  misc_feature (389)..(389): n is a, c, g, or t
  misc_feature (392)..(394): n is a, c, g, or t
  misc_feature (396)..(396): n is a, c, g, or t
  misc_feature (400)..(402): n is a, c, g, or t
  misc_feature (417)..(417): n is a, c, g, or t
  misc_feature (419)..(422): n is a, c, g, or t
tgagcggggtgggagggatggagaggggaggggggagcggagngagcggagacagccgcggcgctgcagagcggctggggcggcggcgcgnntcccggtgctccccccggnngngcgccccgagtnggtgagggcccggctctgcggnccccggagcnatgggctgcatcggctcccggactgtggggaatgaggtgattgcagtggattgnaagggcctgaaggatgtngatcaaatnaanatgganagcaccagctnantgcacgggagcagctccatnggccatngantgagcaaantngaactgatttctcctggganggcatcaacgtgagttcagctgcncccagaattncccattctcccgaactcctcctccncancnncnccnnngnaaannnaaaaaagaaagcgcnannnn

SEQ ID NO: 633517 - DNA, 207 bp, Homo sapiens
  misc_feature (81)..(81): n is a, c, g, or t
  misc_feature (99)..(99): n is a, c, g, or t
  misc_feature (116)..(116): n is a, c, g, or t
  misc_feature (125)..(125): n is a, c, g, or t
  misc_feature (162)..(162): n is a, c, g, or t
gggctgtgtgggtaatccgcaaccagtggggagagggtgagtacgacccgaggacagtggcaggtgaagagtacttcggantatggactctgaactccnttggagatgttggcagncagccacgnacactaaataccacagtgtcatcctcagataaagatncctgcggtaaagcatcctggacgtggtgtgggctgggtcacaatc

SEQ ID NO: 633518 - DNA, 488 bp, Homo sapiens
gacaaattttgtacatgaaaccccagatagactataaataattctaacccaacaagtaggtagctgtgtatgacactgctttaaatcattcaaatgcctttgtttttggactgtgcaaaggttggaagtggatttgcatttctaaaatggtgacttttattctgcaagagttcttagtaacttcttgagtgtggtagactttggaacatgtacattttttgcttgtaatgttatcctgtggtagggttttgccctattttattttgagtctaagttaaatgttttctgaagagatacatgcactgaactgtttccactacaaatcaagatgtggttaaaaaatgaaaggaccaggaccagtgagatctaatactactgtcagtttaatgtccactgtgttttatacagtatctttttttttggtggtcaatttgggaatttttacttaaaccttgcaaaaaataaagtattgtgcaaagaaaaaaaaa

SEQ ID NO: 633519 - DNA, 535 bp, Homo sapiens
  misc_feature (45)..(45): n is a, c, g, or t
  misc_feature (178)..(178): n is a, c, g, or t
  misc_feature (209)..(209): n is a, c, g, or t
  misc_feature (263)..(263): n is a, c, g, or t
  misc_feature (284)..(284): n is a, c, g, or t
  misc_feature (289)..(289): n is a, c, g, or t
  misc_feature (295)..(295): n is a, c, g, or t
aatgaacaatggttaaaagcaattgttgcctgggaaaatcactantatcagtgttctgttatcacatagcagaaaacaagcccttcagttagcgaaactgggttgagggagagcaaggcaagcagcaagagaaggtgctagggaaagagaaccggagaatggtgcaggcactgcctgngagcttgtcagaaatgcagagtcttgggctnctccccagacccactgaatcagggcatgtattttaacaagaccctcaggtgatncttgcacaggctaaaacttgngaagnactgcncaaaggcaggaggcagtaattccaaggaataaaccctgccagagtgtcatgcttggagccctgacagctacctgggagcagtctcagctgaggtgagagggacgtaaggcatgtggaacaggcaagcataggtgccaaaagggtaatagtggtaattgtggttacagtcagtttaaacgaaacattgacagtgtgacaggcactactgtactactttccatgcatggtttcatggtggtg

SEQ ID NO: 633520 - DNA, 372 bp, Homo sapiens
ttctcaagacgcaaagagctgatatgatcacagaatatctagtgtgacggcgctgctgcctaatgatcctgagtacaacacggtggcaagcaggtgtacagtcagacctgctcacacatcagaatagagaagatagcgaggatccagaatccagatctctggaatagctaccaggcaaaaaaacaaactatggatgccaagaatggccagacactgcatgcagaagcaactcttccatgggacagatgccggatccgtgccacacgtcactcgaactggctttacccgcagctatgccggaaagacatgctgtggcatatggaaagggcacctatttagctgtcaatgccaattatactgccaatgatacgt

SEQ ID NO: 633521 - DNA, 222 bp, Homo sapiens
  misc_feature (30)..(30): n is a, c, g, or t
  misc_feature (47)..(47): n is a, c, g, or t
  misc_feature (120)..(120): n is a, c, g, or t
  misc_feature (133)..(134): n is a, c, g, or t
  misc_feature (167)..(167): n is a, c, g, or t
tatgtattggatgaatgacttattaatggnttataccgtttctgagnaccatcattttttttttcaggacacggaggatgtcttggacatgtgagatgtaacgtgacagggttttgcatnttaaactgcaggnnatttacatgtccttattttccacctcccccagngaaaatgctttctaaatcattttcacaggttatatacttcggatctgtttaggga

SEQ ID NO: 633522 - DNA, 257 bp, Homo sapiens
tttgaaaaacccatacccacaggcttttgcatgaactgtacacctccacacaacagatgttaaaagtaatgtaagttaatagtggtctatttcacataaggtaaatataacaaatgtctgtaatctaaagtattcttagaaaatattagccctttttggtcagtggtaatagtgtatccacagtgtctggtcttgcttttctaagggtaactgatgtacagttgctacgttgaggatgtaaatttgtgcattgcaga

SEQ ID NO: 633523 - DNA, 204 bp, Homo sapiens
tatagacatgtagtctatataccctatatataagtattctctataaaacaactaggttataaaaatacagtaggaacaagggcaggttgaatcaatggtgaatcaatctgaaattagagcacacctgcctgccatcgctgttccttcaaatgagtgctgcacatcatgggctctgtctgtgagagacactcccggtgttggtgt

SEQ ID NO: 633524 - DNA, 237 bp, Homo sapiens
tatgttgagccgaagatccggcaggcacgtggtgaagggagactcgaagatactctgaggcttgtaggagggtagaatagatacccagtaaaagtgtagatagcagttgatatgacattattaggttacgtgatgtatctacttagagtatggtgagactcaagtgattgatactcctgatgcgagtgatacggatgtgctaagggagtgggacttctacggcaacgtcgggtcata

SEQ ID NO: 633525 - DNA, 304 bp, Homo sapiens
tgactcgtgcagccattcgaccgtgacgctatagtgttaagcggctgttgccctcggcggggatctcgatctcgtaggagccctggaggagcagggccttctggaggtagccagactgctggtccatgttggccacgctgttcttgcagtggtatgtgatgttctgggaggcctcggtggacatcaggcgcaggcaggtcagctggatggccacatcggcagggtcggagccttggccgccatactcgaactggaatccatcggtcatgctctcgccgaaccagacattcctcttgccgccgtt

SEQ ID NO: 633526 - DNA, 269 bp, Homo sapiens
ggtccctgcttgtttgtgatgtgtgggatcttagtcaaagtgtgtggagtaggcaggtatcagaaggtgatgtcatcctcgtacagtgacagcagcagcagtgactggtccagcctgcccagcagtgcccaccgttgtgcagcagtgaagaggatgccagtgcctgcgggtccctgtactttcaacatctgccgggagcatgtcgcagagtgctacgtagaggaacaggccggtggccactgccagaaaccagaagcccctatagaggc

SEQ ID NO: 633527 - DNA, 771 bp, Homo sapiens
  misc_feature (10)..(10): n is a, c, g, or t
  misc_feature (12)..(12): n is a, c, g, or t
  misc_feature (31)..(31): n is a, c, g, or t
  misc_feature (36)..(36): n is a, c, g, or t
  misc_feature (39)..(39): n is a, c, g, or t
  misc_feature (60)..(60): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (88)..(88): n is a, c, g, or t
  misc_feature (118)..(118): n is a, c, g, or t
  misc_feature (130)..(130): n is a, c, g, or t
  misc_feature (145)..(145): n is a, c, g, or t
  misc_feature (177)..(177): n is a, c, g, or t
  misc_feature (179)..(179): n is a, c, g, or t
  misc_feature (191)..(191): n is a, c, g, or t
  misc_feature (207)..(207): n is a, c, g, or t
  misc_feature (227)..(227): n is a, c, g, or t
  misc_feature (244)..(244): n is a, c, g, or t
  misc_feature (284)..(284): n is a, c, g, or t
  misc_feature (299)..(299): n is a, c, g, or t
  misc_feature (329)..(329): n is a, c, g, or t
  misc_feature (344)..(344): n is a, c, g, or t
  misc_feature (350)..(350): n is a, c, g, or t
  misc_feature (361)..(361): n is a, c, g, or t
  misc_feature (363)..(363): n is a, c, g, or t
  misc_feature (377)..(377): n is a, c, g, or t
  misc_feature (395)..(395): n is a, c, g, or t
  misc_feature (590)..(590): n is a, c, g, or t
ccctgggcancncgggctcaattttttttanccaantanctggtcccactggagcggganaaaganaaanctcgaaanatagaggatntctctctcagactggcaccttgcggttaancttgcttaccanccacttactccaaantctattcttcggttgccaaatacaaaacttgnanaatactcgctanggggctatattatttnatttcttaagcagcttattnctggcaaactccaggantcttttccagaccctgagctgatttatcttatctactttngtcggaaactaaaanatgaccagacactttacttctatggcattnaacctgggtccactntccatnttctgcgaaantnctggcctgaacctnatcagaaaccggaacctntggacaaagtggctgccatgagagatattccgggtgttgcacactgccctgcacagcagctcctcttacagggaggcggtctttaagatgctcagcaataaggagtctctggatcagatcattgtggccaccccaggcctcagcagttaccctattgctcttggggttctccaggacaaggacctcttctctgtnttcgctgatcccaatatgcttgatacgttggtgcctgctcacccagccctcgtcaatgccattgtcctggttctgcactccgtagcaggcagtgccccaatgcctgggactgactcctcttcccggagcatgccctccagctcataccgggatatgccaggtggcttcctgtttgaagggc

SEQ ID NO: 633528 - DNA, 464 bp, Homo sapiens
ggcaactgcttatgatggggagaaggtgaagcacaatacgttccggggcagaggccgtgctgattgagaatggggcttccatctgaggcacaaccacccgggacttcacccaactcaacgagctgcaatgccgctttcccaggcccctggagggccttggcttcccttgcaaccaatttggacatcacgagaactgtcacaatgaggagatcctgaacagtctcaagtttgtccgtcctgggggtggataccagaccaccttcacccttgtccaaaaatgtgaggtgaatggccaaaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttc

SEQ ID NO: 633529 - DNA, 486 bp, Homo sapiens
ctggggaaaaaaaggtgcagatgagatgacagtcaatcctagccacaaatcagtagtcattatatccagtctcttagccatgaatatgacatagaacttaataaatgaatagattgtcatattttctaggggtgaggtgtattagtctgttctcacgcttactataaagagctgccaggagactgggtaattgacttaaaaaaaaggttacactgactcatagttctgcatggctggggaggcctcaggaaacttataagtcatggtggcaaggggaagcagcacttgtcttcttcacatggcagcaggaaggaaaagtgctgatcaaagggggaaaagacccttataaaaccatcagatcgtcatgagattgcagtcactatcacaagaacggcatgggagtaactggcttcatgattcaattacctcccagcatgtccctcccatgacagtagggataatgagaactacaattcaagatgagat

SEQ ID NO: 633530 - DNA, 257 bp, Homo sapiens
tactactactaaattcgcggccgcgtcgacgtatttttagtagaggcggggtttcaccatgttggccaggctggtctcgaactcctgacctcaagtgatctgcccgccccttggcctcccaaagtgatgggattactggtgtgagccactgtgcctggcccacttggggatcttaaaaggaagaaaaacccagaggtgtctgtctgcttcagacacattaattagactctttagagggacatttgaggcttgtgttt

SEQ ID NO: 633531 - DNA, 155 bp, Homo sapiens
gagagcttccctaggatgaacccatccaagccggttccaccttcacagcctttcctgggaattcaaggctgcatgattacatcgtgcgggagtgacaggccgggatcaaggtgacagaggaggtgtgaggctgtaccattgtgagacacaccatg

SEQ ID NO: 633532 - DNA, 229 bp, Homo sapiens
catgtgggcttatctctacacaagaacatctggttgagcgggatgcaccccacagggatgagcctggtttgaagatacttacagcctcaagaacaccatacacatgatagtaccacaaatattagctagttaattaagaaatcaaagggatgtgggggctctaattgtgtttacccgctgaataatggaatatactctggattctaatgtgtacatcagccaccctgaa

SEQ ID NO: 633533 - DNA, 323 bp, Homo sapiens
acaggatcctaagatctgagatcatataagtcagtggagagtgagccagagaaaacctggcagcagagccgttactctaggaaagttccagtgctatggaacctgttaggcatcatcggtcaagtgatgatgtgactcacagaggtgttgggtggagcgaaacaggagttgaacccgttttctaatacttcttggcagggtaacttattacttcccaggacagggaccccaaaattaaggtcttggtaaaatctctttaaagctccccaaaaggcatgaggaaattaggacattggagaaatgaggcaagtaacttagggaca

SEQ ID NO: 633534 - DNA, 381 bp, Homo sapiens
  misc_feature (35)..(35): n is a, c, g, or t
gtactgttggcttacctgtttttttttaacggggngtgggtttttgatccccaggactgctactggggcagcatggctggactcaggaaaagcataagaaggaaccggtcagggaggagttcagggaactttcaaaaccataaacaccattatctaacttcatgaaccagaatgaatcagatctttttgtttggccaaaatgtaatacattccagtctacactttgtttttgtattgttgctcctgaacaacctgtttcaaattggttttaaggcgaccagttttcgttgtattgttgttcaaataaatggggatatagggaaaagagaacaacattggaatttgaataataaaaagggtaattttcccaaaaaaaaaaaa

SEQ ID NO: 633535 - DNA, 1036 bp, Homo sapiens
  misc_feature (250)..(250): n is a, c, g, or t
  misc_feature (1036)..(1036): n is a, c, g, or t
agcggagtcgacgtaggggtttggcgaacgcatccgtatgcaggcctgggcactcatgcgacttggaggtgcgactgcttctcggcgcgcccgcgcagggagatacccaggtgtagctgcccaaggtcgcacgatctacggcactgacgaatcgcgaccagtaatgggatctgtgctgtgccaggcaacctgtcattcattcaggcgtcactatgaccctgtatgtcatgtggcggccgacgatccaagncaggactagctcgactctgcgttcctgcggacgtttgccactttgtcgttgtcttcgtcgtccttgtacctccgccgtgggaccccactaggctctcctaggcggcttggggtagaacggcagctcccgttggagccacgtaaactcgttgtgggctttcgtcggggcgcagtctgatcatacatacgacgttcctattaccactcctacgcaattttacctgaaactccgtatcataagctccatttggttcctcagccaaagggccatgggggactacgcacaaatcccccgaaccagatattggacacaatcgctccgtttttgcgaaaaggggccacctaaagccttgtgggggtaatggcttgtagtatgcatattcaataccccttctctacatacaaggtgcagtcaacaagttgctacgaagaagatcaccaacggggggcatcgtgggcactttgggcgattgattgcattagctgattcgaagatcgagggcaaacttagtttataagaacggggaaaccttgattagcgaaatgagttctgtccttatttcaccatttgaagtgtctcgaggggaaccacatgtcgtgtgtgagaattgtcacgtccttgacttgacaatagtgtggcttaattgtgcaccttgccacttgtctgggggacccgtcacctcgaaactcactagactgattttgaggagcgaacgttcattcttttgccatgaagtggcgttcgccgtgaagaatacaatttagatttgtgcatttcatattgagn

SEQ ID NO: 633536 - DNA, 382 bp, Homo sapiens
ggtctgccacggaaaacaggctctcaggaggaaaaaaaagacagagaaataattccttaattaaatgaggatatacaagattctaattaaatgattatattaaacatgaaattgatgtaacagaataaaggttaaactagaataactttgtatccgtaagacataaccgcggcagggcacctctactcatccagtgcttaagacagaagttagagaatctttttcgtttgctctcttttctgcttctcgcatacaatccaccaaaagtgccagccaatgcttttgtttccacattgcacaggaggtcttcgaggaatgaccagggagactggctattacatatgaagtctactacacaatgaagcgtatgacataacctcgg

SEQ ID NO: 633537 - DNA, 868 bp, Homo sapiens
ggacacatcctgcccactccgacgcccatccagccctcctccagcctctccttcggccacccccacccgtccagcatggtgaccgccatgggctagggaacagatggacgtcgaggaccgggcactcccgggatgggtggaccaaacccttagcagcccagcatttcccgaaggccgacaccactcctgccagcccggctcggcccagcaccccctctcctggagggcgcccagcagcctgccagcagttactgtgaatgttccccaccgctgagaggctgcctccgcacctgaccgctgcccaggtggggtttcctgcatggacagttgttgggagaacaacaaggacaactttatgtagagacaaggaggggacgggacagacgaaggcaaccactttttagacacggacaccaggcttacggcaaaaataatttactttggctcttgatttctaacaaggacttggagacttggtggtctgagctgtcccaagtcctccgggttcttacctcgcgattggacgggatccactagcaccgggcctctgaggagcagatacgtgagggacctcagcctgcacccatctacatcactctgggcatcgcctctactgacatagccgaactccaggctgggcctcagcccaacagccacagtggacacggaccagggagggtgagctggtgccctgcatagacggggcaccaggcccctagacggggcacgacgccaaaccaacggcgcgcccgtgcagaagaatcccccaggccaacggcctggagacacaccggcaaggcacacaaacaatcaaccttgacacggggacacacgtgtcccccgcatcggcgccatacggcactcgacg

SEQ ID NO: 633538 - DNA, 917 bp, Homo sapiens
gtggtcggtaggggagcttatccttttctttccttggttggagtccctgtgcagtgtcggttttcggtagcatgtaggagttcatgttgcccagagtagtccacatcttcactcttctgaagacacatgaatcaggaccgatgtatctgtgacaagcatgccagaagtggcaggggccatcagggttaaccatcttcacacctaccatcgtcccatggggatccaagaccttgagataaagacagacgcgcctgccctagatccctctgctgcatcctatcccttccaatgttggtccagtgcccaatcataatcctctgggcatcagacatcagcgaggtctgtgtgcctcagccctgttaaggggcaggtgtctcttgtagccctcttgcctgcacttgggagcgaaggcgaactaccagtgagacgcaaggtgccatccagtcccgtgccccagactggaccccctggggctcagatagaggtgctgagcccctgtgtcaaagttgttacctgtttttgttttgtgccatctgtagctctttctgtagttgtttgtgtcccctttcctggagcgagtggatttagctgaaagacagtgagctgtttacaaaggccctgtgctcgggaatcggccgcgacgtactgcgctctaggactgatgcctccatgacggagggctgacgggtgtgtttttcgtcacaaaacgcgcctggtgacgaggtgatccctgagatgatctgccgcccttcttgattggtgccccgagagtccgctccctgttgtcgggaaggctccctggattttaccttaacacccagttgctcccttccccttttttcttgccggagctagattcggggccgttgtcctgggggggacacttgcccctgcttgcgggaaagcccccgagccct

SEQ ID NO: 633539 - DNA, 1010 bp, Homo sapiens
gcacaatgcaagttatctccagtgacaagagtgccttctgaagcaaccatcgcatcttcatctagattgacactctactaggctgactactgtaggtaatacaccactaatcttcaatccacctcacagagcaactatcaaacgcttaaatcctctttacatcatagactttcagctacttgaagatagccatcagccgctacgatgactcttttctcccggatctccctaatactatgaacgcggcatgagataacggacaagctcggcctccattccctccgcatacagaacactggtcgacattcaggctacttgtgccactactggacagtggagtcttatacgaaggcctgacactggctcgccaaccagttccagaaccagaactgatcagaaggatctattctttgtgccttgtggccacatcagctagcctctgctgtgtgcacagtgtaacgatgtgtgctgggagtgtgaggcagcattatctcacagtgccttatccatgccataagaaaagcaggtgttacactactaaggaaacccaggagttaatttttaaaaccaccactcttccatttcagtcaggctttagactgatcatattagcaattgatggagaagtccacaagggcttgcttggtgctcgaaggccatatgcgtgcttcatggcaggctagttggagcgcgagactgagttcagctgttgcaatcctggtcatgacgatctggagccctgtcacatcttatgcattcctatccgtaacaaggaaggaattgtccctcctttcttttaccaccatacttttacgtgtccctttgcatgttaataaattgttgataaaaaaatctaatatatgagccccatacggtcccaacttgaggtaggatcgaattaacaaagaaccttcgctctagggtcagaacacacactagccctaatatacattggtgcaccacataaattatttaggacatatcacatcccgatatcagaagaactccca

SEQ ID NO: 633540 - DNA, 145 bp, Homo sapiens
tagtaaggtgagatgacatcagagctggggctggtcaccagacagactgaccatgtgattagaggttagaaggctttgagatcagactgaccctatggaggcgaggagactgagaggcatgagatttaactcactctaggccagc

SEQ ID NO: 633541 - DNA, 957 bp, Homo sapiens
  misc_feature (283)..(283): n is a, c, g, or t
atcgctcagacaccatggggaaggtgaatggtcgcgaagtccacggatttggtcgtattgggcgcctggatcaccagggctgcttttaatctctggtgaagtggatattgttgccatcaatgaccccttcattgtacctcaacgacactggttcttacatgttccccagctatgaatatccgacctcaatgtgcaaattccgatgggcgacgcagtcatcacggcgtgagaacgcgtgacagctagtccttcaatgggatagatcccatcacgcatctctccnagagcatgccgatggatcccgaccaacatatctaagcttgcgtgcgcgagttgcgtaggcagcatagaaggtacgcgctcgagttgtgacgtccaacgatcggcagtcgtatcaccaactcgagttggcaatgacatgtgctgcgggcatcagattttgcgattgtggagggcgcatgccctgagggcgtcgctcgattcgtcttgcgccctcgtcttggcgttgatagcccccgattgttccagtcgatcggtgtgtggaaaccgattgtcagaaggtaattgaacgatacgagtcacttgcataggtattcgatgctacgctaacttgtccctgccatgggcgacctacctcgaaattgttgcctataaggacagcccccgtgggcccgaaggttgcagtcccatgacgagagctttgggtattcgtgagaaaagtgacctcaattggaccagcaggttctcattgcccagtcgacttcggccaccgccaatggaatgaacttgttcgcgtggttggccccccctccccggtgaagactcgttgggcgtggatcggccggcgagggccttcgcccttgaagagatttcactccgcttggcctcctaagttggggcggcttgcccacagggcttgtttgtgttcattgggccttctccctctaccttgacctg

SEQ ID NO: 633542 - DNA, 395 bp, Homo sapiens
gaaatattttggttggttgaaggttcccagccccccgagaccccattttgatagaatcaaagtaggggacagggctgttttttaaaaagccccgacatgaaaatgacaatccctttggtttccttcctccggtgtttccacctaaagcagcctccggcccccgcctttgtttcatagtaaggattttattttgccgggggccctccctttaaaaacctaccctaaatgatttcatccggcccctcacttcttaacatattcctgggtttttgtaagggccaaatttctccttccactcgtccgcccggtaggttttcatgggagtcattttattccttacagcttccttgtaaccccagccctaaatccatgataaagctacttttgtcctccta

SEQ ID NO: 633543 - DNA, 910 bp, Homo sapiens
  misc_feature (1)..(1): n is a, c, g, or t
ncggtcgtgacgtgcgggagcgccagccgagcttcatgtctgcggcatgtcacacctctgggtgtgggcacgtgcgtggccctcactgtgggactttttcagcggtgcggtttcccggggcctctgagtccgacatgtgcgcataagcccacgtggccggggcctcccccagagtgccggctcccacagcacattgttcgggcccgggaacccatttttccggcgttggtttcccctattttccggggccccttgaatcttgggtgatggcgcggtctccaccttgggacccaatggtggcgcgccgacccccgcttcgcacagcaacaccatcccccccccttcccctctggggggccaatccccgaacgagggttcgaccacactgggcagccacttttcacgccctcagtggttgacttcccccgaggcgacttcccccttatctgcctcctcgggggtgttccccccatggtgcccccgttcttgtttggccgacagtggtgacgcccccagcgtgcgcgcggacaggatacaccccccttttttcactctcccacggggtcccccaccggttgcctgcgccctttctttgggacaccgtggtatccccctccccccttgtctgcatagcgccacaggcccccatttgtgggaaacactcatccccttttttggactgatcgcccccgtgtgggtagcttgcccccccccggtggcctctgtcgtccctgcgaccgcccccggctgtaagggtgcagccccagggcaagcggctcctggaggggagtctcgcgcgaggtcaatattgggagtggtgcttgtctcttttgacgtaagctcccacccccccctttcccctttttttctctccccaccaggaaaaaaaaggtaatttttttaacaaaaa

SEQ ID NO: 633544 - DNA, 254 bp, Homo sapiens
ttccccccctcccaagaagattcagctcaagaggaagaaggttaagctggccgtccctaaaatatttataaggtggatgagaatggccatattagtcgccttcgtcgagagtgcccttttgatgaatgtggtgctggggtgtttatggcaagtcactttgaccgacattattgtggcaaatgttgtctaacttactgtttcaacaaaccgaaaaacaagtaactgtataagttaataaaaaacataaactaaca

SEQ ID NO: 633545 - DNA, 140 bp, Homo sapiens
tgttgactggctactggcatctcgtggggaggcatgacttcatcgtacagagcagcctgtgttcacgttgagcttgaccccctgattggaatcggcgtgataaccattgagagggcttatccactcaggctgggctccaa

SEQ ID NO: 633546 - DNA, 777 bp, Homo sapiens
  misc_feature (10)..(10): n is a, c, g, or t
  misc_feature (64)..(64): n is a, c, g, or t
  misc_feature (87)..(88): n is a, c, g, or t
  misc_feature (106)..(107): n is a, c, g, or t
  misc_feature (112)..(112): n is a, c, g, or t
  misc_feature (123)..(123): n is a, c, g, or t
  misc_feature (178)..(178): n is a, c, g, or t
  misc_feature (185)..(185): n is a, c, g, or t
  misc_feature (189)..(189): n is a, c, g, or t
  misc_feature (203)..(203): n is a, c, g, or t
  misc_feature (219)..(219): n is a, c, g, or t
  misc_feature (234)..(234): n is a, c, g, or t
  misc_feature (241)..(241): n is a, c, g, or t
  misc_feature (245)..(245): n is a, c, g, or t
  misc_feature (252)..(253): n is a, c, g, or t
  misc_feature (270)..(270): n is a, c, g, or t
  misc_feature (274)..(275): n is a, c, g, or t
  misc_feature (277)..(277): n is a, c, g, or t
  misc_feature (294)..(294): n is a, c, g, or t
  misc_feature (324)..(324): n is a, c, g, or t
  misc_feature (336)..(336): n is a, c, g, or t
  misc_feature (380)..(380): n is a, c, g, or t
  misc_feature (386)..(386): n is a, c, g, or t
  misc_feature (394)..(395): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (416)..(416): n is a, c, g, or t
  misc_feature (425)..(425): n is a, c, g, or t
  misc_feature (436)..(436): n is a, c, g, or t
  misc_feature (443)..(443): n is a, c, g, or t
  misc_feature (458)..(458): n is a, c, g, or t
  misc_feature (469)..(469): n is a, c, g, or t
  misc_feature (477)..(477): n is a, c, g, or t
  misc_feature (485)..(485): n is a, c, g, or t
  misc_feature (502)..(502): n is a, c, g, or t
  misc_feature (513)..(513): n is a, c, g, or t
  misc_feature (525)..(525): n is a, c, g, or t
  misc_feature (542)..(542): n is a, c, g, or t
  misc_feature (547)..(547): n is a, c, g, or t
  misc_feature (561)..(561): n is a, c, g, or t
  misc_feature (570)..(570): n is a, c, g, or t
  misc_feature (575)..(575): n is a, c, g, or t
  misc_feature (601)..(601): n is a, c, g, or t
  misc_feature (623)..(623): n is a, c, g, or t
  misc_feature (657)..(657): n is a, c, g, or t
  misc_feature (696)..(696): n is a, c, g, or t
  misc_feature (707)..(707): n is a, c, g, or t
  misc_feature (763)..(763): n is a, c, g, or t
tcagcccttncctactcccagacctgccgggaaggctgtggggcccagattcatggcgggtctntggggtggggctgggtgtctganntgtgcgcctgtgctcctnnggtgngtagtagggcntgcgtcctgaggcatcccgagatatcgagggagatggctggcatgagagaagatnatgcagnggcnaagccaggagcccngacagggagatccccngtgtgtcagggatgnaggtggncgcngttgcannctcccggtgctcatcantggnntncagggcgttgttgtggngggtgttcacgtagggtgcgcctcccaggngcccctcatgcngaatggtcaggaagacgaggtagatgctctgtgcagaaagccgnaccacncgtctgcnngcaggnacncnaggttggggnactgcagcnggggcagggcncaggtgnaacgggtgggacagnggcggggagangggcgggnggcaaagncgcgcagcctggtagcngcgatctggtnggagcggtattngctgaagcgtgactcanggaantgttccagaaaaanaggagttcnaaaantccctggttaatgaaatactcggcanagtaaactacgaccaagggaanaatgtaccacagcagacccttgaacactgtccanctttcccgaagagaatggctggagctggagcctggcttngactccggggnctcggttcttatgaggggctgccgggctgcgctctctgcttcttcttcccctccanggtcctgggcctca

SEQ ID NO: 633547 - DNA, 585 bp, Homo sapiens
tgcatatagttcgcagtgtggtgagggagtgtttaaccggagagtgcagccgcatgttgcgccagattgaccgggctcgcgacgctggtttcctagattccggtgcgaggcaaaattccgcacggcagtgatgattgcggtcagtctggcgctgaccggggctgtgtgtggctcacgcctattacctcaaacagcaattctactccagtgtggtgttcctgattcaatattcagtgcccagtcatggcagtccttgttatccttgtctttccgtctatgtcttccttctgagcaaggtgatgggcaaggtgttctttgggcaactgagggcagcagagatggagcaccttctggaacgttcctggtacgccgtcacagagactagtctggccttcaccgtttttcgggatgacttcagcccccgctttgttgcactcttcactcttcttctcttcctcaaatgtttccactggcttgctgaggaccgtgtggactttatggaacgcaggcccaacatctcctggctctttcactgccgcattgtctctcttatgttcctcctgggcattctggacttcctcttcg

SEQ ID NO: 633548 - DNA, 1777 bp, Homo sapiens
tgtgcaaatgggtatgtattttttcatactcatctttactgttagcccttcatccctctacaaaatgtttaatgttttaaacagatttactccctacagtctgcttgggttagtagtttatatagatttaatttagcattttctcaagtactgggctttttttctggcagaatttttcaaatagccaaaacataattttccctctgaatattaaaaaacaccaacaaaaaagatttttgcacgacaaataatttttacacatgcaaaaaagtaattttcaaaagtaagcacttctgccagatgatgcttaataagtctgtcctaatggtatttatcttaatgcttactttcaggaacagtggataataccatattcagtccccctgacaaacccctgaaacaggtaatgtcattagtcctactttctggaggaaatgaaggcacagagaagataagtaacttgcctgaggttgcacagccaatatgcagctgagtgggagttgagtgctaggctgttggatttcagagcctgccctcttaaattgctacgtgacactgactctcatatgtatttatgttttatcaagcttaatataggataaattgtcgtgcttagggatgtagtctcaaagagtggaaattcagacattagtagaaattcaggtatcaggacagttggggaccaggaggccaaaagggggtatggtttagggagtcattcacagatgtgggattctggatatcaggacaactggagttgaggagaatgtcttcccagcatcccaaaccactcattcgcctaacaattagactggcccttgggagcactattcttcttcattggtctcattgccacaaccattctcacaaactcccattgccctcagctcagcccaaggctttgtattgttcaggctgtgctgtgggccctgctctaaaaatagcatatggcaaagaggcctgtcttgtagttgcaaaagtggtgtaggatttgaattccccatgatgagctaatttgggggcccactacaaagattttcagaaaacttttcaaaataatctcaactactgtgactacggaacacaatggcaaggggctgggagcaggaaataataccttcattatccaaactaatgtgcatacatttgaaatgtacaaaaaagtagatgtgttgcatgtgacaactcgacctggtaatgaggttttggggcatcacatcaatgctagttgtaaatactgtatttgccatgtactgcctttggattaattagcatccataacataaaataagttgtttcctgaaatgtaaacctagcaattagcgcttcatcaagtccctatcagatgttagaaaaaaaaattggttttgcagttgtttttttcacccaaaacaagtctgacagtacatattggtggcattcacagcaacataacggtaataaacttcagctactgttgggctctttgtaagcggtacagttactaaagcgagagtttggaagtatggttttcttttaggcaccctcaccagcatggtgagggtgcctacattctagttaaagtcagtaacacaaattaactcatgtaaatgtttttaatcagtgtttcttacagctgattattcagctcattaactctgatcataaatctggactttggaaaacttaacatttgttctatgttaccttttagaacaaaatggtggctgaggtagagaaatgacttgttctctgactggtgactttggtccctgcatcaaggagtggcagaggtctc

SEQ ID NO: 633549 - DNA, 257 bp, Homo sapiens
gagatcgtcatgctgctatcatatttcaccccaaaactgaatggaaacagaaaacctacagaggacatacatgtaactatgaaaatgaagaacagatgcatttaaaaggaactatcagtctagaaactgacttaagagaaaaagctgattgagttagacaccaagaagtacaaaacaaagtcaatattatagtaggagccacaacagtaactacaagtaaatatctaaaatgtattgagcactagcaagtgctggca

SEQ ID NO: 633550 - DNA, 471 bp, Homo sapiens
attactccctatgctcatataggtaagttgtgaaaattatctcccttgttgtacgtcgccctgatactactctgatgagttgtttcttttgctgttcagaaactctttaattttattagatcccattatgtcaatatctggcttatgttgccattgcttttggtgttttggacattaacgtccttgcccacgcctatgtcctgaatggtactgcctttgtgttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatct

SEQ ID NO: 633551 - DNA, 1113 bp, Homo sapiens
  misc_feature (1113)..(1113): n is a, c, g, or t
ggaagcttgacccttgtgtcttcgtcaataagaacagaggaatgagaagcattcttagggcaacatttgccctgcatcccccctcctctgcctgagtgtgtctagtaatgtcagctggtcatacagagcggaagcacaccaaatctttggggtcagagatcctaggttgcctctcccatccatgcctctgtgctatgatgttggcgaacgctatgaggactctggaacgcaaatggggagggagggcagggagaaatgttgcccataatgaaatgcattctcaatacctcatgattctatatcgacgttctagttcaaacaggcaagggatgcaaagtatgacgggacagcattaacacaagctgtgttagtaaaaatagacgtaacatacacgcaaacacaagtaataaaatgaaacaagaagcaaagacataatcaaccacgacaggcgacgacacagacgcagacagacacacgacgacgacgagcccaggacagacgaagacgaagagcagagccgcacagacacgagagaacactgagaagagccacacagggcagccaaagggaaagcaagagacgggcgaaagcgacacagaagaaaggagacaactagccgacagcgaacgcgaggaagcccgcaaagacgcagcgctcagacggcgcgcctgcaaagagcagagaaccacaactacagagatggacaacgacgcgtgactgaaagcgaaacgcagaaagaccagaagcaagcaataagcaaacagacgacaagcacagcgaagacaacatgaagacaaagtaaagagaaacaaagaaacagacatacaacgagcaaagaagcagaacgctgagaaaaagaaacaaaagagaagacacaaaacagaaaacaacaacaaagcaagaacaaagtacaacaagaaaagagacggcaaatgcggcatagcaggagaagaaaacaaagaacaaacgaaaagtaaagaaagagaaaagagcaacaaaagacacagaacaactgacaaacgagaacgagaataagacgaagcagaagcaaatcgaaacagataccgacttgagagcgcaacaaactaatagaaacagaaccatccagtggan

SEQ ID NO: 633552 - DNA, 90 bp, Homo sapiens
gagcggggttcgcgtccgctgcagcagcgcgggccgggccaggtggcgcctcgcgcggcatcgactctggcaggcgctgcagctgaagct

SEQ ID NO: 633553 - DNA, 153 bp, Homo sapiens
cccagatacgagatggagacgtggaagatctccagtaatggtcatggtgattggtcccggggcactctcacaaaccaggtgagccgggtgacaacgacattgggggctttcggatctgtcaccacaggaccatctcccagcagcgttttcttg

SEQ ID NO: 633554 - DNA, 111 bp, Homo sapiens
ttctgcttctgccgcttctgcttctctgcttcctgcttctgccgcttcctgcttctgccatggaccagggtctggtgagggggtacccgacgctcgacacttcgtacactc

SEQ ID NO: 633555 - DNA, 121 bp, Homo sapiens
tgatgccagccactccaggaggaagtcgggaggcgtggagggtgccacaccttggcttctgtgactctcctttgtgtggtgcccacctgcagatgtccctccttactacccacagcaccta

SEQ ID NO: 633556 - DNA, 179 bp, Homo sapiens
  misc_feature (1)..(3): n is a, c, g, or t
nnnccacccgcgctttccctcctcaccatcccctcattgctgttgattaccaactcactggacagccagtgctcaattggtggcaccaatgggaacctgtagttatgttcttactggcactgacagggcaatgctgagcctttggacacctgtcatggagcgggccagtgcaattgtcc

SEQ ID NO: 633557 - DNA, 244 bp, Homo sapiens
ctcactgcaacctcaaactcctgggctcaagcaattcttcccacctcaacctctctgagtagtctggaactacaggtgtgtgccaccatccccagttatctttaataataaaattcactatgtagagacagagtctccctattttgcccaggcgtggtctgaacctcctgggcacaagcagtcttcctgcctcggccctcccaaaggtctgaattcacaggcatgacccaccaaactcagcctt

SEQ ID NO: 633558 - DNA, 297 bp, Homo sapiens
ctatagcataatatagacttacactgaatatatgtcattagaagtgctgtggtccacttcatttataaggaacaaatattttgacagtacatatatagcaacagcaaaagccctgtctcaccctgataggaatgggtttgctgggtgtctagaagttagattcctgctgaatagaattagccatccttaaaagattttaatccaatactgaactgtttataaaatgctttctctatggtaatgtactgtaagtagtgcaattctgtatatactgctattgaaacttctaaaactagg

SEQ ID NO: 633559 - DNA, 173 bp, Homo sapiens
gggggggggaaaaaaggttttttaaaggggttcctttcccccccaaagcccaatttaatttttttttttggggggggggaaaccccccaggggttttcccccttgggggggggttcccccggttttttccccccccggggggggggtttaagggcccccttttttttttttta

SEQ ID NO: 633560 - DNA, 842 bp, Homo sapiens
tatgtctctgaagttgctcctgaaaaactactgtgtgagcactgaaacgttacaaatgcctaataggcatttgatcaactgagcaaggcttacttgttatctcatgaaatgcctgttgccgagttatttgaatagaaatatttgaaagtatcggaaagcagatcttagtttaagggagttggaaaaggaattatatttctctttttccgtgattctgtactcaacaagtcttgatggaattaaaatactggctgcttattctggggagcctgtagctaatatgagtatgggacaggtaataattgtcgatctttaatattgagttgaaatgaattaagatattataggatttaggcataaatttttatacggtggagtactttatgtggtcgagctagaatttatagcgggtggaattgggaaaatgagaaacagggccgcattttgatggattaccatttatatggtcattgggtctgaatccttaaaggttgtaagcgctacactatttggacacttattattctttagctagaatagtaattgttggagtcactataatcattagataaattattttttggggaagcgaaaatggagcaggcagagggttcgcaattcgggcgtttcgtagagaataaggcggtcacggttattagggagggcagtaaggggaagaattcattggtcacaagggggggggagaggaggtttaaaccccgaggggatagtgtggaagcaatgggtgacgggccggaaatgaaatagcattttttgggcggacgagaagtgttacgaaagaggagaaaatataagggaagggacaggatatatagtattta

SEQ ID NO: 633561 - DNA, 535 bp, Homo sapiens
cacgctggagtgtaaacggttattgaagcaggtaggggcagattttacgaagggactgcagatctggaataatgggtatggggtagatctgcccatagagctcactttagaccggcctatactcctacaaggaattggggtaggatcttctactcagccttgccacaatagaatggccaatgcccttctagtatgtttggtgaaggtcttgaaggcaccatttcccccatccaccctggggagaaattgagtccctaaagtcaacgacaaggcttattgaggctgagtttgcaacagatccgatctgggaggtagaaacaaaaatgactgaacatctttttatcccccaatcgttacaaagcctaaataactctaaacgggatgggagggcaaattttaggtcagttgacatcctggagaagatatcctaggtcctgtctcattccctagaccgcataacactccaaccgtgtaaatctcaggaccctgaagaagacagtggtaggggagaggaggggagctagcttccacccta

SEQ ID NO: 633562 - DNA, 168 bp, Homo sapiens
gcacttgaccagtgtctgagtttcagaaggtttactcagggatctctacttcaaacggacatataggtggttagaaagggcatttacacccccttcctcaacctatatctgttctgtgatgactactactaaaggttatatatacatgaggccaataatcatcatgct

SEQ ID NO: 633563 - DNA, 175 bp, Homo sapiens
agatagaatcgagctcgggtaccaaatactcggatctaccctagcatcacacacgcacaatcccctatccacccagcccattctctctccggtccaacctaacccctttccggcgggcttttccccggtcccttgagacctcagccatgagggagtggctgttggtttgggccaa

SEQ ID NO: 633564 - DNA, 133 bp, Homo sapiens
accggaatatgtttgttagaagccaagctaccaattacgggaagatctcacaaaaaatcatgatgagctttgatagacacccaccagaatatggcagactgtcataggcattctgttattgtccggggttgtt

SEQ ID NO: 633565 - DNA, 123 bp, Homo sapiens
caaatccaaaagaacaatagctgtaaccacagctgtcattgactagaatgctctgtcatactttatattaaaaaatgctttgcatttcttccagtgccatgcacattccatatggtgtcccac

SEQ ID NO: 633566 - DNA, 108 bp, Homo sapiens
cctcaacaagtgcgagacctgggcgtccaacctgcctacaaccacagccgcgaaagaagaagacctgctgcttcaatacaacacgggaggacctggccatcaacatca

SEQ ID NO: 633567 - DNA, 338 bp, Homo sapiens
ttacctgccacagcccgagttatggtggcagcagcagttccctcccaaccagtctggcaagccatttgttggcctgtgagtccacaccagcactgatgagtcaggtttttcccttctttgtgcccagagcagctggggagggagttgggggtttctaggaaacaggacctcctccttctgtctctcccactcatccccttgtcttggagctgctcattttctatctggagcctctgtctcaccctggaaaaagagccttcatgtcctactaaagagagtctcctatggccacactggcaggaaagtctggtcccatgctgagtttagtcaggagccga

SEQ ID NO: 633568 - DNA, 175 bp, Homo sapiens
cggagtcgagaccacccgggcacgatggtgagactcgactctactaaaaatctttcaattggtaaccacatgcacacaaactttggtccctagcccagtcgtctccattctccagaggacgatttcacaccttggcctctctctttactctcagcggctttccacctaggggtac

SEQ ID NO: 633569 - DNA, 549 bp, Homo sapiens
ccgaaggtcttatcgatggtaatatacttaattaataggaataacaagttaatatagttctaaaactactgtattgcaatctatgccaggaacctgatgacggaaaccacgagataactggaaattcccaaattgcgccaaagaaaaatactacgagacttgagaatcatttaacgtaacttcctaagtgtaagatgacaaaatatgactatcgggatattctggcgttaattttcccgtccgcctaaatgtgggcaaaaattcacagctacgttatattaagcaaatattaacagtgcctattatatgctgggtagtgaaatttgataaaaaacttaaaagttaaaaaaaattgtttcgatctttaatgtcacattgacttatctgggacatcgataaatttaatcctaacatgaagatctggctaagtatatttttaaaaatctgtaaatctcacaaaaactacagctgttaagcacagtttaaacccattctgcagggttagaaattcttctgtcaggcaaactatttgataggaagtaaaataag

SEQ ID NO: 633570 - DNA, 312 bp, Homo sapiens
ggtagcagcgctcaggaatgtgtatgcccagtggggacgggcgagtacagacaggctctcgctgcacttgtgaatccatcacgtaagaggcatgagtcacggagcctatcctattcatctatgctccggtccctcactactgggtccgcagtgatcctccggcttgccgcctcctgtctagatctgatcctgccaggcgattcgaccaggctgaacggggtgatctggagctcggatacagagatcagaggtggttcatggtctcagctctgtgaccttgggcagcttcttggtgtcaaagaacaggctgtc

SEQ ID NO: 633571 - DNA, 197 bp, Homo sapiens
  misc_feature (196)..(196): n is a, c, g, or t
gggaccacatgccatcatgcctggctaagttttaattttttgtagagatggggtcttgccatgttacccaggctggtcttggacttctgggcttgggcagtcctcccgccttagcctcccaaagaaatagggattataggtcggagccaccaggcctcgctcttattatatgagtatatatgaaatctttctgtgna

SEQ ID NO: 633572 - DNA, 287 bp, Homo sapiens
ccgccctctttttttggccatccttcctttccccccccttgacccagggaggagaagggagaacatcccccccccaagtcccccccccatcttttccctttttgtatattaagggcaaaaaaccccatcatttgggaactttttttctatttattgaacgggggattacaggtccttttccttttttttttttcaaagattgaacagaaatttttctttttaattttattttgagactggggggcatctccagagcccctccccccctcaacctcgtttcctccgca

SEQ ID NO: 633573 - DNA, 187 bp, Homo sapiens
agaccctgtctcacaaacattcacatagaattcatacaagagagaatggggttctcaagtgggaaagcctgttttctagaaacgtgtggaactgggaaggacgactacggctcgtgatcactgtctagaaaagcatgtatcctaacggacatgcttctttttggcgatgtccgagaagctgtggcgg

SEQ ID NO: 633574 - DNA, 208 bp, Homo sapiens
gcgaattgcccccacagaacagcgtcattgtgtgacacgtcgttggactgctgtttagataaccaacaagagtctatgtatagaaatccgctgatgggagaagatggtcttcgtcccatcagtcttgctcccatcaaaccagcgtcattgtttgacacgtcgttggactgctgttttgataacaacatgagtcaatgtataaaatccg

SEQ ID NO: 633575 - DNA, 958 bp, Homo sapiens
ttctagcggcgccgattattgcataataaaatacagttttgaaaaaaatggatgaagaacctgacagaactaagcgatgggaaggaggctcatgcaaagcaccatgggcagcattcttcaaagcaagcatgcaatctggcatcccgttcaacagcttacaaatcagcaagcaccattcctcattccaagggccaacagcagcaacacaaagcagtcatttgcagcacccatggcacaagttcgacttgggacatgatgccgccacctttcatgtggtccagtaacctggcatccacagcaaccaatggcaagcaccccagatttcaccagcctcaatagactgcacgtggtaactttaccaagtcgtcggcactactctgtacgaggaactattccgatcaaaatcctattagctcagatcggaataactctgtcacctaagagtacccagagctgcacacacttgcctgaactttcaggaacacccacgacacaacctcataacgtctttgcaggcaggctgtggcatactgacctggccatggacgagccatctctttataattccctaagcatggctatggcagactctaaacaacagcatgcctgggaatacaaggtcgagcaagtcctactccatttttcggccaggcctttaccaactgcgatcccatctcagtcattcatggctctcactccaagaactcttacaggacgcaccacctcaccagtctccgactcggcatcgccttgcaccacgtcgagctggcgtggtactagcccggaaacgagggccgttcccaggtatcgacagataacgccatacagtgagtcgtcaccgctcatctcagcgccccggcagtcagcgaagcccacaacgcagcgacgactacgttacaaaatcaggccacatcgcagataactcattaaacacttgacgcgccgaccaaaacaaacg

SEQ ID NO: 633576 - DNA, 1721 bp, Homo sapiens
tggaaactattgttctttttaggtattcagctggttcaacctttgcacacatctgtgtcattcaagccatcagccaacatcatcaaactccagtgcaatttctgcacattcaagccagtgtgtgttctccatttgcattcatggttcaggcacacaccagtttcaacacatcattcagttgcacacaggtcaagcatctcacgttcacatggcatccctattagtatattgcacagctcagcttcactcatcctggtcagcacacactcatcacatcccacccatgcatgcgcacatcttcacatcaacacagctatggcagcagcacaccggcatattatcatcttactacaagctagtgccacaacatgtgtacatacaagtggccacatatatcatcatctagctcatagtcctcacaggcccatctccagcgctcatcggtcgtcaaacttctcacatagcaacttcgaacggcacaacaccctatcaaggtcacttaacttagccaaaagcaacatcgcagacaacactctttcaacgcaacagggtccggggctacaccaccaccttgggcgtgtcaccggacagtcggccaaaactctggcgtaccccttacgcatccacacttcatgtacaccccatcacagcacggctcctggggctccattgcatttgccttacattgtccttggacacagagtgcacgccttagaggcaaaccatcaggacttgagtacacactcggcgcaacgactcgttaaagcacggcggaacagggacactacgtcaagctgccggcaccacggcatataccaaacaagacggaccaagcggaggcacgtacacatacacaaccgagcctccaacagcatcacccaagccccaaccgagcgcccacgcatcgtccagacaccttacacacatcgcatcggagccacagcaacgacacactgggtataccccgccaggcaaaccagcagcaggcaacagactaaccacaaagaacactaggcaggctaacactgaccagcaaccgcgaacagcacaccacagcgggtcacacaacagcacaccacccagtcacgcaagacacacaaccagacaagcgcacaacaacacacacacgtccaacaacacacccgagcaacacacgataagacaagcacacacgaacaagactagagacacgacaaccagcaagcagcagagcacaacacaacactcacgaacaaccgcacgcccaccaacggattagcgccaagcgatacccaggcaacagccacgatacctcatcgtgcacctccacaccaccaacacccgagcacgagcgaaagacaccgacagcacacacacgcgcacgcacgagccaagaaccacacccacgcgcactggacccaaggacagacagccgcaaaaccaagacacaagcaggagaccacacaggccccggccaacgcgcagcaaccgacacacacgaacgagaacgcagcgacccaaccacgcggaacctaacacacaaggcacacacctcgacgacaagcgcgaaagatagagacaacacacagagcaggacgcagatatacaatcacgaaggccaggcaagccgacagacccacaaccacgagaaaagcacactgcgccacacccgaccgaacacagacacagcacccgacaacgcaccaaccaagcgcacggcgcaccacacccaccgaagcagc

SEQ ID NO: 633577 - DNA, 415 bp, Homo sapiens
accgaatcagtactaggttaatactaaatacaaatattaaacagaaatacagtgttgttacttttatgtctatcctatacctgtcctataaacaaaaaaaagtttcaaaaataaagtaaacgtagtttaccaagtagagtttacttgtacacagatgtactctctctgtgacgaatgccccatcttttcaattcttagagtgaccctgcttggggtggaaaatgttcagtcacgttcagctgtgagatctctgtcacatatttgaaagggaaactgcaagccacaccctgtcagttctcctctctggaaacatcagtctgtggtagtattgagagtagaacatatcactctgaatctctcctgtgtccaatcaaaaacgatgagaatttaatgctatggacctcggaaaatattt

SEQ ID NO: 633578 - DNA, 151 bp, Homo sapiens
gacctgagccagctgacgaagctccacagctttctgggtgatgaagtcttcctccgggaactcgccaagacgaagcaggagaataagctgaagttttctcagttcctggagacggagcacaaagacgaagatcaacccatcctccatggtt

SEQ ID NO: 633579 - DNA, 1127 bp, Homo sapiens
  misc_feature (600)..(600): n is a, c, g, or t
cctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgacccccaagccttcccatcccttccctgtccctggtggtctanggacccaagctccctagattctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 633580 - DNA, 146 bp, Homo sapiens
  misc_feature (8)..(8): n is a, c, g, or t
  misc_feature (45)..(45): n is a, c, g, or t
  misc_feature (64)..(64): n is a, c, g, or t
  misc_feature (116)..(116): n is a, c, g, or t
aaacactntgcaacgcaaaattatctcacacaaggagtgctcaanaatctgaaggctaggaatnacaagcaatctcaaaagcagaaactcacagtcataaaactttatacatcatntgaacgaaaatacatttatactactaaaac

SEQ ID NO: 633581 - DNA, 926 bp, Homo sapiens
  misc_feature (41)..(41): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (399)..(399): n is a, c, g, or t
gtctttatacttcctcaacgctttatacttcagttcttctnactggggggtgtgaggaacagggggaccatggacttcatcagcattcagcagttggtaagtggagaaagagttgangngngaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgacccccaagccttcccatcccttccctgtccctggtggtctanggacccaagctccctagattctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 633582 - DNA, 115 bp, Homo sapiens
  misc_feature (81)..(81): n is a, c, g, or t
tactcggtcctggaattctccggggtcgacatcgatcatcatggaatttgcgtggtgcatgtaccaactaggcttaatagnctcgaattcgagctcgaattcgaggcttctaacg

SEQ ID NO: 633583 - DNA, 1599 bp, Homo sapiens
  misc_feature (600)..(600): n is a, c, g, or t
cctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgacccccaagccttcccatcccttccctgtccctggtggtctanggacccaagctccctagattctcttccaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacagcctagccgtctttcctgggccgagaggagcccatgcttcagtcaccagggactgtctgatagggcccacgcctgttagccatgccggccgacagcaagataggccgagtgcagagtgggcgggatgcggggtcctggcactaggcttttgtgcttaaggcacctctgctcactgacgacaaggtcaaagacagtggttctccacctcagctgcttatcagaatcaccaggaaggtttaaaagtctgatgtccagaccctaagtcagaagccctgaggggaggatccaggtattctcatgcagaggccatgcttgtctatgtgggaaatcctaggaatctacagaaagcagacaactagggagtccagcaaaatctcgggtgcaagataaacacacaaaaacctgtttctacctcctagaaatgaacatgtagacacaaaagttaaaaatatgtactgtttacaattgctga

SEQ ID NO: 633584 - DNA, 983 bp, Homo sapiens
gggctcactgtggcctcaaccttctgagctcaagggatcctcccacctcagcttctgagtagctgggaccataggtacatgctaccacaccccgctaatttttgtatttttttgtagagatgagatttcaccatgttgcccaggctggtcttgaagtcctgagctcaaggtgggaggatcacctgagcccaggagttcgagaccagcctgggaaacacagcatctctactaaaaatttaaaaaatcagctgggcttggtggcctccgtctgtggtcctagctacttgagaggttgaggtgggtgaatcacttgagcccaggaggtcgaggctgtagtgagctgtgatcataccactgcattccagcctgagtgacagagcaagagcctgtctaaaagatagataaaataatctttgtattacaaagataaatgttcatttagaaatactttacaaattaagattagcagccaggcatgttggctcacacctgtaaacgccagtacttcaggaggctgaggcaggaggatcgcttgagcccaggagttcaagaccagcctgggcaatataatgagaccttgtctctataaaaaattaaacaatcagtcaggtgtggtggtgtgcatctgtagtctcagcctcttgagtagctgggactacaagcactgccaccatgcccggctaatctgtatattagtagagatggggttcaccatgtggcagctggtctaaatctggacctcagtgatttgcctgctcaactcagctccaaggtgtggatccaggtttgagcaagtgcctctttggtagagtctaattaggcataacgacaatagcgttacctgtatgcgccgtgtctgaaagcatacttgggcagggaggggtaagtataacaggaccgttgggtcggactgccacgtgttaggaaagcgcccacgaattttgggagacagcacgggaacaaagatccaaaacagacaaagg

SEQ ID NO: 633585 - DNA, 993 bp, Homo sapiens
  misc_feature (600)..(600): n is a, c, g, or t
cctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaaggtgagcccccgccgacccccaagccttcccatcccttccctgtccctggtggtctanggacccaagctccctagattctcttccaccgtctgtacgtttcaaattacactggtgtaggcctgtactgctggtggggctgggcccctaaacgccagaaagtgaatcttaagaagctctgccctaaactgagaacgcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 633586 - DNA, 720 bp, Homo sapiens
cctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 633587 - DNA, 816 bp, Homo sapiens
  misc_feature (733)..(733): n is a, c, g, or t
cctgtctgcagctggtggatgcctgtgggcatggctttctctggggaccccattcctgtcagtagcaaccctggcagtgtccggagcggctctagacaactttggtcataggaactctggaggtgggttctggtcatctgaggtggctactcaacaggtttgaggccccacagcaacagaagtccaggacccactaggttgcctcagaagccctaagactgatgagctggagcgcgcatttgagagaagcctcgcacccactgtgtactggccccgctcaggccggcctggcacaccgttgcctgctggcggctctcatggggaagcgcctgggcactggggattgcttgtggcccactcaactcttggggcagtggcccgtaaccctagtttgcctgaggcccttatgtccccttatgttcctggtactggagcttgagctcttgcctggaacgctgcagctgcacccaccctgcttgatcccacctgggaggccaggacactgaggagctctgaacccagcccacagggaagcagaggaagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattacaaaaaaaaaacganagaaaaaaaagggggggcctctgggacagccctttgggggcccaatcccgcctaaagggggggggttaaaaataacgggcggg

SEQ ID NO: 633588 - DNA, 740 bp, Homo sapiens
  misc_feature (41)..(41): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (313)..(313): n is a, c, g, or t
  misc_feature (315)..(315): n is a, c, g, or t
  misc_feature (317)..(317): n is a, c, g, or t
  misc_feature (344)..(344): n is a, c, g, or t
  misc_feature (353)..(353): n is a, c, g, or t
gtctttatacttcctcaacgctttatacttcagttcttctnactggggggtgtgaggaacagggggaccatggacttcatcagcattcagcagttggtaagtggagaaagagttgangngnaagtgttgggatttggacatggagttcctgaccctggagcctggcctagtgactggaggaggggcccccaagaggctgttgcccgggagaagctgaaattggaagaagagaagaagaagaaacttgaaagatttaacagtaccagatttaatctggataacctggctgacttggaaaacttggttcaaagangnanaaagcgactgagacacagagtcccccncaggaaacntgagcccctggttaagccgcagtcccaggcccaggtggagcctgtgggcctggagatgttcctgaaggcagctgctgagaaccaggagtacctgattgacaagtacttgacagacggaggggaccccaatgcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccattaca

SEQ ID NO: 633589 - DNA, 790 bp, Homo sapiens
gcggaggtcccggcgcagaagcgcgcccgggccaggcgcagatccgcatgctcgaggccgtatgccgtgaacccggactggttcgtgttcactgcgaggctgcacgggtcgcaacgatccggcagatcagcctggactgtgcggcgggtcatggagccgctcagctgtcagccgtcgtgcacggttcgtaatgaagaactcgctgaaggactgctgtggcagtggctgggcccctcggggatcgatgaccacgtttctgatcctgagcaaatgagagaccaatgtctactttaagctgatgcgcctcccaggaggccccaccgttgaccttccaggtgaagaagtactcgctggtgcgtgatgtggtctcctcgactgcgccggcacggtagtgcgaggagcaggcatgttgctcaatcatctcctcctggtactcacatcagctttggcccaccgagtggtatgcatgtgataggctcatggccacctatgttccagaaatctgtgcccctcctattgacgtgcacgagaggtgaacccttgaacacgcatcaaggcgcatgtctcctcatcgactacggacccgactcccaggagcgtggagcttccggcatgtataggcagtcaaagttgtgcctgtgcggcgctgagtcgcgggaatgaacgaaagctgcgtccgaggcagaacgtactgccagacatgagccggcatgcagggacatgagggaagcttgcatggcccatgggcgcggggctgtcggagaggcgaggaagagcctgacggggaaca

SEQ ID NO: 633590 - DNA, 178 bp, Homo sapiens
tggggttgggcaggttgggccccgacagcccagaaggcttggggagtggctactcacagactctggtccgcctctgcattaactagaagaggcttctttagagctcatctcgaagctctgaaggcagaaacttgtactgctgctgccggatctgggccagattcttccgcgcctcttc

SEQ ID NO: 633591 - DNA, 935 bp, Homo sapiens
cagctcaatagagcacacccgtctatgtagcaaaatagctgggcatggattgataggtagaggcgacgaccctaaacgagcctgttgcattagctggtggtccacggatagtacatcttagttcaactttaaattggcccacgagaaatcctcatatagatcccctatggtcagtttgactgttgggccaacacgagggatcgagctcttgggacgactaggaagaaagcgttgtagagagagtcagagatttagcacccatagtgaaggcctaagaagccagccacgcaattaagaaagcgttcaagctcaaaacctatactaaaaaatcccaaatatataatctgaactcgtcatggccaattggaccaatctatgagcctatagaagaacgtaatgtgtagagatcatgtacacgatgaaagacattgctcctccgcattagagcctgcgtcagattaaaagcactgaactgtcgaattacacagccaatatctacaatcaaaacaccaagtcattattaccctcattgttataccagtcagaggccatgctccattgcggaaaggtccctcagaagtgaaagtgacactcggggaaatcttacccgcctgtgaccagagaactatcactctagcattcaccaggtatcacaggaccgacctgccaacggacacatgtttcaaacggcgcggtaaccttaaccggtgaggggtgataatcactggtccctgataagggacccgatgaatgggccacgaggtcaggggccctaaagtgtaaccggacacatgccggccggaaaagggcttgcaccagggggagaacctaaggttataaataggcaagagcaaaccaggcaaaaaaagcataaacgggcgacgaacacccaagtgtgacccacacaaaccctagcaaacacacacacccacagc

SEQ ID NO: 633592 - DNA, 250 bp, Homo sapiens
cagatatggcttgtatatataaatgggctgatctatgtaatcacagaggccagtatgtacatgacaaagttgggaggttttatttctgggtctcttcctcctttgaataacgtcttgatgatctcctccttcttggccgggaggcgctcttcacgggcgcttgcgtgcttccttggtcttagacctgcgggcctcagccgggtcagccaggagcttctggcgggcctttatctgcgcaggggtaccgagc

SEQ ID NO: 633593 - DNA, 639 bp, Homo sapiens
  misc_feature (13)..(13): n is a, c, g, or t
  misc_feature (63)..(63): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (104)..(104): n is a, c, g, or t
  misc_feature (122)..(122): n is a, c, g, or t
  misc_feature (148)..(148): n is a, c, g, or t
  misc_feature (153)..(154): n is a, c, g, or t
  misc_feature (157)..(157): n is a, c, g, or t
  misc_feature (166)..(166): n is a, c, g, or t
  misc_feature (168)..(168): n is a, c, g, or t
  misc_feature (197)..(197): n is a, c, g, or t
  misc_feature (201)..(201): n is a, c, g, or t
  misc_feature (233)..(233): n is a, c, g, or t
  misc_feature (257)..(257): n is a, c, g, or t
  misc_feature (279)..(279): n is a, c, g, or t
  misc_feature (307)..(307): n is a, c, g, or t
  misc_feature (318)..(318): n is a, c, g, or t
  misc_feature (330)..(330): n is a, c, g, or t
  misc_feature (355)..(355): n is a, c, g, or t
  misc_feature (378)..(378): n is a, c, g, or t
  misc_feature (390)..(390): n is a, c, g, or t
  misc_feature (393)..(393): n is a, c, g, or t
  misc_feature (404)..(404): n is a, c, g, or t
  misc_feature (462)..(462): n is a, c, g, or t
  misc_feature (473)..(473): n is a, c, g, or t
  misc_feature (476)..(476): n is a, c, g, or t
  misc_feature (479)..(480): n is a, c, g, or t
  misc_feature (482)..(482): n is a, c, g, or t
  misc_feature (488)..(488): n is a, c, g, or t
  misc_feature (509)..(509): n is a, c, g, or t
  misc_feature (516)..(516): n is a, c, g, or t
  misc_feature (522)..(523): n is a, c, g, or t
  misc_feature (525)..(525): n is a, c, g, or t
  misc_feature (537)..(537): n is a, c, g, or t
  misc_feature (610)..(610): n is a, c, g, or t
gtatgtgcggatnacaccagggcttgctctgcaccctcagctggctaccggccatcctctgcntgcntntntgtccgcagcccttcccagctggaatatttgtnaggctggaatttaagctncggcaaacaaactgccggaagagggnctgannganacccaagtncnaagtcaggcccaatggggtgagtgaaagngtgngagagcaataggcgcatgctgaggtgtgagtncatggacttggggtttggggtgtnggacaaatgcctgggatagtgnatgcatgaaatatagggaggtacattangaaagggtganagttcgaaaccnccctagggaagacgcataccttagnaggtaggagtaggatacagcctngagcacacaagnttngtagagcagtnggctcggttggagaagactaggaggcctaagacacgaccaggaccaatcggttttggntttaccccctnggnccnnanttcttncattcagaagacacggggctncaacctncgcgtnntngcagtgtgcctncttcttcaaaggcatacagagagacctgggagttgggaaagggaggacgaggctagtagtgagtgttgttgtnctgaggtggcgcccccctaaaacctaagg

SEQ ID NO: 633594 - DNA, 361 bp, Homo sapiens
tactggcggtgcctctactgtatgaattgtaaccagtgacgaaagaccgtatggaagacattaaaatattgagtgcatctccatctcctacccacatacgtggagaaactgctagtgccacatcatcaccatgtagagattctcaagagtcggacgggcgcaccaaccagagcaggaaaaggagtcatagaacagacagaaaaatctcatccaagaagccgtaacgtgctatctgtcgctttgagtcaaagaactacagttcctgaggaagaactaaatccaaagatactagctttgcagaatgctcagagaaagcgaaaaatggaacatgatggttcactttttcaagcagtagaggcaa

SEQ ID NO: 633595 - DNA, 308 bp, Homo sapiens
gatctgcttgccttggcctcccaaagtgctgggagtacaggcgtgagccaccacgccctgcctacagtggcttttatgtttacttatgtagttacccttaccagtgttctatattttttctttttctttttagctactgtctggtgtcccttcattttagcctgaaggactccctttagcatttcttgtagatctggtctagtagttagcaactcccttagtctttatctggaaatgtcttaatttctctctcattccttgatagtattttcagatgtagaattcttggctgacagtattttccttag

SEQ ID NO: 633596 - DNA, 669 bp, Homo sapiens
accatgctgccccccactggtggatgcagatccgtggaggatgtgcggggtgcgccggcagaggatccacgtgttcaccatcctggccccgtgaagaacccccagttcccgttcaggatgatggacgtgatgcggaggcccctgtggagagcgagctctaccagacaaagccggtgcctacgtggcatgccaaccagctgggctgcagcaaggcgtggcaactgtgctgatggcagcaggttgtgatgctccatgcatgctgatgcctggctgaggaccctggatgctgggatggtggccccagatgacagcagtgcatgcgattacctggcatgcctgagtgcttgcctccctcgagtgctgacgctcctctggggcctagcaagtgcttgtggcaggctggcacaaggggtgtgccttgcagccaccagtgcgttctcccctgtggtggggtcctgtcagtggccgcacgacttggacactttccaccgtggtggtccccaggccacacggtgaggtgtatgacgacgagtgacgccaccctacctcgatgtcttgggtgcttgccggcttcactcccgtctgttctacacttcattgcccgagattggatggtgacccaccacatgttgggctcacgtcactgcagtgacactgcaggtgacccaa

SEQ ID NO: 633597 - DNA, 884 bp, Homo sapiens
  misc_feature (162)..(162): n is a, c, g, or t
gctcgaggtgaggatacagcagaagtactggggagtcgaccttccctcgggcgtctggttaccaacaactgtgctaatcactgtgaaagcagacatgaaattacgatcaagtccagtctgacaatcaagagaagaactgaggtacctcttatgaatcttctngtgggcgataagaggcttaccttatgaggcattagatagtacatgtgtattaactctactaggggtgctaggaatgcggtgtggtatgagtcaaaaaggagatgacgcgaatattgcaagaggcgtgttagaatgtttctctgtgggcgcgataaagattccgtgtaactggtgttgagagactttgggattttatgtctgtcttggtcccgagggtacggtctgtcgttgctttatcatattaattagggtttctattgatagaaagaattgacgaacgttggaatatgatcacggcttgaggaggcgaacgtctcgctctaaaacatgacaaagtctcgtgcagggcataaggtcaggttttctctcaacaggactcgcagacggtcgcacaaaggctcctgggaggggctgactggcgggatggccagaacattggttagtgccaaaggtgtgccatgatggttccatggagctagaacaatgttttgaattttttacacttgtgtttgccatttggattggctcgttgaaacgcttgatgacggcttctggaagttcccgtgtctgcgcccaggagaaagttggggaagtgaaaatgggggggcgggaagggaaagcaacgtgtttgccaagattaatgtgagttgccataaaaatgtaagcggcatgggatagaagggtggtgactcgtgggagttgtttatcaatttataaccttg

SEQ ID NO: 633598 - DNA, 276 bp, Homo sapiens
  misc_feature (59)..(60): n is a, c, g, or t
  misc_feature (175)..(175): n is a, c, g, or t
  misc_feature (273)..(273): n is a, c, g, or t
ttggctcactgcagcctctgcctcctggattcatggcacgtcctccttgcctcagcctnncaaatatgctaggactacaggcccccacgcccagctgattttttgtatttttagtggagatggggtttcatcatgttggccaggatggtctcgatcttttgaccttgtgatccgnctgcctcggtctctgagagtgctgggattacaggcttgagccaccgtgtccggccagttttccatttttaaggtgttccaaaggccattttgtgttanaaa

SEQ ID NO: 633599 - DNA, 316 bp, Homo sapiens
gtgtacggtcacacgcacggagaggatcaaaagaataaatacctaggttgtaaactacctaaggaggcaaagacctgtactctgaaagctataagaaactgatgaaagaaatcaaagatgacacaaacagatggaaagacataccatgctcttggcttggaagagtccatatgatcaaaatgactatacgaaccaaggcaatctacagattcaatgcaatccctatcaaattaccgaggacatttttcactgaacttaaacaaaagattttaaagtttgtttggaagcacaagagacccttctccggtggcgtggt

SEQ ID NO: 633600 - DNA, 287 bp, Homo sapiens
actttgcgtgctgcacattttggatatggtggagggaaactgatgctggcagaccccaggtgtgtcagcacatggccaagcaatgcctgtgggtcataggcgtatgtttaagatttttcatttttgaggggagacagagcctctctctgtcccccaagctgagattgcatcattgcattccagcctgggcaacagagcgagactccatctcaaaacaaacaaactaacaaacaacaacgaaacaaacacagagagccctgccactcttgtccaagaactgaagttgg

SEQ ID NO: 633601 - DNA, 903 bp, Homo sapiens
gggaaccgggtagcttgtgccaggttgtgaggaacctgcagcgcgccgcagtgaccggtgccgctgagcctgcagcctgccccgcgccgtgacctgcgaccctagaccccgactccctttggctcagcccgcgcgccccagtgccggccctgggcctggcgctgactgcggaggatgagcggcggagcgcgggaaggaggagcctgccatcagttctgctagcctggccaaaccggggccctcaaaagtctccgtctggacgctacgggtgctgcggagctgacgcgggcctgggcaggctacacggactgacactttattaggacatgtcgatctacctcggttcccccacgcgaatcacttagccatggagagaccctgcgggcattgtcaccttccgcgggcagtccagccacgagtcacacggacgggggctcccccgcagcgcacattacggccacgcggctcacctgggcccactggagtccgcaagccagggaaggctaccctgcgcaccgccgcacctcaccgtgtcccaggcgccaaattcacaccaaagcgagcagcaggcatgacggcgcacaggcacacctactggcagcgcagacgccgcgcgcgccctccagcaccacaaccgacacaacggcgcacacggaccacaaccctcacggcgcccaacgcgccacaaactgcaccgaactcggagcaccagctcacggcacgacgccgcccgagaccgccagcgactagcacgggagtgggcaaggaccaaaagccccgcaaggaggccaccacacagcacccaggcgcaacacggcacacgaccagccgaaaggcacgcggcacggagccaccacgaccaccgaagcgccgaacccggacacaccgaccgcgcactagcaa

SEQ ID NO: 633602 - DNA, 1112 bp, Homo sapiens
  misc_feature (633)..(633): n is a, c, g, or t
ctaaaacataaccacataactccaaatatcaaataaaataaataacagcaataaaaataaccataatcctaaacctaaaaccccagaaatgtactccaacccccccacaagaagacccaataccacaaatacccaaatcccatatgatcgtctaaacttcagaaccgatgacagtcgccacaccaacacaagacgacacatcatgggcgaaacttcacaaccaataactaacacatcaccacacagctccaaatatcacaaaaacccaataacaccaataacaaaaaatccccccgaagccccaaacaccacaaacacccaaatcccaaaacaaccaacaagaaacccaaaaaccacaaataccaaaatcccacatcataggcgaacttcagaaccaccgcacccgggctgacaacaacattagatgacatatcatggacgaaacttaagaaacaataactaaagcacaaccacataactccaaatatcaaataaaataaataacaccaataaaataaacataatccaaaacctaaacctaaccccccccctcaaaaggtaccctaaccaccccacaagaagcccaaacaccacaaatacccaaatcccacatgacggtctaaacttcacaancggtgccagccgcgcccacaccaacaaaagaccgcacaccacgcggaaaaattttgaaaaaaattctaatcaacccccacccggatgcccaacattcaacaccagccgcgcccccggccggaagaaaaacacataaatcaacataatcaggcaccaaatgcttaaacaaaaaccagccgaggcccccctgagcccccctttgcacaccaccgaaaaaacttcagaaccaataactaacacataaccacataactccaaatatcacacaaacccaaaaacaacaaaccaaacataatccaaaaccctaaactccacaaccactgctctctagcgcattacatatcagagaccgatttatggcctattgtaggccgacacccccacgagaaagccaataaccccacctcaaccaacacaaccccaaaacaaaatacatgcagtctccaacacaagaatcctcatactaaatataaaaataa

SEQ ID NO: 633603 - DNA, 123 bp, Homo sapiens
gatcaggaggagtaccgcgacttgacgacgtggcgcaacatcatcgagaagtagttcggaaaatcaccatcgagcagccacagcaaggtgtgccaggtcgcgacgatcaatccaagcgccgca

SEQ ID NO: 633604 - DNA, 223 bp, Homo sapiens
gcctaccaggttatcaggcggcggttcaagcaaagtgatgttggagtgtaagtgaaatattatgttggcggataagcagatagtgaggaaagttgagccacataatgtactgctgaagtcagttggaagcctgtgtcctacaaacaaatgttgacgccgtagcataccgctcggaacatggtgacagggagactcgacagtactctgtaggcttgtacggagg

SEQ ID NO: 633605 - DNA, 213 bp, Homo sapiens
gtggctctggctcgtgtgagggcacggatgcacttcccaatgccgcgcgggagacgaaaagtatggccagctaaggaaagaaagttgggtatgttctcacccaaaaactccttcacctccttcaatgtggcaaggcttctgacgaccaggacgtgggcttgcgattgtgaccaccacttctttccggagtctatggtactagctgtaatcccg

SEQ ID NO: 633606 - DNA, 538 bp, Homo sapiens
  misc_feature (528)..(528): n is a, c, g, or t
  misc_feature (531)..(532): n is a, c, g, or t
cgtttccccgccctttttttccccgcggcctgtcgggaagaaggtccgcgtgccagggctatcgggaggtcggccggagggccgcgcgcatgcgccccgcgcctgctttcaaactccggctaggaagggcctggagctattttcagaacctgttagggtggggagctacggcccaggaagttacctagcagcgtttctgtcacttggaagatctcttcattacctagttagtcctagaaacaaaatgtttacatattcattgcttgttaggctcgctcaaagcactttattggcagtgaaaccgcaagtaacccggagccctcggcgcgaccacggctagaatcagagcctaaggcgtgtgagctcggccatcccacgtctgtcttcacgctcatccgcaagcccgacacaccggggctcccacttaatgaatactgaagagtagggctgtccctaccgcttctcacttccttgttttcatcttttcgttattattaagcgacctaacacaataaacatattaccttnttnntaaaaa

SEQ ID NO: 633607 - DNA, 400 bp, Homo sapiens
  misc_feature (390)..(390): n is a, c, g, or t
  misc_feature (393)..(394): n is a, c, g, or t
tcctaggtgaaggaagatgatttcccccccatcttgaccaccccccagtcttcgccgccaaaaacggactccgccggctatcctcggcccggtaccagttgttggatccaagagaattccggaacccaaacggctcgctcaaagcactttattggcagtgaaaccgcaagtaacccggagccctcggcgcgaccacggctagaatcagagcctaaggcgtgtgagctcggccatcccacgtctgtcttcacgctcatccgcaagcccgacacaccggggctcccacttaatgaatactgaagagtagggctgtccctaccgcttctcacttccttgttttcatcttttcgttattattaagcgacctaacacaataaacatattaccttnttnntaaaaa

SEQ ID NO: 633608 - DNA, 189 bp, Homo sapiens
tcctaggtgaaggaagatgatttcccccccatcttgaccaccccccagtcttcgccgccaaaaacggactccgccggctatcctcggcccggtaccagttgttggatccaagagaattccggaacccaaacggtccattaccgcggctctgggctcgctcaaagcacttattgggtacgagctgattca

SEQ ID NO: 633609 - DNA, 210 bp, Homo sapiens
tggactctgagcactggggaggaactcaggctcagcgatatcgctgtggaggaactctagagctcagtgataatctgctgggaggaacatcagcgctcagggattatcgctgaggtagcgaactcaggctcaaggataacgctgggaaggactcaagctcagggataacgctgggaggaattcacgctcagggaattacgctgggaataa

SEQ ID NO: 633610 - DNA, 844 bp, Homo sapiens
tgtataatactaacagggttcgtcgcgtcattgaaagaacggccctgaaagcacattattgtagatcacggcgttatgttagtcatcagtcattactaacgtcgactcgtcagctcctacttatcaacgaaagacgactagtatgagtgagttcattctgttcgacgacagtcttaatacgtgcgtgcatcgcagacgaagacgacagtctgtcaggcagatggatcgctcctaagtcatccctctactctatctagttgggtcgaggctacgtacaggcatacattcgatcgcatacatggagccagccttctatatctagctggcaaagacagccaacgtgctagcaagaaaggaagaaagcgaacgaaacgagcgctaggtagctggcaagcgagcgatcgctctgcgtgtacgtaccccacacgccgggcgtaatgaatgcgtccaggcagcgtgcctttcgtcattcagtctgcgcgcctgttggtaaggaagatcggtccgggcctgcctgttagtacgccagccggctaaagaaagatgtatgtcaagccagttaagttaggtggctacaggcttttttcagtcagtccgttgtttgtcaacggccggtcagttgattgtaggtagctctctctataagctatctattcgcatgcatgcgtgcgtaagttagcatggtttatatagaccgcctgctacttctatccgtctgcgagaaagcggccgaagggtcggtcagctacagcccagacagcaagtgcttgaaaggcatgcgtcaggcaagcatgcgtgactgtcattcatagtaattaaggttggttctgaccggccatatgag

SEQ ID NO: 633611 - DNA, 232 bp, Homo sapiens
  misc_feature (19)..(19): n is a, c, g, or t
  misc_feature (149)..(149): n is a, c, g, or t
  misc_feature (215)..(215): n is a, c, g, or t
cgtactggctgctcaccanccctggtcccgcggggtgggtactgcgtggccctgtgtacccgaggagggctactggcgtcgagcccactgcctcagaagacttcctttcatctgttcctactgagtggtcccagccagcagttcaggantgccctctcctgggcagctgcctcccctcctctgcttgccatccctccctccacctccctgcaatnaaaaaagttttactgaa

SEQ ID NO: 633612 - DNA, 796 bp, Homo sapiens
  misc_feature (1)..(1): n is a, c, g, or t
naaaatttgtgttgggaaaagccccccattaagcttttcttgtgaaaaaatttcttttccttggttaaaaccggtccgggttaaaacccacccaagttttccgggtggaaacccggccctttttttaaaaaaaaggggtaggccaaacgggggcccctttgaagaattttatcaacgtgtggaattttttacaaaaaccttgggtgcccaaaatttttggaaaaaagatttcccaatatggcctgttttttaacccaagtcctgggggtgtcctaagcaaaagggagtgaacggtcaagccaccctcaaaggtccaaaaaaagtcaaaggccatcgcctttgaacctcctttaggacacaacaaaggactttgttgagaaccctccaggccatgttcttggacgtttgtattacagggtttagggaatttcaggcccccctgtgcactgtcgtgctggaaaatgttctcacccaaagggaaaacagtccacaagaaaatgttggaaatgaatggaatctaaccatccctcgcctgaaaattagggcttggagatttagcaccgggggcccccacatttgagtgcgtggaagaaaatcctctttgagtaaaaaaggctcttcaacagccccatttatcctgggcccatgaccgtggccaaaacctggttccattagcacttgaccattccttacgccccttccccatcgggcgccgtttaatgtcccccactgagaagtcatgtgataaaaacctcccaggttattgttccccaaaaaaatgtatgtcataaaaaac

SEQ ID NO: 633613 - DNA, 444 bp, Homo sapiens
  misc_feature (92)..(92): n is a, c, g, or t
  misc_feature (96)..(96): n is a, c, g, or t
  misc_feature (101)..(101): n is a, c, g, or t
  misc_feature (423)..(423): n is a, c, g, or t
tccttctggccacgccatctcagccaaggaactgtagttctgtcagagtggtcattgggttcttggtgacctctctgaccaaggtccttctngccnggttnctcagtttggtcagatggtcagctctagccagagtctgggtagttctgtattttgtaaaccaatttcccaatgatggagaccactgtgcccttgaaaattagttttatccccttcctcagatatacagtaccagtcaaaagtttgacacctactcattcaagggttttcctttattttttactatatctacatcgtagaataatagtgaagaaatcaaactatgaaataacacatggataatgtagtaaccaaaaaagtgtgaaccaaatccaaatatattttatattttctaagtagccaccctttgcacactgcgtgccngaaggagggatactctagtac

SEQ ID NO: 633614 - DNA, 1642 bp, Homo sapiens
gctgaatactggagggccttcaaaggctctcatcggctgctcagtacagcggggctcaggtccgcgtgctctccgaaccaccccagttccatttaggccagaaccggaatcgacgaccccatgtaatttctccggcagaaatttcctgtccgagcataggtcccagcatatgagggttgcatgattgcgattcctgtgatgtaacgcaggaagcagaacgccgagttgccgtacgtattgctggagcaattgaagtgcagcttagcggggagtaagatacttaccgacgacagtcagtctagccccccagcgatgagctcgccagttcggggctagcagatcttccaggctcgcattctcgcgtgatagatctagcgtgcacgcgcctagcacgagataacctgagccttggtttactcccccgaaccttttgggcgccaatgcattgagcactcatcgaaccgaatagctagggcgcaactagtgatgcagattggccatacaacgtgggacgggcacccggctgtaacgcgcgcgcgaacacattctccgtagggagggcacactgcccttgccgacatgttgcccccatctacgccgttctcgcaacacgcaccccgcaactagcgccaacccttgtgatccaccgttgagcgctgcgtcgtgccagcaccacagcctgcaacgcactgcgacaccctcactctgcgggtccccttggcacccccacaatccccacccaaccgcttcgtggtgctcccctcaggccaaacacccccctgtcgctcccggcctcggcgccacgtctcccttcgacttgacaacgccccaacgcgcactataccgctaaacgagaacgacctgccattataccgttctctatactccctgggccgcccaagtgtggtgccaccatttatcatcccacgccaacagctttaacaccaaaataccgccggtacctggcgcagtattacccattcccacaccggtggtgcctacatatcaaaaccaccagcgaccacccccacaaggagtcatcccccgaggcgcgccataggccccaatattgccgcgcgcgcgaaaatggcttgcaccacactcactgtcctggctgcgaaccgacaacgcaagttgcgcccaccccagacctctaccggaactcgcactctcacacacaaacgcttcactcggcacaagccatcgaaccccgcgcaaccactccaacacgacaacgcgacccacacaaccccccaaccgcgcccacacgcgcaccgacaacccgccgcccccccaacaccgcgagccaaccgacacgcaacaccgcgcacaccacaacagccacccaccacgcagcgcgcccatgacaccgcccgcgcgaaacaccggtcagggcgcacagccaccacaaacaccgcgccgggcaccgtgacccaccactacgaccatcccactcgccacacgccaccggcacgccacctgcgcactgccaacactgctcccaccccacgacgaccgcccatcggccctagcccgagacgcccacgcccggcaccaccaggcgaccagcccctccacgcaccccaagaccaggccacccacgtccaactaaccccctccgtggcccgctcgcgcccgcacc

SEQ ID NO: 633615 - DNA, 188 bp, Homo sapiens
gagtgcaggagcgttcattggagacttaatggcagcatacttcttctctctgcagctactcggtacctcttcctttgcttctgcagcatctatcttctcttccttcatggtaccggtcaatgcctctgtaatgggtgtcagggcctctgccatatctgccttctcatcctccactttggtttcctcta

SEQ ID NO: 633616 - DNA, 377 bp, Homo sapiens
agacggaaagcagttgtgagagccacaggaaaagcagaaggagaagacgaacacgacaacgaggaaccccaagaaagagacgacgaagaaagacaaagagcacagggggcagtgaggcacctctctccaattctgagaggccaggcaccacacatgatcgatcaatcccctggtggaagaggggacgcggggcccgggtgcaggagggccgtctgcagtgtgaagagtctgggctgtggtgctgtccggggtgggctggactccttcctgtgcctgcccgcgactgggggggccccctgctgggtgttggccctggggactgctcggcgtgaaccgggcgggggggggcgcaaggtctcccgggcgggtttttacgg

SEQ ID NO: 633617 - DNA, 250 bp, Homo sapiens
  misc_feature (206)..(206): n is a, c, g, or t
  misc_feature (212)..(212): n is a, c, g, or t
ccccccgggggggggggggtttttttttggggccccccccccccccccccgcccccttttttttttttccccccttggggggggggggggccccctttggggggcgggggggggggggccccgggggggggggggggccccccccccttgggggttttttgccccccccccccccccccttttggggggtttttcccccccctttngggganattttttcgggggggggttttttttttttttttttttt

SEQ ID NO: 633618 - DNA, 268 bp, Homo sapiens
caagtgtggggagcgtcgcgcccgcgctgccgagccttggatgtccccaagagatatctttcccacttttatatcatctcagggcggtggaagggcttccggcttgggtgccttactcaatctcggtgccggggagcaccttttccaagcgggcttcatggttggctcagaattctcggagcggcacagttccagggaggggagcgggcacggtctgcattctgagggctagtatgtctgtgacttcccagttggctcagaggggtac

SEQ ID NO: 633619 - DNA, 905 bp, Homo sapiens
cgagcctgacaaaacggccattacgctgtgactagccccgtccacgtctttccacagggcgttatcacaaaaagtcggaatgacgacctggggtgtgcactatgtccaagtgggctgtcccaagtgtcggcacgcccagaccgctggtccgcggcggcgcacacgaaagtgttccggccacgatccctgcatcgtttgtgcccgcgcctctcctagcgcgtttctgcccacacaatctcctccaggcgtccccgcgtagttccttctgttctgcgtgccccttccctccctatttgtggggggccctctttgccgcacgccgtctttttcaacaaagtccgctctcgtcgctccttcctccccctaatgctttttcccctgcaactccctgtgtctccccacggccttatttccgcctcccctggttgtcgcgcaaattgtcgtgccccccctttcgggtatccctccgaacgtcaagaaccccctttccgcgcagttagtattcttatcacatcacgtctctcttgagatacaacgcaactatgaagaatggctagccccctggcaacatgtttcctcccctcaatattagagaaaaagtctgttctgccgcactttcgtgcgtccccgcagtcccgcgtggaagcccctggtattgcagatcattctgacagggtggcatcacgccctgttcatttcctgctctttatgcgcaagtctctagacgggaggagcacccagcctctctggtgtctccgcgttcagtgcctccgccgccccttggacgcggaggcccgtcgtggttgatgcccagtacaatccctcaccccttgggtggccccagcaggggcggattcctggccccgggtttgagcccccccgggccccaaccaacccacaaaaca

SEQ ID NO: 633620 - DNA, 355 bp, Homo sapiens
ttgtttttcccttttcccaaggagggtcgtggggcggggtggggccttttttttttgtggggtgaccccgggccccagatgcctttttattggggtttttccctttttggatggctgcaaagccaggtgggggtttttttttgggggctcggtttgttttggggccttgccttttgtgggggggggggggtttctttccttggggcctgggtgtgggttgttggggggctttgggggggttctttttttttggtttcagggggggtttccggggggggggttttgggtgttttgttttttttttttaggggggcgggtgggaattttttttttaattttaacccaacccctttta

SEQ ID NO: 633621 - DNA, 243 bp, Homo sapiens
tgggcccctaattttgggggtttttttaaaccccaagggggaaaaaaaccccctcccgattttttttttggttgggtttggcggggggtttttttccaaaaccccttttttccccccccaaattttgggggccggggggaaattcgggggttttaccctttttttttcgggtcctttaaaacccccaacccccttgggttctggggccccccggcctttaaaaaaattccccggtttttttga

SEQ ID NO: 633622 - DNA, 118 bp, Homo sapiens
acccaaaataagaagaaagaaagaataaccatatctcatatcacctaaaatccataatagcttcagagccctagaaataaaagggctctgaggtcaacccaaatcctctcctgaccat

SEQ ID NO: 633623 - DNA, 174 bp, Homo sapiens
tagaggatcccctgacgcttgacatgtctgtcttcgtcaaaaaaaaagggtacctctaggacttggggtgcacgagcggttacgatcaggatgtctatagtatagggggattccttatcccctccttatcctccctgagcgaccaccccttcccccacaccagacaaaagtcca

SEQ ID NO: 633624 - DNA, 348 bp, Homo sapiens
tggctcccccttacactttgtcacagctactagatagtgctgatcggagaattgcttgaatccgggaggcggaggttgcagtgagccgagatcgtgccactgaactccaacctgccaatagagcgagactccgtctcaaaaaaaaaaaaaaaaagaaagaattagctttgaaaaaaataccgcacttcagaggaaagctttttttctgcttggtgtctttacaaagaatagaaatatttgaacctatgttttctaccgatggtgtggataagggtgagctgactgaggcatcgctcaagctggggggtggtgtgtaaaaagcacgtggagccacaagaggcacctccg

SEQ ID NO: 633625 - DNA, 171 bp, Homo sapiens
aatcccctgtgatcgtactaggcggcccctcggggcccccgcagcagcagcagcagcagcagtcggtgccagacccggccgggcggccaccagcggccctcggaggtacccaagccccacggccgagctctggccggagatcggccgccacggggggacacagcagcggcc

SEQ ID NO: 633626 - DNA, 1751 bp, Homo sapiens
  misc_feature (1733)..(1733): n is a, c, g, or t
cggtttcgtccgggcacctagtcttctcgtgtgtcgtccctcactctgtattgtggctgtgtgtgcgtcggccctgcgtgttcggctctgtgtcgcatgtgcggtgggtgcgtggtagggtgtgccccgctgttgtgcgtggctagcggaagccgatgcggggtgtgtgcggcgaaggtgttgtctggtcacgcgtgctgggtggcttcggtagttatctcgtttcgggcgtgctcggagtgggccctttaatcccttttgtagctctcctcctttgtcgttgctacaggtcgtctgctcaatggctggggttgctagagcgttgtgcttgcaagtggtgggcgtggtcagctccttcgggcgctttggcgtcagcgttcaatccaatatttgtctcctcagtcaagcttggattctaaggctcgtgctgtcgtggtgcgagacaccccctgagagggttgcttctaacaattttggcggctgatacttaactctagctgccctccaaagggctctatagagtgccgcgatgtgggagtgtggagctgtggatgttggccagtggatgactttgaaggtgcacagctctgaatcctgcagctgctcctacgttggtgcggcctgctatttgctacttgctaagttcccgctagacggctcggttctagttgctcggctgcgtgctcgtgtaaagtggggagtgtagcagctggttggtgtgtgcgtaagctggggtgtgcgtagtaaagtagagtgtcaagagtcgagtggggatgcgtcgcctacatagggggcaatctgtaattggtcgttggggcgcctgaggcaggagttcttctttgttgggaagttgggtgtctgtgagtagttagtggaatacgagatgttgttgcggttgcgtggttgtggcaaaaggggggggtttcctgcagtttgggaagttccgcacatagggaggacgagcttcgacgcagaactacggtggctttggtccgtggtaaagcccgtccgcgagagcttgttgcattgccctatgcggtagccagtatgaagcgggcgaagacgccgtcgtacacaacgggcgtgtttggcatgggcacgagccgtcggatagagcgtctgcaatgtggtttgatagacacgtcggtgtcgcgtctcattctgtgtctaggttgggcctctttcgtcactgtgttgtgtgctcggtgttacccctgtccgtgagaggatgcatacggtggaggtgtcgaagttctacagagctttcgcgttgttgaaaggcttctcattagcgctgccctatagactacataccttgacgggttctgactctctgctactccagcatggccagggtacaagctatggtcatggagcgcacaagacatctcggctgacaagtcgactcgtgtgctagacacgacgctgacaggctcttgatcatgaaggtctatcggtcttaaaggacagcacggtaacacctcgacgtgtggcgactgccaagaatgtagccaaggaagcgtagcctctcttaatcgctggcccaggcgctcaggatttcattttacttacgcagatacgctagtgtattgggttgggaacgggaagagagggataagaaaatacctttcttcctgtgctaaactcgcaatcaacaaacatattttgagtgcctttatgtgttccttggcaccctgttgggtattgggtacttggctacctgttgggtattntaaccggggtgagccaga

SEQ ID NO: 633627 - DNA, 904 bp, Homo sapiens
  misc_feature (148)..(148): n is a, c, g, or t
agcggatgctcaccattctcaagcttgaaaacccacctgcaatcatttgggcggggggggggggcatcttaaagcgcccaggtaaactgggtctgcaggcagcagctgtcctttcctcgggaatcttcggcgtgaggcttcggtaggntggattaagttgaatacgtgatttggtggcaggaacttccctttcagccaatctccgtgtctcccggggagggcctcgtggaagaacccagttatcagaaagaatctggtagtttgccgtggtggcagaagatccgacccaaacgttgagcaaaaccagtttcaaacgaatctcgggttttgaaactccccgaaggttcaggctgaaagagttcaacaaccagcaagggtgaagactctaggagttcgtgtcccccttgaaccgtggtggtggacccgtgatcaaacctcgagggaagggcggggagaacacttcccgggtcagctgtgtaggaaagccagagagcatttggagaagaggctgaagctgaattttggcaaacacacaagccctctgattttccccagagagaaggtttttcctcgtctacattcccttggaaccacctggggtgaggaaaaacctctatttggggcaagcaggaaagaaacaggaatctatggactggaaagagggtcgggtaaagaggggtcctcgccaggttaaggggagggagttttcacacctctggtgttaaaatcccaacgttggattcttgaaccctttgttagatagaagtctgggggacgcaggttcaagagacacggggtctgggcctcctgcaggcgggtgctccccaacggccggggtcaccgtctgaggcgaacacattgtctcattctggccgattggtgaagcacgagtcccttctctgag

SEQ ID NO: 633628 - DNA, 875 bp, Homo sapiens
  misc_feature (26)..(26): n is a, c, g, or t
  misc_feature (492)..(492): n is a, c, g, or t
  misc_feature (510)..(510): n is a, c, g, or t
  misc_feature (577)..(591): n is a, c, g, or t
  misc_feature (599)..(599): n is a, c, g, or t
  misc_feature (603)..(603): n is a, c, g, or t
  misc_feature (615)..(615): n is a, c, g, or t
  misc_feature (630)..(630): n is a, c, g, or t
  misc_feature (633)..(633): n is a, c, g, or t
  misc_feature (635)..(635): n is a, c, g, or t
  misc_feature (640)..(641): n is a, c, g, or t
  misc_feature (645)..(646): n is a, c, g, or t
  misc_feature (680)..(680): n is a, c, g, or t
  misc_feature (685)..(685): n is a, c, g, or t
  misc_feature (721)..(721): n is a, c, g, or t
  misc_feature (760)..(760): n is a, c, g, or t
  misc_feature (785)..(785): n is a, c, g, or t
  misc_feature (787)..(787): n is a, c, g, or t
  misc_feature (870)..(870): n is a, c, g, or t
acggagctctcagggctggcgaccancagcagggcaacgccatcctatcggaaccctgaggaccagccccagctcaggacggctggcttgccaacatccaaggtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttncccccgacagacagagcngcccccacccgggagccttgatgggggtcaggcagaggccagcctgcactggagtctgaggcctggnnnnnnnnnnnnnnncccctaanccangtttctcattantttttcccgggcctntancnaaatnntaannacccctcccccatctcctcttttaaaaccaaaanaaaanagcgctcctctcccaaataggaaaaaggcctctaanaaggagaaattagtgtgcggcaaaaggcagttttctttnttctcagactaatggatggttccananaagaaatgaaatgtgctgggtggggcgggcctccggcggccggctgctgttccatgtccacactctgaggctgcacccctctntctac

SEQ ID NO: 633629 - DNA, 343 bp, Homo sapiens
ttagaagaggcagaaatgatagaaattgattattttttcatagcggtattcaggatctcgatcaccttgtgcccgtgttttaaacttcgtcatggtaaatcctggctcttcataatacatgagtaggtcccttggtgcgcgtgtcacttgcgctttaatagtgttgatgtactcagtgccgtcgccgtgtactacattagagacacagaacaatgtattagaatttccagctgtgggtttgaagacttagggggacatccagaacgtgcttcctctttcagacggtgtaaagtcccctggaattacacagctttagtgctgagcttttaaaaatgggatgcag

SEQ ID NO: 633630 - DNA, 505 bp, Homo sapiens
  misc_feature (89)..(89): n is a, c, g, or t
tgtgagaggtggcgtgcgtattctggcatggacagaactggcaggagaagtgacgtctggtctgccgcacacattctcgccacttcttntgtctgagaactccagcttcactacttttctggacccgagggctggcggcgttcagctgtgaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcgttacagagaggagaagaccctggaagagcggcggtgggagaggctggagttccttcagaggaagaaagcattcctgcagcatgtgaggaggagaccccgcgatcacatggccccctatgctgttgggaggaaagcagaatctcccat

SEQ ID NO: 633631 - DNA, 136 bp, Homo sapiens
cttctaaccaaaaatcacaaggtcatgaaaataccatgtacatgaaaaaagcacatgacttgattaaactctactcattatggtaagtggcaaactagtaatagaaggtccaggtatgccagaaggtccaggtatg

SEQ ID NO: 633632 - DNA, 322 bp, Homo sapiens
gtatcgttacgtgctctgtgcttgaggactgcggcttcttcgctgatttcttgtgcctatagcagtcaggaagggcgcgcaggagcagtgggcagaggtgcttacccagacccctagcccatcccactaccaggagatgcagctcgaccctttctgccgccctccacaactgtatgaaggtgctggggccggatgggagacggagggcggacccagtgtacggtcctgagttggctctgtggtgtacttggatacccaggccccattcaagatggaggaacacgccccttcactcctcatgaccagcaagtactgtgtgact

SEQ ID NO: 633633 - DNA, 700 bp, Homo sapiens
tgtcgatacctatttcaagcgatctggtttaccatggctaggatggccgacaagaccgagcgtttgctcatggacaggacgagccatttgatcgtggtcattaagatcaagtccatgcctatgaccgaactcacgtccactcgcttgtagtccaatacactctatcaatgactcgcgattcatgattgatccagagcagcagtcgacgcgaacctcagtcgtgacgcgcttccacgcagcagatgcatcagttacagccctcttccagcttacctgatcacaatggcagcgcgatactgccctcgccatagccaagtacacgagcatggtcaagctgtcaaccgactacgctggcgattcctgcggtcacaatctttttccgtgcctccctagcactatgaacgtgtctgccacttcactttcaactctatactctccgccctcccaccaattgcaccagaaccgcttaccacctctcctactatgcccttcctacaccgctccctttactcctctccctcttcccctccctcccccttcctccttgtgcccctctcactcccaccttcgcaatcttccctcggctacctctattcatcccctacttctctttctccttgtctcaaccacctcttccttcctcactccccccactcccccagcctgcctccgccctctctgtctatcccacaccctcccc

SEQ ID NO: 633634 - DNA, 521 bp, Homo sapiens
attgatcccctgtggccgatgaacgcgccccagaagtcggcctgcacgtgcacgaggtcgaccggcgggcgtcgcgtcatcgcgcgatcgaggaatcggtccgtcgctcgtcccggccagctcatcgagtactcgcggtccaccgtgatcggcagggacggcagatccacggatgacccgctggaggtgcgccggacgtgcatccgcggcgcgacgaccgtgacggtgtgccccgcgcgttcgaggaatgcgcgctgcagccgcatcgacacctgcgcgcccccgagggagtcgaggtgctgatcgccgaagaagacgatgtgcatgtcgggccgctcgctactcgggcagcggctcgtcgcggtacagcgcctcgaaggtgtcgagggtgcggttgatgtcgtggatcacgacgccgtcgagcgacgcctgctgcatccgctcgtactcggcgggctcggcggtgagcacgtccgtcaggcgggcagcgagttcgtcgacgttccccggctcgaacaggt

SEQ ID NO: 633635 - DNA, 227 bp, Homo sapiens
tcagtcggtacccctcacggattactcaaggtcatctgatcaaatggatagttcttcatcttctccatctctttctcatattctacaatcctggcctttgagagagacacccactcagcacaagatttcacatcttctttttcttcggcatccacctgggcagtatatcttccctctctcacgtcactccaactctgacactgactccattgtcacgtatccttttc

SEQ ID NO: 633636 - DNA, 576 bp, Homo sapiens
tcagagagggtctggctcagtcgacgcagagcgtgaaggcagagtgcaggggcagtgatcacagctcactggaacccgtatctggcaggctcaagagattttcccaactcggactcctgagtagctgggactacaggcacatgccaccacacctggctaattttttttatttttattagagatgaggtctcgctgtgttgcccaggctggtctcaaactcctgagcttaaacgatcctctcaccttggactctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattatcgttaactgtagttatcctacatagctgtagaacactagaatttattcctcctatctagctctaatttagtatacttttaaaaatctctccctattgcctcctccttcttacccttcccagcctctaatatcctcgtt

SEQ ID NO: 633637 - DNA, 166 bp, Homo sapiens
aacgggtagctgaagggatgggatgtcatgaaggaaagtgggtagctgagtgcttcaaagggcctgcatgggacaggggtttagggtgaagtggatgaggcccaataaagtcttgtggggtaaacgatgggaataaacatggagaaaggaacgacggaggcagtgt

SEQ ID NO: 633638 - DNA, 256 bp, Homo sapiens
cgcaaggctcctcagagatcacactgtagcagctggacactcaaagatgaacggatagaaacatcagcgtccattttggactgtgcctgtcttgtggctacgcgggttaggggtcccggatgtctagtgtgcagccctacagtctggactccctttgtgagcccacacatgccccttccccttgctacgcctggcaggctgtctccttcttttctgatgctgccctccatctgcatctgagaccctctcccttggc

SEQ ID NO: 633639 - DNA, 250 bp, Homo sapiens
tactgtggtgtaccgtgatccaagccaaatctgggaactacaccacagctcacagcaatgaggatccttaacccactgagtgaagccctgggatggaacccaaaacctcatggttcctaattggattcgtttctgctgtaccacaatgggaactcatccccaggagttgttaatgagctttgtgggtgaccaattcctcctgtgcctttggtcctgctcctcatttttcaggggcactgaggggcacagg

SEQ ID NO: 633640 - DNA, 131 bp, Homo sapiens
gatgcacagtcattcccttgtgatatgtcaagtgactgattggtgaagagttatactcacaaattattataatgattactaatatattttttccatgtttcattgcctgaatgaaactgtttaccacggtt

SEQ ID NO: 633641 - DNA, 353 bp, Homo sapiens
ggtaccgattgatgtgtgggagcacgcttactacttcagtataaaatgtcaggcctgattatctacaagctattctgtgcacatgttctcaactgagagtaatgtcactgataatcatacattgctgtgcaaaaagtaaaccacgatcgttatgcttgatcataccctaatgatcccagctagataatgtcctgtcttctaatatgtgcatcaatcctgatagatcctgtaaaccctatctggtcctggctaatttttgttgagacttcttgcattgaagagatcttctattttccatttgtgtgaagttgtgtgcctgttactacaagaatctgtcctgctggcgatcccct

SEQ ID NO: 633642 - DNA, 398 bp, Homo sapiens
agagatgagcgtatactagaacacatatagatgctccaaaagactcccagacagataagctacttcagtaaagtttcagggtataaaatcaggaggcaaaaatcattagcatttctatacgccagcaacgtccaactcgagaactaaatcaagaactcaatcccatttacaataatcacacacaaaacatacctaggaatacatttaaccaaggaggtgaaagatctctacagagagaagcataaaacactgatgaaagaaactgaagaagacacaaacaaatggaaaaacattccatgcccatggattggaagcattaatattaaaactaccatactgtccaaagcaatctatagattcaacacaattcctataaaactaatgtcctctgtcatcag

SEQ ID NO: 633643 - DNA, 162 bp, Homo sapiens
tacgctgcggctggccttctttcggcagctgcttgcaaatggtgcgccacacttcgcgcggcggtgacgccgtcgtcgcgcaggctgacgctggcgcagcccagcacgtactggtagccgccgcggcgcaggtattccgccaggccggaccacagcagcatg

SEQ ID NO: 633644 - DNA, 473 bp, Homo sapiens
gctgttccagaggccaaaagactactcaccttgacgccctgctcgaaagttagctagttccgggatggtgaaactgtggctttaagaaacggagtcacaactggctgcaagcagcaagggctgacagcagaggtagagtcctggccctgtgggtggcagcaagtccacatggttaggaggttaaagagttcttattggccgtcagcctagctgcttctgctgaggcagaaccctgtgctcagagcctcttggtttagacccatgtcctggttgagaattccacctatactgaagtgaggggcggaaggtacgagggagtgttggagtagcccacctgaatgagtatggggccttggctctaggcgtctggagctctcaccactgaaggttctaggatccctagtcgcaggtgatgacttccttctttctgcctgttccagatggcaagatagggaatgagcaaacgtgcaagc

SEQ ID NO: 633645 - DNA, 351 bp, Homo sapiens
tgactattccacaggggagactggcagagcatgtatgcacgttacaaatttaattcttaactgtaaaaacacttgtagtggagggggaagagaaatagtcaagagtcttaagaacgctccttaggagccataaattcaggcaagctgtagggcaaggctgctactgggaaatcaagacaataaaaaaatgaaacaaaactctaaagcaggagaaaatcccagggagcagccagctaaaggggaagtcctgagcacaagttacggctgtgaatttttaaaaggcaaaagtgaagtccctggatgtggtaacctgcgtcctgaccatctgccataacatttgctagtctgaat

SEQ ID NO: 633646 - DNA, 766 bp, Homo sapiens
cgggcttccggaaaaactggggaagggtacccaggtgccttttgaacgctcaatcttgacatcagattcgacctatagttctgaccgtactaaagagaggactactgtcgaatggacacagacacaagcgctcatgtctatgcgagttcttggcaaacctgagccacgcagctcagccgtgtcccagagagtttgccaggggaaccggagatccttcctcaagcaccctgctaagtgctcatctgaaggatcttggaccgaagaaatctctctgatgaatgatgacttgttaccaccagctccttcgagaactcatagaacggaagactcagctccttggatccttaacgatcaggtggccatgggaaggcagtggcttgcaatccagaagtgtacgaagcataaatcctacaaataaagtatgagtaggaaagccagcaaaggcaggaaacttcggtttcatgtccttagcaagctacctgacgtttcactggcacctattgaccatactacagactgaatgatgatgccaggacagaactgtaccgctctctttgttggccagctccaccctacccgagcgaaggccacggggattgacatcgcccacctccgacaccacagtgggcgacatgggctaggtgcgactgcctggtaccagataggaggaaaaccagtgactgttaatggggtatgagctagatagggaagaccctggaaagatgctagcgttccgaaccgcgcataacacacgggaggcgcgtcc

SEQ ID NO: 633647 - DNA, 501 bp, Homo sapiens
atggaagagaagtcatgagagaggagaagacgttatcccgcatcgcgtttatgcagcaggacgtgctggatcgtgcgagggagcaattgagtgccactgctgaggagatcagggtcccaagagcattgaccagatccataaggaggctgcgatggcagaacatcgagagcacatcaaagtgcagcagctcatggccgagggccgtgaccaagcgtcggggcggtcctccaggccctcccatcagccgtggacttccccttgttggatgatggtggctggaacacagttcccatcagcaaaggtagccgccccattgacacctcactgattcaccaagatcaccaagcctggttccatcgatcctaacaaccaggtctttgcacctggagggcgactgagctggggcaagggcagcagcgacggctcaggagccaagccctcagacgcagcatcagaagctgctcggccaggtactagtactttgaatcgcttctcaggcct

SEQ ID NO: 633648 - DNA, 1219 bp, Homo sapiens
ggcagctgcatgaaggaccagcagaaatgatgcctgatggcggaagggctgagctgtgtacctgaccctgctgcctgaagctgattccctccgtgtgcagtgcctgtgtgagtgtgcttggagctgtgctgcctgcgctgagcatcctggcccatggtatgcacctatcgatgtgaccatgcagctgcttctcatctgtgcccctgacaatcctgggtagagcttgtgccagacgccctctgttacgcaactgtggcatgtaactagcgcagagccacactactgtttgtatctgcttgtatacacttgtgtgaccatacatacgcttgatacttgttagttgagtagaccagtaccgtcatactagctttgccttggattgtgactacttgcgcttgatcgtatattatactgtgactgacacttgctttaccaatatacttctacatctagcttgacaaaccattatgtgacatgatacccaaagcacttattgactagccgtacctttattgaggacctggcacgagacgtggttcgcatgacacgccatgacctgaccattatccacgcttatttgccctcacattggcgccatatggcgaaagtggacaacttaccttcaccctattaaacacacatataactttaccatttggactcttagcgcctttggcgattggccatggcacgccatccgtggcaacgtggagtcatattcccttgctcgaattgcccattggcgcggtaagacccgaagaggcacatttggggtattgtgcacccaaatccgggtgacatacccacgcacagagaccattgcgcccattattacctaaatcgcacagcaacttatgggacgcggcccttgcctcggcaaccgggagcggcgaactatgccaggcactttggcacccgcattgagtcgacagccaatcacaaggttcgatacgagacgcagagtaaggacaattacacatgtattcgcgagacgacaccttatgaagactaggggccaattaccccactatgatgacgaccctacaagcactaaggaccaccagaaggcgcccctatgtaagaaacaatatatcgcaattatgtaaccatgtaggatagaagagggtatacatatggatatgcgaatcacgtgacggccccaaccaatcgtgtagcacaatgatcagcaaataacagacatattacacactgtggaggg

SEQ ID NO: 633649 - DNA, 1230 bp, Homo sapiens
  misc_feature (714)..(714): n is a, c, g, or t
ggagagagagaactagtctcgagttttcgttctttttctcttttgggggacctctgttttaatttggagggcaccaaaccagcaggagggcctccaatgtgtgtggggggtggcggccctgggcgcacggactgtggctgtggcatttggggcgcagggccaagacccggataggtggcaagaaactccacaacccctcgaaaggcatgccctttaaagtgtgcattcgcagcggtgttgccaaggccatgggggctaaccaggggacatgaggagcctcctcacagggcttgtgatggaaaacaccctctcacctatcgccacaaaaactatgtgtgcccccccagagacaagccgagcgcaagtgtgcgtctctcacctggtgacacctgtgcaacaccccacgggggtttatcaacagggcacagagcgcatacacatgatatcccctttagtgttgagacacagcgggaatgtatacccgcgtgtggagacaccccctgtgtctccaagatcatatgtctcaccagtggggaaaaccatgtgggctcgccataagagtgtgtgtgagacaccccgattagagagattctaccccacgggggaagacaaccccctcttgagtagtcccgcatctgcgacagaaaagagcacccccccccacaaagagggcgacacagagtcgtccgcaccaatttactaatcttcacaganccccccaccaaggaaaaaacgtgtagtacgtggcgacacatgtttgttgggaccccgccccaaaattgttgtggggggacgccaaagacacgtcgcccacagggtgtcgtcccatggagcagcgcaccaaagggtgtgacagaatagcgtatcgcccacacgggagacagagttgttgtggcagcccacgatgacacctcccgtcgggagcgaccccaccacaacggtggcgacgacaacgagagtaccatcagaagggagcacagcttattcgcacaggaggaaggccaaccagcaggggggggatctacatccacgcaataaataacccaccagctcggaagagaaggagaacatccccgaacagaaaaacaggggggcgcatagctcgcgcgcatcgtcttccccacccttagtcccccggtagcaacaggcagcggacagggcacaaacaatacaggagagggcgcaaaacccaacgggggccaccagttagcgagaccagagtgaatgaac

SEQ ID NO: 633650 - DNA, 975 bp, Homo sapiens
agcggggggggcttatgggctgaggcgcgatggcaggatgtctgggctgggcctcgtggcgagagcgatggggcgtgcaggtccctagcatgtcttgctcagcgctgatgctgccaacatggcgcccgcatggggacatcgtagcttaccaccattcgtgcgatgcaccggagaatgcgcgtgggggggttgcgcatggataacttccacgatggcagacacactgggtcactcgggtcgatacctagtcagtgagcacaccacgatgttgtggaataatgcacgaatggaaggttcatatccattggcccctcgtaggcgccctggggtctgagaggcagtgcatcgtgaagaaaagttgagagggaaccacaccgcatagggccaaatggatagggctcggctggtgccccggggcgacgttaccggtcttgccgggagggcgtgccgcctatactaaatgctttctagaacttctcgcaggtatctggcaccaggattggatcgactccacaagttcctgttcttgccattgtccatgatttacttacgcatggagttgtggttctgctgtgcgtgaggatgggccaaaacctagtggtgttggaggtcatcggagattacaggggtgtgggggaggcagtgcaaaacaatggtaaccctgaagatttgcttgcataagaagaatagaaggtgaccaggaggctaatagggttcccagagcttgaggctagttgctaatgagatcaggtggacatgaggactttcaagaaagggacgcaaggaattgaccagaagtgtaattcgtggaatgacgctgatgtctcggaagttgaacgaagctagaagaagcaatcagagcagaggggtacctgatgggggggtcccagtttgggtcagaattgggtgcatcctcaatcctctaactggcatatggcataatgcgtcaagctgtgaagttgtttgagggccaga

SEQ ID NO: 633651 - DNA, 670 bp, Homo sapiens
ggctgctccgcccctctctgtcttctctgcaagtgggagtcagctctcctgtccaaagatcctcacacccctgataatgttcgcctgctccatagtttgtctctcatcttcccttccttggtcaagagtcaccttcacagctgactagatgccgtaccgaatattctgctagtggttgactgataatccgatacggcagatagctgatcagatgacgatgctctaccagtcatcttggcagtctcatgtcccgcttatccttcagcttgctctcttagcctgaagcattccaaaaccatgcgccaatctttcagagtggacgatctgacatcacgctaagccaacgttcatctaggtagcctcgagcgcgcatgcgcacaggtatgcggcggatcggcatggctatcctgaagcggcatggcgatatcggaacctgtcgatttgggcgaagcactccattcacttgcgattaatgccatgagaacccatgtgctctgataggcaactacgcctctatcgtccgtaccgctcagttgctggtgcttttgccctcgtcggcaacggccattgcgggtgcttcttttgttctgtactggtaagccttttcgtcatccctcttttgcccgatgtgaaagtgagccggtttcccaacctcaccataagttcctcc

SEQ ID NO: 633652 - DNA, 143 bp, Homo sapiens
ctctggctggatgatccactttaagtactccttgtcctggctcgatgatccactttaatactgcttgtactggctggatgagtccactttgaatactgctcgctctggctcggagtagatccagcatgcatagctccgaggaa

SEQ ID NO: 633653 - DNA, 1330 bp, Homo sapiens
gcagaggtgtggacgctgtgtatgaaaatgtctttcctccaggtacccaatgtttcttcaccatggggatgtggtccattggtgcaggagccctgggggctgctgccttggcaattgcgtagcttgccaactatagacgtagtatctgtacaagccccagaaagcgtgccctggagtacctggaggactatagaccatgaaaaatcacctggagacggaacctaaggatctttcaatagacaacatgtgtagctatgtggaaaatcaatgcgtagactgtgattattgcgccgttgccgtgcaggcccagcgctagtattccctctgctcgagagcgaagctgtcgcgtaatctgatcctccctgaacaacagcatgattgtgcacctggagcttggtgcgtcccgccatcgtaatgcgagatgcgtccaagggtaggacactcatcagcgtcacgtgacaggtggcaggcattatcgcaggtccttctatttctcaactagtggaccgaaatcatttcgcatggaattggataaaagcagaaacagagctttcctagtgggataccagtaaacagggcgtgcatagcattgcattgtgtctctcactgggagaattcttaatctcggtgtcgtgggggccagattgcttgcgttgaccaaaacctctccatgtccggacagcccgtggtaacacttgggaagtgcgtatcctcagtggtcaagaacccttggccgaacacgggaggcaaacgggctcttccaaattccccttatgaggcgaagttggacaccttctaattccggcctgcggcgtaagcgagtcattcctagcggcacaacacgcacctagtgtgaattaaattatgcactttccatgtggagagtaccgaccccgtaacattgacacagccaccaggcaagacttctgctgggaagccacgcaggcaaggattcatacaaccatcaaacctgtatgccatcgctcttacctgccgccaacggactggccttaacacacaattgctactcccaaaaatccgatcaagcgaaacatgtctggcgcgccttcccatttaggaatacgatcgacactcgcaatttccggtaggcttgaacacacaccttgacgcccaaggtcgttcacaggtgctatttaaaccgcaaaggggagagcatattcgcgccccgtgaatggatcacaattggggacatagcataatttggcgtaaacccgctaatcagtaagtattgccgtctatatagtgatcacagctgtgcgtgacaaaacacccccacatctatacataccgtgcgtaagcattacatgac

SEQ ID NO: 633654 - DNA, 332 bp, Homo sapiens
cgtccctagtatgcagactgcttcgaacttcatagctgtacaatatggttatgtttgtgctgacattacaatatatttccaatgatggaacaaaataatggagaaccctggtaaggacctggtacttttgcttctcgaggaactgtaaaccctcgacgtactgggaatcgctctctgctgatcttacctggaagctaagcctgtctccaccgcccgaggcctgcgccggttggctcccgccgcagttgcgtttgcttctggaccttgcctgcgggtgacggagtgcttggtaccgagcccgctcctttctgtacacctagcgctgcccgccc

SEQ ID NO: 633655 - DNA, 140 bp, Homo sapiens
taaaggaatatccatatagtaccaaaatgcttgctcgcagtatgtcaccatcacaaatggtagcatcaaccccaccatcatctagcagcagaaacatagcagctgcatcctatctggcagcaaagtcacggtatgacacc

SEQ ID NO: 633656 - DNA, 167 bp, Homo sapiens
tgtgaaagcacacctttactggcggctttacccgtcgaaaccattggatcggcgtcatcctgtaaaacacctaccatggacatggttttatgatgcaataacacagaacatccaggctctagtaactctttatcgacaaaggataagatagatacataataatcagg

SEQ ID NO: 633657 - DNA, 902 bp, Homo sapiens
  misc_feature (5)..(5): n is a, c, g, or t
  misc_feature (66)..(66): n is a, c, g, or t
  misc_feature (70)..(70): n is a, c, g, or t
  misc_feature (78)..(78): n is a, c, g, or t
  misc_feature (81)..(83): n is a, c, g, or t
  misc_feature (85)..(85): n is a, c, g, or t
  misc_feature (88)..(88): n is a, c, g, or t
  misc_feature (91)..(92): n is a, c, g, or t
  misc_feature (115)..(115): n is a, c, g, or t
  misc_feature (124)..(124): n is a, c, g, or t
  misc_feature (126)..(126): n is a, c, g, or t
  misc_feature (136)..(136): n is a, c, g, or t
  misc_feature (140)..(140): n is a, c, g, or t
  misc_feature (163)..(163): n is a, c, g, or t
  misc_feature (165)..(166): n is a, c, g, or t
  misc_feature (184)..(184): n is a, c, g, or t
  misc_feature (231)..(231): n is a, c, g, or t
  misc_feature (254)..(254): n is a, c, g, or t
  misc_feature (268)..(268): n is a, c, g, or t
  misc_feature (336)..(336): n is a, c, g, or t
  misc_feature (356)..(356): n is a, c, g, or t
  misc_feature (373)..(373): n is a, c, g, or t
  misc_feature (384)..(384): n is a, c, g, or t
  misc_feature (391)..(391): n is a, c, g, or t
  misc_feature (393)..(393): n is a, c, g, or t
  misc_feature (403)..(403): n is a, c, g, or t
  misc_feature (466)..(466): n is a, c, g, or t
  misc_feature (475)..(475): n is a, c, g, or t
  misc_feature (645)..(645): n is a, c, g, or t
  misc_feature (666)..(666): n is a, c, g, or t
  misc_feature (712)..(712): n is a, c, g, or t
  misc_feature (744)..(744): n is a, c, g, or t
  misc_feature (753)..(753): n is a, c, g, or t
  misc_feature (800)..(800): n is a, c, g, or t
  misc_feature (835)..(835): n is a, c, g, or t
gcaanccccagtacactcttcccctctcgtacccacagcaacgttacaatcaaaaaaaaataagtntcanggggaagnatnnnanggnaannggaaaagggatatgggtaaaaanaataaaatnanaaaagaaatntttnaaaaaaggtaattccactaaatnannaacttactaccctaaaantacaagttctcattttcgcttctaaaccctttcttcttcaccaaacncttcttcatcttcctcgtaatcnacctttccatcgtnataaccttcttcatcctcctcctcctctccactaacgtcctcctcttcaccttcctcctcctcaaccncgtcctcctcgtcttccacnacctgagcatctacatnaaactcctccncaaccanancctcctcctnaaaaaccaggccctccacgtagccctaagcatccgagtaaggggcctccttgtcgtcccggtnaaagccgtngaaaaaagtaaatagcgggaggagcttgaacacattttctcggtagttgttcaggttggttacctcgcaattaaaaaggtctaagcacttgaggttttctaactatttcagtagctctattgtactgaggtctttaattttgttgccacttgaatttagatgcgtgaggntcggacacttttctgccaatncttccaggccccctgagactctgttatcgcttagttcaagcttctnaagtttgtttaactttggtaagtttgcgattnaggtgaggnctacgttgattgttcttaagaattccagttcttcaaattcatctgtnagggcttcgagtttgccttcattcgaccgactgtngttcaggacaagttctttcacatcagagggcgtcctgttccgcagctctaaatgaattcgtctgccc

SEQ ID NO: 633658 - DNA, 874 bp, Homo sapiens
cctcctgtttacctcgctccaccgtattttggcccttttttacctaagcctcccccctatccgtgctcctcccgcggtggtatgtccccccctcttttaaccctttttccccttataccgctaatatgtgtagaccaacggctcttcctaaagtgcccgactaaacccacacgaccgtcttggtcaacaagtacaattttccccctccctaacaacacccccttctgcgttaaaattatcaccgctagtattgccctgctgcttaatactgactctgttccccccctccattaccccgctcacgatcttcggaacggtttctgtaatctctccccccctacgcgtcaacacccaaacttccctcggcctatttccccaccccgaactttctctggataatattttaaccctcccaaaattccggaaaagttcttcacccgtaaaatgatggcccacaaaccaccaacaaatagaagccttattataaccggttgacaccacaatacaccacccccgtgcctaatcttgcccccctctccatccccacgacttcatttaatataatgtcaccactaataataaggtacgccattgtttattattttcacggtccaaactatatagcaccgaaatgtatggcttaaacactcttttatggtaggggaaagaaaaagtaacactcactattcccacaaaagttttatttcaataaaaaataaaaactgctccttgccttctaacaaaaatgcggcccacataacatcataatttacattagccccgttcccccaactttacaaactttactaggtttctctttcttgtttatgaagaggccccaaacattttcaaaaaaaaagcaccccacaaaaca

SEQ ID NO: 633659 - DNA, 214 bp, Homo sapiens
gcacatgttcctgctgcatattcagcgttgccagtgtttcctgcgtgtcgagatcatgcttggcctgatctgcctcatatcgcgtcgatatatgatgcggatggtggcacccagatgtgccactgccggaaagacgcaaaacgacacgcgcaccgtcttcaaaatagatacggatgccctgatgttcgcttaccgaatggtcgatcggatcacg

SEQ ID NO: 633660 - DNA, 324 bp, Homo sapiens
  misc_feature (245)..(249): n is a, c, g, or t
  misc_feature (271)..(271): n is a, c, g, or t
  misc_feature (296)..(296): n is a, c, g, or t
ttttttttaaaaaaacccccctgtgaaacacccccaggcagggccttcaggaggtccccaaaaacacccattgttatccctgggagacgacagccccatggtcatttttgcccctaaaaagcttccagtgggccaaaatgtgggggtggaaaacggtgaaactaatggttccccccctgggtaggccaaggttttagcttttaccaaaaaaatttaaaaagtaaaaaccaagtaccaatgctttnnnnnaagagaaaaccccccccaaaantaaggactgttttctctaaattatnggcgtatttcttctactgaaaaaaaaaa

SEQ ID NO: 633661 - DNA, 843 bp, Homo sapiens
  misc_feature (52)..(52): n is a, c, g, or t
  misc_feature (63)..(63): n is a, c, g, or t
  misc_feature (83)..(83): n is a, c, g, or t
  misc_feature (94)..(94): n is a, c, g, or t
  misc_feature (108)..(108): n is a, c, g, or t
  misc_feature (125)..(125): n is a, c, g, or t
  misc_feature (175)..(175): n is a, c, g, or t
  misc_feature (184)..(184): n is a, c, g, or t
  misc_feature (214)..(214): n is a, c, g, or t
  misc_feature (236)..(236): n is a, c, g, or t
  misc_feature (251)..(251): n is a, c, g, or t
  misc_feature (267)..(272): n is a, c, g, or t
  misc_feature (275)..(275): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (298)..(299): n is a, c, g, or t
  misc_feature (303)..(303): n is a, c, g, or t
  misc_feature (307)..(307): n is a, c, g, or t
  misc_feature (309)..(309): n is a, c, g, or t
  misc_feature (324)..(324): n is a, c, g, or t
  misc_feature (338)..(338): n is a, c, g, or t
  misc_feature (364)..(364): n is a, c, g, or t
  misc_feature (381)..(382): n is a, c, g, or t
  misc_feature (399)..(399): n is a, c, g, or t
  misc_feature (452)..(452): n is a, c, g, or t
  misc_feature (458)..(458): n is a, c, g, or t
  misc_feature (467)..(467): n is a, c, g, or t
  misc_feature (492)..(495): n is a, c, g, or t
  misc_feature (500)..(500): n is a, c, g, or t
  misc_feature (503)..(503): n is a, c, g, or t
  misc_feature (527)..(527): n is a, c, g, or t
  misc_feature (543)..(543): n is a, c, g, or t
  misc_feature (566)..(566): n is a, c, g, or t
ttttattcaacttgtctcaattcagtctacaggtatcccctggccgcctccncccactcccanggagaccaaaagccttcatncatctcaagtngggggtttataaanggggaagggggggtagnaggttcatcattcaaaataaaacaaaataaaaaagtattgaaggcgaagnttataaaanattttgcattacataattttctcgaaagcnatgctatcacctcccctgtgtngacttgggagaggantgggccattctccttnnnnnnaantggggtggnttttngnttggctnnggtnttcntntaacatacgcatctnatatttggaatgtntattattatatatcaacaatgtgcantcaaagtcctcggccannttgtgaactttgggggntgctcgctccaaccggcgtgctgttaccttcatccgttccagtttttaaatcntgagtnaagccaatnaaaaaaaaaaaaacctttttttttnnnngtggncgntttaggccttgcctttctcatctngttttctgcgcaagtnaggttttgtcaagaaagggtgtnacgcaactaagtcatagtccgcctagaagcatttgcggtggacgatggaggggccggactcgtcatactcctgcttgctgatccacatctgctggaaggtggacagcgaggccaggatggagccgccgatccacacggagtacttgcgctcaggaggagcaatgatcttgatcttcattgtgctgggtgccagggcagtgatctccttctgcatcctgtcggcaatgccagggtacatggtggtgccgccagacagcactgtgttggcgtacaggtc

SEQ ID NO: 633662 - DNA, 145 bp, Homo sapiens
gattgtgactgacgaacatggtttgcttctgaagctacgagcctatgggccatctggattctcgtggaatttagagaaggactgcagtagacatgctgagaacgacatgactggctcgggaaactctgaggatctgggatggaaa

SEQ ID NO: 633663 - DNA, 967 bp, Homo sapiens
agcgggatcatctgtgtgagcaacaggttgctggattgtgtccgtacatggacatttcttatgccatctgtggctcttaccagatagtgaagtcccctatagaggatcttgtcccccataataaatgttcgtcggaggtttggtttatccgagacagtcttgtctctgttgcacatgctggagtacagtgcagtaccgattcttttctacaatacaacgttatagattgtcgatataacaatatgcaaaagtggcgcgggcttggaaggctcatgcctgtgatcccagcctctttgggagcccgaggtagggggctcacctgaggtcagggagttaaaagaccagcctggccaacatggtaaaacccccgactctactaaaaatacaaaagttagccaggtgtcgtgatgggtgcctgtaatcccagctacttgggaggctgaggcaggagaatcacttgaacccgggaggcggaagttgcagtgagccgagatcgcaccattgcactccagcctgggcgacagagccagactgtctcaaaaataaattaacaccacaataacaatacaataaatagaacacaacaggacaaagaacattattaaactgtcttagttttgattcttggtttaatccagttcaaactggtctaagtcaaactaaaggaatttataattaggacacaagaggtttgtgtttttgcttttgtctttttcacaggactccggagtggaccttaccacggccaggctctccccctgtcaagcatccgaacgcccctttagaaaaggcaaggcagcacctctctggttttcttgccttctgctcttctctgtgcttcctgtttcctttctttcagggacctctgctttgcccaaagggtggcttttccacccgaagaactctgtggggggcaggttggttttcccccaatttttgtgcctgggttaaacgccccccgttcttc

SEQ ID NO: 633664 - DNA, 137 bp, Homo sapiens
  misc_feature (6)..(6): n is a, c, g, or t
  misc_feature (113)..(113): n is a, c, g, or t
ccatgnttgggctacccatggctggccaaggacaggcttcttagaatgtgagttgggctggtttccgcccagccctcaggtccaggatgcccaacatggcagtgatgcccaancatgggtgtgactgcccaacatgg

SEQ ID NO: 633665 - DNA, 391 bp, Homo sapiens
  misc_feature (142)..(142): n is a, c, g, or t
ccgggggggggtctctgttatacacccttttcccccgcgaaaatttgggttaaaaccaaagggggggggggggaatcccgggccccccccgggggggccccccccaatttttttcccccctgttccctgggggggccctttntggggggggcccccctccccaaaattacccccggttttaaggggttcccccccccggccccctttgggtgggggggccctttggggggccccaaaatttaaaatttttttggggccccccccaggaaaacctttggcgggggggccccccccctggcccccccgggggggggcccccccccccccgggggggtttttttaaacctttttttttttttttttttcaaaaaaggtttaaccccccccccca

SEQ ID NO: 633666 - DNA, 87 bp, Homo sapiens
tggctggggtcgcgtgcttgggaaaagctgccgacgcagtgaatggtgcgacacgtcctgggctccctgggtacggacgcagcggcc

SEQ ID NO: 633667 - DNA, 507 bp, Homo sapiens
gcctcgggggaagatatgtagcgatccaatggaacgtggagatcaacgttgtgttttcttcgcgcccacccgaagttgaagggaggtggcgcggcgggtctcagccgccgtcccggacggcgaggcgccgggaccgcggccggtcggagaccgcgggccacggagtgcggaggggctctctgggaggccacggctctaggagcgggccgggaaatggagcgtggccatgggacggtggtggacgctagggacacgcacccggaagccgccggagaatccgtcgagacagaccatgtgggcccgatggccacggaggattgaagccggggacaggcatgggagtcaggctccgcggctccgggtagggcctcgcgcactgagagtgcgggggggaccgcggtgcctcaagaagtcataaggcgtggggaggaacgcgaacgaccgcaagcaggcgcgtgggtcgtcgcggacaaggaagtgcaggcattgtctcaagcaagggattcg

SEQ ID NO: 633668 - DNA, 517 bp, Homo sapiens
  misc_feature (142)..(142): n is a, c, g, or t
  misc_feature (149)..(149): n is a, c, g, or t
tctccttgaagtgattctcaaagcctgattctcagcccagctgcattggcatcacgtatgggcctgttagaaatgcagattcatgagccatgttctactgagtcagcatctctaagaatggggcccaggaaactgggtttcnttgcttnttttttcagagatagggtcttgctctattgcccaggctggagtgcagtggcctcccaaaattctgggactacaggtgtgagccaccatgcccagactgttggccctcttaagtctttctcaatctagagcaaatcatttcttttttttcccaacaataagtatttaatctagcacgttctaggtactgttgtttaccatgaaataaatttagctaaggagtcaaattcagaaaatgtaataatagtttttttttgttttttaagtgtaaggcattataattgaagtagtcaaaaaaggtttaattagggggattgagtgttaagagtagaagtaatcatgaactgggtattgtataaaattttttaaa

SEQ ID NO: 633669 - DNA, 1003 bp, Homo sapiens
gcaagcgcgggatcccactgggtagagccttggaccgaatgagtttgcttagtcctatccgatccgatggcccggacgtaccttaagtcgtgactggggcgccgacaggtgctagacccgagacaagagctctcttgtggaccagtactaccagaggtggctgactaataaacgaaccacgagaagtagggtctgaatatcggatgactagcagaagctttcaggcgatgcgtcctcgtcgcgaaacgtggttgagctggtgcccgagttggagcaacttgtcgtctccgggaccgagagacaggccagtgagcctagcccttggttcacgaggtggggataacgttgtctgaaggttcgtatttccaagggacagaaggaagtcattaggacaacatttggttaatacgtgcattcctggttggagatgctttcttgggatttaatcttatggcagcatacccgcaatgcttcacatgcattggaggttgcccatcacccgaagacacaacggaatgacagggcccccagacaccgcaccgttcaggggactgatccaataccgtttgcggccaaacatgtcggtggaagaacccccgttgttaggtacctagcaaccacacttagaacagaagggtgtaaaggtggggtagcacacgggcgcgtggtaattcacgcaaagggtagcttctgtgggacgggcttggagcacttgggcaacgaaatcacgcatttgaagcccatggggaagaggatacggacagcatggccaactaaggcagccgaaaaggaaatcagagggcccagccggggccaacagtcacaaggacccatgcggcacgcaccgagccggcggaagaccgcccgccaatactcaagaccacaacgactagaaagcgaagaagagggcaatggggctgcaatggcagcccactgcgccgtataggcaatcatgtcggaaaaacataaagcccacacaccagaacaacagtggccataaccg

SEQ ID NO: 633670 - DNA, 166 bp, Homo sapiens
  misc_feature (48)..(48): n is a, c, g, or t
  misc_feature (102)..(102): n is a, c, g, or t
  misc_feature (135)..(135): n is a, c, g, or t
cggttcccagcagcactggctgatgctgccccagctgggggctgaggnggaggggacaggagaagggaccattggctccaccctgaggaccaggaaggagtntccagagggcgatggggtttgaggtcgaggagnttgggacctgtgacttggtttgctccaaagg

SEQ ID NO: 633671 - DNA, 373 bp, Homo sapiens
agggtgagtggagcgtggcggagcagctggccagcttcgctgcgagatggagcagcagaaccaggactacaccatcctgctagatgtgaatggcgcggctggagcaggagattgccacctaccgccgcctgctggagggagaggatgcccacctgactcagtacaagaaagaacctggtgaccacccgtcaggtgcgtaccattgtggactagtgtccaggatggcaaggtcatctcctccctgctgatgcagtgtccaccagaccacccgctgaggactcagctacccctgtgcctggccacccagtgaggcagtggagtgcatgcctgccccatctgccccaaagtctccgtcctctccagcaggtacgca

SEQ ID NO: 633672 - DNA, 403 bp, Homo sapiens
tctcttggtaacactcgtttttatataaatatccgcaagtcttgttacaaaaaaagccccaccggggaaaaaggtcaacgttggggtttggttaaatggaccccgtgcctttcatagggtggggccccagcctgtggaggcgcctgtgcgtgcttgggagaagggctggggttgctgccgttgaggctgccgaaaaagctgcctgtgtcgcccacccctgtgggccagaccccctttcttgggtgtgtggtacattggtgacctttcttcgtggccacccttatagccgtggggcagggtttgggaagaacaggggttcaaggaaagcaggggcccagagagtccgtggggcgcacttgtggaaattggggtagaaggggacttgagccagtaaagaggtaga

SEQ ID NO: 633673 - DNA, 128 bp, Homo sapiens
tgctgggattacaggcgtgagccactgtgcccagccatttttttatgagtacaagttgagtgccccttgatccaaaatgctggggaccagaaatatttcagattttggattttttttttcagattttg

SEQ ID NO: 633674 - DNA, 751 bp, Homo sapiens
gctgagacagacggtaactcctggggatcttatttctagtatggataagaaacgagaaaaggttttcccccagatgttatatcacaggagttctgagaggcggtgcacctcaagatttacgccccggtctttcccttgtgggttttaagcccacctgcacgagcttgtcccgaggtcaaacgcccacaggaggtgctttttgtgctaccaccagtttttcgcccacatgggcctaagttttctcgaggggatccctcggagaaaccacagaagagagaaaagagggagtcccccgcggaatgtaaccttcggaatgaaggaggcctcgggtctatatctatgggaaaattcgtttgttctcggtcgtggctcatatattggctcggtcccacaacacacagcctgtagacgtgtcatagcccccctgcgcctctttcttctcgtgaaggtgttcttggcgacccacactgagagcacgacttgtccacactcacgtggagcaccacacgtgtagttactggaggtcgctaaatgtgagtgaagccaccccacctcgtaccctcgggtgaggcacaaagtcaagatgttttgaggagacccctcttttccttcgaatttgaagaagttttaaatggacccctatatttttctttaaagctttcctcttttttggaaatttttttttttttaaaatccttccccaaaatttccaatatttggggtaattttaggaaaacccatttttttttta

SEQ ID NO: 633675 - DNA, 242 bp, Homo sapiens
tctgactttgagtatcccgggagtcagagagaaagcgctgcaggattccgcagaaagcaccgggaggagtgatgatgtgcatgttgcttttgcacctacggggtgctctgattccagctcccccctagatgagctgcagcccccctgagagagctctgcacgtcacttagtcaccaggtctccagcctccagtgcccatttccgtccagcctctccccgctctggatctttctctctccact

SEQ ID NO: 633676 - DNA, 390 bp, Homo sapiens
ctgctccgcccctctctgcttccagtccctgcaattcacctgaaccttttaaaacataaatcatatcacgggttttttctttgacacgaagtctttctcttgctcaggctggagtgcagagccatgatcttggctcactgcaatgtccacctcctgggttgaagcgattctcctacctctgtctcccgggttcaagcaattctcccatctcagcctcctgagcagctgggattacaggcacacaccaccacacctggcccagctaattcttttttgtatttttagtagagacggggtttcaccatgttgcccaggctggtctcgaactcctgagctcaggtgatccacccgtcttggccttccaaagtgctggattacaggcataagcca

SEQ ID NO: 633677 - DNA, 692 bp, Homo sapiens
gcgacatgtgaccccgcacctagcccgtgcccgcacctgccctccctgggcagtactgggtgaccttccctgggggacggggagggaggaggcagctgactccttggacagaggcctgggccctcagtggactgccgtgctcccacagccgtgggctgacgtcagaggccgaggcaggaactgacgtgaggccccatggtcactgggtctcagcgatgggtcctgggggcctcgtgttcatcaagacacccctcatgcccgagctcaccacagtcttcagtcaccaggaaaggcctaggacttggcgtccccgcgatcactcagaactcagcaagccagtttgcctcaacgtccccccctttgcctcggtctggggacagagggtggttgggggacatgggtgctagaggtggaagtaccgccagacagtggtatgagttaccgcattggcgagtacctagagctcaccagcgggcatataaatggttggtccggcccgttggggtacagcttgattgtagaatactgaacgaagctttggccgaaagtcggtcgcgtcttggcattctatgcgggcgttaaaggtaaaggataattgtcgtcaagtattttgaaaggacacgcattgatcactaacgtggaaaagggcacaatggatgggtaggtggctgataataacgtcagggagtaag

SEQ ID NO: 633678 - DNA, 330 bp, Homo sapiens
gggaaacttagtgttgatccatggccttccagaaggttcttagctgatcatattttgaaggccgtgttttaccaagagttgcttgtaaagtgttgcgtgcacagttaaggcagaaggttggttagtcggcaagagatctttctttaggtagtgtgtgcctctctcgtgtgtgcatactctagatatatagaggatatctctagagagagagatctgactctgctcttgagagatatataagagagagttgtccatacacccgcgatgtgtgggaatcacaagctcgagagcccacggttatacacggtcactatggggattgtgtggtac

SEQ ID NO: 633679 - DNA, 98 bp, Homo sapiens
  misc_feature (30)..(30): n is a, c, g, or t
  misc_feature (53)..(53): n is a, c, g, or t
tcttcaactcctggggcttatgccatcctnccgcctcagcctctcaaaaagtnctgagattacaggtgtgagacaccatacccagctatatattttat

SEQ ID NO: 633680 - DNA, 541 bp, Homo sapiens
  misc_feature (442)..(442): n is a, c, g, or t
atactagtgatgcgagtctgctcatctgcagagacatgattccccaggatggccctctgtacactctgcccctcgagtcagcgtttggtagacctgccctgtcgcactggtgcccccagagtcaacgccatccccgctgcctctggagaccccttgtatctccccatgacgcccctcattggtggtagacacctggctataggcctggatccgccctgttgtgtgagaggagaaccggatgtagtagaggctgaagggtttgggaaaccaccatttgttattctgtgcttcccctcctggcctggaagctggcccacttcatggggtgactcacggccctgcctctgtgccccaaggcagcctccgccctcctgtaaacaggcccacagggctccaaggggaggacatttgtgggtaaatcaccctcacatccccccagcanccacagctcatctggaaatcagctttccgaagcttccacatgtgtgccctccccctctctccactgcagacacctgcacaggctgagctggcctggtca

SEQ ID NO: 633681 - DNA, 172 bp, Homo sapiens
ggtattgagttgccaccattctccatgataatgtacgttgcggagtaaggtgctcgtctgaccccataaactgaatgaggcagaaacacacacacacacacacacacgcacgcacgcacatacacacacacacacacacacacacacgcacgcgtgacacaatctctacgag

SEQ ID NO: 633682 - DNA, 798 bp, Homo sapiens
ggaaaatgaactgtgcagagagtcatacttgttagttgtgggtgtgggcatagggagtgggctgttggggaatgggagaaaatgaataggaatgtgtgatctgaatgtgcctgagcaggtctatcagtgcatggttggaggagatatgcgcgttaaaaggaatgatagggagaagaggataaataccaggtgatcaaactcaatcgagggaggtagtaccaataacatgtggactgtgcactgtgtccaggtgctactctagccttggctatgatctacttaaccacaccaataacagatctattgcagattggctcgggacgtcccctgacaccgatgtatttgtcgtgacgttgggtcgaagccagaattatctcttgcgtctaggacacttgctcgatgcctgattcgtgggatgatatttgaccaaattccaaggtgggttgacagcaatgtacctcagattataagagaaaatagtatctctctcagtgaaatcgaattgccgtgctcagaggattgcatttggaaactttgtcccaagcacatgtctacataattgcaggagcctgcttgtctctgggttttcgatttgctggctcagaaaacttatcagcatttaacgtgtttgcataaatttcgccaacagatttatgacttatttgtccgcacctaagggttgtgtacagggcctcataacctaaaaattgtctgaggtggtgcaggtggcctcgccaggtcactgtggccaggaacccaaagggttgcgggtttggggtctaacctggagagggggga

SEQ ID NO: 633683 - DNA, 288 bp, Homo sapiens
ccaaccccaacaccaccttgcacacatgaccccaacccctgacacccatcaccaccaccaccactggtgaccccaaccccaacacccatcctgtgcacactgggcccaacatctgacaccccatcaccacacaactactacttgtgaccccataccccaatcaccaacctggcacacctgatgtacaaccctagacacccgatcacctaccaacactactggtgaccccaaaccccaaacacccacctggcacacatgacccgcaacatctgacacccgatcatgcac

SEQ ID NO: 633684 - DNA, 391 bp, Homo sapiens
ctcgacccacgcgtccgacaaaagagctagaattcaaaagaaaacaacatttagcctatttatttatttgtttattattttttgagagggagtcttgctctgttgcccaggctggaatgcagtggtgccatctcggctcactgcaacctctgcctcccgggtttaagcgattctcctgcctcagcctcccaagtagctgggactacagttacatgccaccacgcctggctaattttttgtatttttggtagggacggggtttcaccatgttgatcaggcttgtcttgaacacctgaccttgtgatccacccacctcagcctccggagtgctgggattacaggtgtgagccactgcgctcagccgccctttttaatactatgggtattttag

SEQ ID NO: 633685 - DNA, 174 bp, Homo sapiens
attatgaactacctggactctacgttcagcaacttgcgttagtgcaagcaacaaaggcctgctggggaatgtattagccactaaattccccaagtatgccaacattacaaaaaagataggtttttcatcataattgaatttccacataacctccccatatcacagagtattata

SEQ ID NO: 633686 - DNA, 324 bp, Homo sapiens
tgcaaggatcccctatctcctctgcccctgcacggctcggtcccaggcaatctgtctgcccaccacacctttctcctcttgcccaccacgctccagccccacagtcctctttctgcttctttcccagcctctgggcttttgcacaggctgttccctctgcctgaacaccctccactgggctgagaacaactctctgaggcctctctcagctgttgcttcctttggaacagccgctgctgctgtccctctcccagctccaagacctgctgagcctcctgtctttttcagttcccatgcccccagcacttcttcttggcctctagc

SEQ ID NO: 633687 - DNA, 274 bp, Homo sapiens
taaagaagaagcagacttctgcaatatcagtgttaatgactcctcttcatcctcagaaaatcgatggctgtgacctcccgagtggtgcagtggtctaaggcactgcatcacagtgctagctgcgtcactacagatcatggttcaatcccgggttgggtagctgccggcccgagaccaggaaacccatgtggcggtgcccagcatcgtccgggtttgagggtttgaccggccgggatgtccttgtcccattgtgctctagcgactccgtcgacgc

SEQ ID NO: 633688 - DNA, 314 bp, Homo sapiens
ccagtgaatcgagctcagtaccatctcgtgacggcgattatcactagttcttacaggttttgggataggcggtggagttagggacaatgttttgcgggcaggggatggatctcacaaagtacattctcaagggtggggagaatgacaaagaaccttcttaagggtgggggagattgcaaagtacattgatcagctagggtggggcagaaacaaatcacaatggtggaatgtcatcagttaaggctcttttcacttattttgtggatcttcagttgcttcaggccatctggatgtataatcgccggtcacgagat

SEQ ID NO: 633689 - DNA, 249 bp, Homo sapiens
gctgtactgactgtgcctgtgtacaatgatcacatgactctgagtgacaaggccctcatgaactggtcctgagagcagtgttcgtgcggtgagttcctcgcagtggcctggtcagagctacactattgagaaccatgaacactggaggccgacccctggccacgtaccgtgtgccactggcaccatgatccaatggacttgctgaccatggcgtggggactcctctatgacgtcgaccgtgcatgtgcg

SEQ ID NO: 633690 - DNA, 162 bp, Homo sapiens
gaattccgggatgcagcaagtttaatacctgaaggttaacataaatgacaacaggacacagatgcaatgctacagtcaaatgtggttgatcggatggaagggggacgagggacactggatatactacacggacaccgtgagtgagtcctctgtgcgctgaga

SEQ ID NO: 633691 - DNA, 161 bp, Homo sapiens
cggtatgcatttaggtaaaaggcaaagtctctattcagaaaaaaaaaaataggctgggcgtggtggcttacgcctatatccctgcactttgggaggccaagacgggtggatcaggtggtcaggagttcgagaccaccctggccaacacagtgaaaccccat

SEQ ID NO: 633692 - DNA, 803 bp, Homo sapiens
ccagtcggtgcccctcccgctccagccatgctctccggcctcggccgggctgccagcgctgctctccgccgcagcttcagtcgacctcgcgcccttacgcgttcctagttgctgttgacgtatgctacatctccttgcagctagtcctggtgtagagttggtcgcgctgaataaacagaaagtcgtatgactgtcctgatacttccctatacgctataggatcgagagatcccgagcgctgatgaagaaccctggtgctcagggatttacagatgcattttggcacagaggacttacgatactatcagcgcgttctggacgcgtgaagagaggctatccgtctctaactcgttgttggaaggagtctcttcctgactgtgaggcgagactgagtcgctgccggccagggtgtctcacacagctgcattgaacttggtcccgtcgagccagcgttgaagcctaggagtcgctaaggctatcttgtgtagccattcttctcagaagtggtgcgttcttaagaacgtctgctagctgtgtctacgaagtcaccagaaatgctaataatataacacatgacgtctgggttcatttgaaggaagcttatagactgcgggggggggggtccggcgatttgaaccaggtggactctatgttaacccgtattttgagaagagcccgaatcatgggagactaaagaaagaccagatctgtatgcagtgaaagcaccactggaaggaagaagtcgagggagtgaaagaacgtgtgactggaccaattgcatgctgctcttagccccgggatag

SEQ ID NO: 633693 - DNA, 382 bp, Homo sapiens
  misc_feature (135)..(135): n is a, c, g, or t
  misc_feature (146)..(146): n is a, c, g, or t
  misc_feature (153)..(153): n is a, c, g, or t
  misc_feature (227)..(227): n is a, c, g, or t
  misc_feature (267)..(267): n is a, c, g, or t
  misc_feature (330)..(330): n is a, c, g, or t
  misc_feature (340)..(340): n is a, c, g, or t
gggcagcaagggccctggcgaggacttccgcatggccaccctctacagccgaacccagacccccaggggtgagttaaaggagaaaattcgccgcctttctgcaagggcccaggggcttcacaggaggaataccanttgtcttcctngccccanaaccgtataagtgcatgacaggaacaatagactcccccaggggctgaaggctgggatcccggccaaagccaagntgacccccacgctctgagatgtctcgtgctctagttcctntccccgaagcccctagccccggcgtccccgcgcaaagcgaacccctgcccatctaaagaattnttctgtgcgncaataagactccggagagcaaagacagatagaaaagaaaaaa

SEQ ID NO: 633694 - DNA, 201 bp, Homo sapiens
  misc_feature (149)..(149): n is a, c, g, or t
  misc_feature (187)..(187): n is a, c, g, or t
ggtgaccagcgtttaaatcctgccccctggccgggcagcctctcagtttcctcacttgtatcatggggcatgatcacagttccaggcctccttgggcctttgagggaattaggggcagaagtgggtaaaggcatctggggcccttgtgncggcagggcttcagtggaaccccaaaacgggcggtggntattaatgggggga

SEQ ID NO: 633695 - DNA, 1168 bp, Homo sapiens
tttttttttcaaaaacacttatttaataaacaactccaaagagcaaggggaagccaaatattatttatttattaatatggaagggaccagagaaactggatttggtggaaataatttgctacctttcactaaactattctcttaaatattggctcacctatgaagatttggtggcaattctatgtggcagagcaatgtgggtatgaaagtctggtctggaggggaaaacacaccactataatatgggggcttttggcctggctttcctaattatataaagggagaactagaaaggaaagggcatgggcaccaaataattcaaactctgtatgactaagaaaacaatcggtaacacacacaggggaccaacaacaaaaaaatctcgaggaaacctattttgaaaaactcttggtcagaaacaagcagggagatttatgcccacaatttttgacctattataacctcataaagtttccccataagaatggttccgcctccttacatgtgaccacccaagtgcccccccaattttttcagggttcaccatgtgattaagaatacgggtcttatctcaattaaaaatattttcaatttcaaaaaaaccaaaagcaaaaagagtttaggggaagtctaggggtgggccaaagagaaaagaaaaaattatttttttgaaatgattatattattagtgctagggggttgtggtggcgcaacttttttgttcagagaaaaataatttcccaattatttaacaggtttaagagaaaagttgactagtatgatatacactaataatgtggtatgtattacaaagattaggggaggaaatggtgggggtaaattattcaggtaaaatttgtgagtcctaagaaataacttggagggtaaaggggtatgaaatgggcaccttatccatggccataaaggtacaacgtctccccttgtaacgcggaatacactgagtaaaatttcggacaattttcccaccccccgggtaaaagggggacctctgaccctaaaaaagtccctattcgaaaagaagagactacatactataccttttgaacacacaagattctccgctaataaacataaagtttctatcaatcctggaaaaagaactaatgttagttgagaaaacctgactccaccgtaaacatttaacatg

SEQ ID NO: 633696 - DNA, 506 bp, Homo sapiens
agaggcactgctgaaccctggcaccgcgggcactgggagagtcaagctcatgggggtttcccggagaatcctgtgtgatctgagtagaaaccctgctgcttccacccttctagccctcagcttgtcaggagctgacccgttcagcttttccacccaaccagagctctgtcctgtgtgcagagagccacaacacccaaatccacagcctggctgacgggcctgccagcgttgggaaaagccactgataggttcgcatgaagtggaactggaccctgcagaagtttccaaaagctgccctgcgggtgacaggctgtccgggccccacatacctctgtctgtccgagggtgagtagcacaggacagcactcttccatctgtgcacggccgggaactgatgggggtcgacgtctgcacattcaagagcggccaaaacatcctgatcgagttttgatggctcctctctagaaagcacaataaaagaagcaaaaacatctttggtaaaaaca

SEQ ID NO: 633697 - DNA, 498 bp, Homo sapiens
aagactgctgtgtgctgggaacaggacctccatctggaagtccactctcgactaccctgtcaccaagcttagaggcagatcccaaggatggcgaggggtgtcccatgtgccgtctgcttccgtctcgaggcaaggaggattcgcagacttcccgggatgaggggagagcagtgtacaggcagggttgggccaggaggcctgggctgctgaggcgggataacggtggttgtggagggcactgtgctgtccccagctccgtctcgaggggcctggattccccactggatggcatagggccgctcacaggtgcttcacaattggtggctctcattagtctgctactgggtaagctgtggcctcagggagtgagacagacaccataggccatattgtgttggatgaatcttacccatcaaaatgtatcctggataaaagcagtcatctagctacaagtactatcttgattctatccatgggccgtcaatggactgtagccca

SEQ ID NO: 633698 - DNA, 293 bp, Homo sapiens
  misc_feature (253)..(253): n is a, c, g, or t
gaaagtatgacggtattgtcggtttcaggcttgaaactgccaggcgcctattgcttgacctctgtttaaatgagggacttcaagactagacagcatggttcttttcagtttatttgcatgaatggagttacactaagtccaagttaaaatgcggaccccaatatggttacattgatacaatgctgtgaggtttttaaaccctgtgacaaggggagagagagggaaattctacatcatttgcaagtgaagtccntcactgtaatgcttcgatgtgagccacaatgccacgtgtc

SEQ ID NO: 633699 - DNA, 477 bp, Homo sapiens
  misc_feature (19)..(19): n is a, c, g, or t
  misc_feature (60)..(60): n is a, c, g, or t
  misc_feature (73)..(73): n is a, c, g, or t
  misc_feature (246)..(246): n is a, c, g, or t
  misc_feature (250)..(250): n is a, c, g, or t
  misc_feature (282)..(282): n is a, c, g, or t
  misc_feature (330)..(330): n is a, c, g, or t
  misc_feature (360)..(360): n is a, c, g, or t
  misc_feature (395)..(395): n is a, c, g, or t
  misc_feature (451)..(451): n is a, c, g, or t
ctccgtatgaactgtgccntgtcttaggagaattgcttcatacaaaagtggattacaagntaccctgaagaanggctgacaaggcctgtgagccaggagtgactatgtgtacaagacccgactggtcaaggttagctgccaatactttacgagtacatcatgccattgagcagaccatcaagtcagctcggatgaggtgcaggttggacagcagcgcacgttatcagcccatcaagtgcagagaancctnagctgagagaagaacactacctcatgtggggntctcctccgatttctgggagagaagcccaacctcagctcatcatcggnaggacacttgggtgagcactggccgagagncgaatccaagacgaagagaccagaaacaatccagncctcgggccttaccgagagcatggttgtctttgtgcccaactgccacacccccatnccccactccagataaagccccaccca

SEQ ID NO: 633700 - DNA, 188 bp, Homo sapiens
catggtatctgtcagacaagacccaggttcaacatttgggatggtgctagagcatggcaactaccatctgtgattatataacgcttaagtcaaatcccgcagcgaagatcgcagccccgagctcggtggctcgaagccggtccccctgtccgcgcggccccccccctcacggccggcgcgggagggcg

SEQ ID NO: 633701 - DNA, 926 bp, Homo sapiens
cgaaaaataaaaaacaagaaactaaatcatatcaccagagaaaattaccttcactaatgaaagacaggaatgaaagaaggaagagaagaccccaaaacaaccagaaaacaaataacaaaatggcaggagtaagtccttacttatcaataataacattgagtgtcagtagactaaacttttcaatcaaaagatagagtggatgaatggatgaaagaacaagacccatccaggtgtggtggctcacgcctgtaatcccagcagtttgggaggccaaggcaggcagatcatgaggtcaagagctagagaccatcctggcaaacatggtgaaaccctgtctctactaaaaatacaaaaattagcagggtgtggtggtgcgcacctgtagtcccagctactcaggaggctgaggcaggagaatcacttgaacccgggaggcagaggttgcagtgagccgagatggtgccactgcactccagtctggtgacagagcaagactccagctcaaaaataaataaataaataaataaataaaataacaataaaagacccattgctctgttgcctacaggaaacactcttctcccataaagacacatgtaggctggaagtggtgtctcactcctataatcccaggcacttggggaaggcagaagggcgggttgggtttacctggaagggtccagagaggtcaaagaaacaagcctggcccaatattgggtagtaacccggaatctctactagaaataccaaacattccgaccggcaagagtggcgggccccagtgaatcccagtaattcccactgaaacccctttcagtatcagaaacaactggtggaccaaaggattatccaaaggcacacttaatgcgaaataaacacaagtagagcaatggtacactataagaggaaaatcacaaatacaaaga

SEQ ID NO: 633702 - DNA, 160 bp, Homo sapiens
  misc_feature (2)..(2): n is a, c, g, or t
  misc_feature (32)..(32): n is a, c, g, or t
  misc_feature (45)..(45): n is a, c, g, or t
cnccgcccctcctacagctgtactccctctgnctttgcccaaagnctctcctcctcaccccacctggaggccaggggagtggagagagctcctgatgtcttagttccacagtaaggttgcctgtgtacagccccgttcaataaatatggcatgaaacctg

SEQ ID NO: 633703 - DNA, 1799 bp, Homo sapiens
cccaccccattcctccccacactcatcgcccttaccacgcatacacctacctactctccccttccataaccaacattagtactacaagggcgagataggcagcgacctacgagtgcccaccgggccgcacgcacgcgccacgcgcacgcaaccgcgcgcgcgctccaagccccgcccacacccagctcacgcatcaatcagagacgtatcaatactcatccacgagtacacatcatcaacaacggcacatataacaccatgcaaacacaccaccgcactacacacacacccacgcacaccttcttcacatacctcaacccacacacgccacacaaacagacaatgagcgtccgccacacgcatgagcgatacaccaacggctagagcgcagcccagaggcacagacacagcacgtgcaacgatagctacaggtgagcacccgcgacgcctgagccacattgctagcagtataccagggaagcccagtaccctgcaccaggtcaaggtgatgagctggtgcacgctgaggtatggagaactgagcggtaaatagtccgatagcgcgctatttcatagctagccgagccagcacatatcctgcgcctccagggggtcacatatgagagcgcgcgcgcgcacgacagtgggacgcaaatcactacgaaggtgagcatacatcactgtcctcgggtagcgcaacgtactacagccacacgaacactgtacccacgcctcgagacacagcgtcatcaacactacggaagctcaaagcagttctccgagcagggcgcggcagagtgccgcgctcgagagtggaagtgacgagaaaggtgtgatcgacacaacacgacagcgaggtgagacgaggaggagcgactaaccgaggacaagaactaggcttcgtcgcgacgagcgcacggcgaagtcgtcgaacgagctcaacgcaatcacaccaaaaccgaacaccacgcgagagaacacccaccagtgcagcaagctggaaaccccgtccacgtcgaaaggacaaataacgtgctacgcaatgagtcgtgattcacacaaggcaacccagacgaagaggaaacacaggtcgcggcccacaactatgcgactacgcgcaccaccactgccacacaagacgccgaccagcgaacatacggcgacagacaaggagacaatccaagcggagacgacgcgggcggagacatctgatcactgactctaccaccgcatgggagctgcagcatctatcacggaggaagaagaaaccgatccgccaaactagctaagatagaaactacaccaacatctcgaatgtcatatcctgaccgacgaccgactgacccgaccacggcgagacagtgtagccccgagaccatgcgtgtcacacgactccaaacacagcggcacgctgcagccacagcaagcgccgggcgtgcgtctccacgcagctaacaacgtggactatcatacatcagctcatccttcatgcttacatctactacacattctcatcaactctatacatcgttcgatgttgtctgctcacatgcttccccacaccactacttcctcttatctgtctcagcctttatatgttgttaccaccacctcttagcttgctatcatcttcatcaattgctgctctctaacatctttaccatcccgctgtcgcatgcttgaccactacattgaccttctttctcatacacactgtcttcttgtgtatctcacttacttagctagacctctgatcactagatgtgttatccaatctacattctgttcgtgtcaaataa

SEQ ID NO: 633704 - DNA, 203 bp, Homo sapiens
  misc_feature (61)..(61): n is a, c, g, or t
ctcatgcagtattggtcatgcctgtctcggaaataacccgatagtgcagattgcggactgncttgatgcgttaatcagacttggagcggcagtcgcattgggctgatgaataagccctttatagccatctccgttcgtccgaggcttagcagtataaacccgcatgaccatgaaaatgcggtcttttacttcttcttggagag

SEQ ID NO: 633705 - DNA, 147 bp, Homo sapiens
tcttgtaggacgtactgggatgaggaacgtcattgggatgaggaacgtcactgggatgaggaacgtcactgggatgaggaacgtcagtgtggatgaggaacgtcactgggatgaggaacgtcactggtaataaagctttggaatggg

SEQ ID NO: 633706 - DNA, 133 bp, Homo sapiens
ccagcagcgcgtaaggcggcaccggggccatggctccctgggcggaggcgagcactcgcgcatgaacccgctgcgcgcggtgtggctcacgctgaccgccgccttcctgctgaccctactgctgcagctcctg

SEQ ID NO: 633707 - DNA, 154 bp, Homo sapiens
gaaggacgaacatagctcccaattctcacgggaggagtgtcgatttgcaaccatttgagaaaacgccacagacttctcactagtatcagaaatacaacatatgatcttcactaaaacatttcatcagcatttactcttcttgttcgttccattt

SEQ ID NO: 633708 - DNA, 927 bp, Homo sapiens
taaaggcccccaggaaatttgggggtaaaaaggggaaaaaggggggaaaaaaaaaaagaggggggggcaaaaaaaaggggggctttgggcacaatgggggaaaaggggttcgggggggccccccatgtggttaaaaagggaggcgtcggggcataaaaataaaaaaaggggtgggtgttgggggggaaaaataattatcgtgggggggtggtgggataatttgtggggagggggattatctggtccaggaagagcggtagttactttaaacaatggggagaagagacccccccatagttgtggtgggagccgtattgacaaatatttttgtgttggccacatcagaaaatatctcatggcccgacagcagaggtgggggagggcggtgttataaaaaggtggtggcggcagcaggataataaaattgttcgcggcgggcccccgacgaagggacgcctgcgggggcaaaaacaaatgggtgtgcaggtctcctaaacgacgaaacacaccggacacaaacaataatcaccccgcggggggcgcctgctaaataaagggtcgtaagcaacaggggggggcagcagcgggctaccacacccacacagaggggagcggagacccccgaacgagtgactgagtaagacacccccgagtctggtgcaaaaaaaaataaggggggctgcacgatcgcgcgggcggcaaaaccattaagggagcgcaccaaactaaacgtgagaagcggaacaacccaatggttggcgaggggggaccattctcatagaaggagaccccccaaaatatcggaaagaaggggcgcccccatagttcggggggcaacacacgagcatatctggcggccccaaaaagattggccccggagagaaacccacagagggcggcctaaacaccagaggaatccgcaaccgt

SEQ ID NO: 633709 - DNA, 581 bp, Homo sapiens
tatttgggttgggaatccgttcttctctttggttaaaagggggaaaggaagtggatgcgggtacccccaggtgcaggggaggcatgcaggcagccccagcaggcaggcgcgtgggaggcgggggaaaaagtccgtggagtatcccaaaagtccatatactctgcaaggaacagcaacgctggctgacagagggggtgggagaggaggcagggcccgtggggagggggcgggagggcagggggcgtgggggcctcacacataacagtgcaaagctccagcgtgccccaggaaactagggttgcttcgtgaaaagcgaccacagcgttaaaaattacacagaacacggcacacgcgccacacagtggcgggaagaagagctctggatatatcccataagaggtggaggagagtacaaaatgagcgcaagcgcgggcccccgacaagggaagacctcccaaagacacgaggggcaatacagacaaggttcactcgcgcaaaggggggggggtaccctcccagggggaaccccgtgggcgggggagtgggaaagagaggacgttcttacaaaaggaaggcggaga

SEQ ID NO: 633710 - DNA, 134 bp, Homo sapiens
tacttcctcatcatgagactcggaattcctgttaacgcgtgagacttcagcctgtgcagatccagagcctggagacactgggggtgctggcacgagcagtgggtggagcccatgagtacgctggaatggaattg

SEQ ID NO: 633711 - DNA, 608 bp, Homo sapiens
atcccttcaggtcgctgaaagttggccaggaaatccaccagcgtgttaagtcctaacagtggaagatgccaacccctcttccttgctggagcaagctgaacgagcagtttaactgggtgtcccggctggccaacctcccgcaaggggaagaccagtactattttgggggccccccggtggctttccaccctttttaatcggacgttccctccggggtcccttagggggttgtgaagctcttttctcttgatcccctccctgtggcgggccccgtagaagtttcccggaaaaacccttaatttttgggggccctggcggagaaagccctgccggaattcccccaaaagccccggggggggttagatgtggatgttgcttttgcccccacggggggattttagtcccgcccccccccaaattaggtgcagcccccccaagagaggtttggccgtcccccagttacccgggccccgcctcccgggccccaactccgccccgcccctcccccctttgggtcccgccctcttacccccggctttgctggtcctggggagaaccgaattggtcccgcctgccccttattccataaaactgttttgtgggctgga

SEQ ID NO: 633712 - DNA, 237 bp, Homo sapiens
tgatttgcccttacaaaaaatgttgaaatgtaaaacttttgctagaagaacccagctgtaattcgatgtgtgtcgggagaaaacaacttagggccaagatgatgaaagctcgggggcactctaaatagggagagacacttttcagagaagagcccgggctatatagtgctaatgactcgcaatgtaaaaccttcagcaatgtgtaattgggccacgaggagcagcagtgtatatgtg

SEQ ID NO: 633713 - DNA, 252 bp, Homo sapiens
atggaatacacgcattcccatcatcttctgattcatcatcctgcaccctaggcccctagcgagcacccagggggctctcccatcctgcgctccactgagcttgcgcattgtcacagtgcctgtatcctgccagggcgtggcagggagggactcttagcacattgacatgtgcagcacctgaatgagcagggtgtgccagaccaggctagcatgtcctgaaggctcctgtccccatagtgatgggaaaggaat

SEQ ID NO: 633714 - DNA, 102 bp, Homo sapiens
agttcgacggagactctcatactgctgggtcatatgataattgttgcttcactttaaaataaacgctaaccgttttccaaattatctgtaccattgtgcatt

SEQ ID NO: 633715 - DNA, 1654 bp, Homo sapiens
tcggctgggcacaatattggtgttggtgttgatgccaacacagagcgcactgttttcgtggctgccaccgctcttttttggctggagggcttcgcttcacacaacaccccggcgtatcacatcatttgttgtctccctcttctgtctgtctctcacccgtcgactcaatgatcgcccggtgggttgttcctccaccttctgttgatgctctccctgcgtgggattgacctcacggtgatggccacagtgggcccctccgtggcaagcccacggttgtgtttgaaggtggtgggattgtggcctcccctctttgtttagggggacgtcccccccccaattgcggcgggtgcctacccctgcgtgtggaatccccccacacaaaaattgtgtgcgccgtgtgagaacaaaatgtgggagaatggcaacgggacagcacccttgtgtgacccggcctcgtggagagaaagtctctgcccttgaaccacgttcatccgccccatggagaccacacgcttgcatgttgtgggggtgccccgcccgcccctcgtctcacgacggggaacttgtgaacaggaattcttcctcgcacgccgaaattttaatttggcataacgatggagggggaataaaaattgggggtctcgtgtccggctgatcaacaccacctgtttttcgttgtcgtataagtttttgtgcccgccgtcagcaatagctctgtgggctgtcaacaagatggggtttataaatggaagtgggggcccccccctctgtggaagcccacatgtggaggggagtttttgttcccacaccgcgtcgatcaacggcggagagagtccttgtgccttgtggtagatgacggcccgcatatgagaggagaatcccaccagggaagatttttctctttccctcgcccacttctcgtttgcgccacaaagactctgggtgtcgcactcgccccctcggagaacccccttcggagagggggatgaaaccttttatatattctgctcgggaggatgtctcacactcccctcctctcttggggttttggaatacacccccacgctccctcataataagggagccacactttctctcgaggtgttaatagcacccgcgttgttgaaacactattgagagatgtgaccacagaggttattctccaccggtaaccttttcttctcacgcgattctcccggagtgtgccccctctgtgatataaacaagttgcgcaacacaccacactccacgggccacgccgacaataaatattgtaccccccgcccctaggatatttttaacataagagaaatctccaatattttcttttataagggacacaccgcctttctcaagtgccccttttttctccccagtgttttctcacagaggcgcgcccaagaatatgaatttgtgaaatataggaaatataacctcttatagttcttttcaccacccgaccactctctaccagaatttatgaaaaaaagtttaccgaccataatcttatgtttaccacgagaaaatctttttgcgtagaataccttttttaaaaggtatttttgtagatacccacatttaacctccttttttttttcccgccagtatcccacccacttggttttgcttccaataaatctttgggaaaactcca

SEQ ID NO: 633716 - DNA, 165 bp, Homo sapiens
gaactaaccaagcatgatgatgtctggaaggtcgacgtgtattcaccactgcggtgcatgctccctgtacaagttccgtcgacacgtgagcacgtggtgactccaaatatcgttaagctgtgaacctgtgtcgaactctagtaggatcctccagtacccgagcat

SEQ ID NO: 633717 - DNA, 80 bp, Homo sapiens
ctgcccagccctgtgctggggccctgcaattatgaatgttggccagatttctgcaataaacacttgtggtttgcggccaa

SEQ ID NO: 633718 - DNA, 262 bp, Homo sapiens
acaggatctcaaggctttaccgcctttttgagaatagccattctaacatatgcaaagtgatatttcattgtggttttgatttgcatttccccgatgaagagtgaagttgagcatctatccatgtgtctgccatcaatctgtacattttctttggaaaaatgtctgttcaggtcctctgcccattttttaacagtttttcacttctttgatgttaagttgtatgaattttttgtatgttttggatattaactagcggtaaaag

SEQ ID NO: 633719 - DNA, 343 bp, Homo sapiens
  misc_feature (328)..(328): n is a, c, g, or t
gcgtacactggcatcaagctacactccaaatctgtgcattattttcagattcatttgttccctcggcaggtaatccatattaagatgttttctagtctcttttttttcagctgtctagttttgttttgctgttttttgtttgtttgtttgtttgtttttttggttgtgcacatgggtattctgaatacctaggatttgctcaaagctaaaattcaaaaataaaatactttaaaatgaagcccttgtcagtctcttgccaaaacagttgtctctaaaattcaagtctttctagggcttcagactaaaaaacaaaacaggtacttgtccntaggtccatttaaat

SEQ ID NO: 633720 - DNA, 305 bp, Homo sapiens
cgacctagaggatccccactgacggggttatgggactgaaagaggacgttgtgcttgatactggggtgtgatagctcaacggggttacaaggtttcttctcacacatagactcgtgaggtcttccttgagctctttagagccttccctcgggataggatgaaatactgagatcctataaaggattcacaagacgagtcactcatcagtgcagattcacctgattcacccctagatgtgtgtgggatttggatcgcaaagagacacaggcactgaagatttttgtgccaggagaggggctctcaaa

SEQ ID NO: 633721 - DNA, 794 bp, Homo sapiens
ggaggagggaagcggctgagcatgtgacaagagcgaaagtccactgcctggcaaggacagcctagacacgggggaaagaagggacatggaggggctgagccctgtcacacgtcatgccctgcatgccgggctggacatggagaagctgagctgtgcagtctggagctgaggctgggaagccctgatacatggcttagaaggtgagttggtgacaactggactggttccccagcaggtgcaagcaccagagtgatgggaacagcccctgctgccaggagcccacgggggggagtgtgcacgtgtgtgcgtgtgtgtaggtgtatcctgtgtgcacagatggtatgttcaatagattgtgtacgttgtcttgtgcattgtgtagcggtgtgtagaggagagatactagtacataaggatgtggtggagaatatgtacaatagtagtgcaggtagtagtagtggatagtctgcccttatagtgtagagcaacattgctgttgctgattgggtgcctatgatagcttatctaattaacacggcccgaaaggaccaaacatagtataggcacatttctaatagatcggttaactgattacatagagcataaaagccccaattttatgggaataacttgcagaatcaaacaaggttcattgatgggactataatgtagaacgaacaggccccggttcaatacaagctgggacatttccccacgtcatgtactgaagagttgcgattgataattcagaaggctccaattaaataggcgccactaacaatgtgaaacacccg

SEQ ID NO: 633722 - DNA, 108 bp, Homo sapiens
  misc_feature (1)..(1): n is a, c, g, or t
ntccatcgtgcagcaagcatcacccaacgtgccagcaagcatttctgcgaggcatacaggtgcatcttcgtgccacgcatgcaggtgcatcgttcgtgccacgctata

SEQ ID NO: 633723 - DNA, 376 bp, Homo sapiens
aagatatttttaccccagtttgagatatattctgaacaattaaatgtcccaggaatacattttttcctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcacatgcctgtagtcccagctactggggaggctgaggcgggaggatcacctgagcccagggagggagaggttgcagtgagctgagatcatgccactgcactccaccctgga

SEQ ID NO: 633724 - DNA, 486 bp, Homo sapiens
ggcacgaggcgcatttcaggagtgggcatctcagccccctggccaaggactgcgttctgagaaagagcttcattgatcttaccggtaggcagacgggtggttcgcactctttcttgctgacgagaaccagggctctccagccgctcctggcagccgtcttgtcaccatgagggaacccaagaggaggaccaagatgtggagccggacccttgatcagacctctcctgaatcccgcctctgggcttcccagtaagatccctgactgtttgggctgagtttctattttctggagctgaacacatcggctgaaatagccagactgtccaacaggcaggttaagcccctggttcacgtgtttgtcacccatcctcaccttccagatgtccagtcccatgagggtggactgtgtccctgctgcgtcccctgactagaacggggtggacacagagtacacagtacgtgcaaaataaatactgttgaatgcaa

SEQ ID NO: 633725 - DNA, 953 bp, Homo sapiens
gtagcgcacgacggtgcgccgcacccctcttccccctcgaatccaccgctctgccgcctccgttcgttctgccgcttccctggtgcttgctctgctgttgcctcgctcataggtagcggaccctggttaccttcatctttgctgacacgccggcacgcctgcaggcagactcccggtcgccatcgccacactggacacgaccgtaacaaaggcgccaaaggcacacggcagatcaaacgaccttgcagtatacagaacgaactccactacttcaacatctctgcacacgcgatgcgcccgcgaggcccacgcgcacatgcgcttctccttgcctgagaatggccacgcccttctacccgcaagttctcaacgcaacggccaactaatcccacacaaaccgatataaggcgtaccaacacccttacaccctggcacacacagccccgattactttggctggaaaagccgaaccccagcggtgcaacttatggctcacaaaattgacaggggccaatgcaaccttcaacgaaactttatccccggaacttctctggcaacccggaggagacccaaacacccccaacacgttccacacaccttgtcaaccacaacccaacagaaacaaaaccgaatccccaattgacccaaaaccaagcggctcagtcggccccccaccactttgggcgcaacgggcggcacactggcactccgcggcaactttacacacaaaaacgattgtctgggaaagatttggagatgaggatatataacccccaatgaagccaaagatgctccacatcggcgaaaccgcggatgggggacaacgacggggactgagcatttccactaaaacccctttgcgtgacaacactaacaactggacggggggaaacaaaagcccccgcttgggacacagcttatatcacactttacctattacaaccctattatcc

SEQ ID NO: 633726 - DNA, 364 bp, Homo sapiens
  misc_feature (1)..(1): n is a, c, g, or t
nagacctagaggaccccgagtctacaccaacgttttgatacacgaactggatccaaaagacctttagccaaggaccccgcatgtgaatctacctcccgacctaccaccccactggctggttccagaacgtctctacctagaccttgcctcccctccttcctgcccagtctgaccctgatgcttaataaacgcacgacgtgagggtcctgattctccctggttttaccccagtccatccttgcatcactggggaggacgtgatgaggggacttgggtcttggtcttacccccaccactagagaatacaggaaaatccttctagatctcttttaccggccatgggtccgagctgaattgaatcagg

SEQ ID NO: 633727 - DNA, 184 bp, Homo sapiens
gcactactgacccttatagcatgatgaactcctcgacagctcagctgttgtctgcatttgtgtcaggtcctccatgatgtgttctatgacctatttcattcttattctccttcttgagaaaatttatgcagatcttttctgcaccagctctattgaattccccacaagttggggtacctgagct

SEQ ID NO: 633728 - DNA, 413 bp, Homo sapiens
acaggggagctggtgtacccaggatgggtttatgggcgtcgaggtctacaggtaccaaacacaaacagctcttgacctgggtactctgaggatgggaaattcatcctgccagcctgtctttgaggctcagtctcaggggctggtacggttccacatacccctgaatggatgtggaacgagatataaggttagtactggcagatggcacgaggttaagtctcatctttgacataactggctgctaacccactttctctgacatttaagttcgaagatgattaaagtcgtctatgaaaacgaaatacatgctctctggacggattttcctccaagcaaaatatctagagacagtgagttcagaatgacagtgaagtgttcttatagcaggaatgacatgctactaaacatcaacg

SEQ ID NO: 633729 - DNA, 583 bp, Homo sapiens
  misc_feature (302)..(302): n is a, c, g, or t
ttttctcattttaattggacaaaaaaagtggctctggcatgtacagattttaaaaaaccaaaagtgcctttaaaaaacattgaaaagtgggggggaggggtacaaaaccttcagtgggggacagatagggaccaactaaattccaacttccgtgcccctttcctttcacagaaaaacacctttattaacaaccttcacagttccacaacacagccattacaaaaatacacccgcgtgggaacactttacgtggaaataacacggtgtggaggcacagtgaccatccgcgtgtgccgctgtgnaacactcaacgagggcgtggggagaatatctcgcgtgaaaaagcggtgggataatactcaccgagcaccgcgactacacccacacgaggacacacacccgcaacaacaagcaagaaaaaaggagacaagaacaagaggacaaaccgaagcagaacaaagcagaaagcagagaaccacaacaaagcaacaggaagcagaaaaccacagaacgagaaacaagaagacgaggaagacgacgaggagagaagggacaacaacacaaagacaaccaaagaaacaaa

SEQ ID NO: 633730 - DNA, 150 bp, Homo sapiens
  misc_feature (69)..(69): n is a, c, g, or t
  misc_feature (118)..(118): n is a, c, g, or t
actatgaagatggggcttttggaattcgcattgagaatgttgccttgtggttcctgtgaagaccaagtntaattttaataacccggggaagcctgacctttgaacctctaacattggntccttcagacctgatagatgtggattctcttc

SEQ ID NO: 633731 - DNA, 382 bp, Homo sapiens
ggctgcagtgcactccacccgtgggttaagagggagactccgcctcaaaaaaaacaaaaatggtggctaaagtataaatgtcggggggctggggtcgaaggaggcactgttagaaagtgacaagctccacagaaaagcagcgagtctctttcctgagtctgtttctctgagtctcttctttggggtatgtggtcataacttgaagtccaggggggtgtatacaaatggtgggggtgcgggtgaactcgcaggatagcgactaggggggctgtgacggctttggcccccaggacactgaggtgtatggggcatatcaacgtaaagtcaggagaaccactgttgcagggccatggccgtaagcggctggcataggagacccgga

SEQ ID NO: 633732 - DNA, 1431 bp, Homo sapiens
ccctccatggttactctccgctcccgtgagtaacttgtgctccgtgggtgctcctggtctgcctgtcccgacactgcactgccctgcacacccattggaccgacgacctgcctggctctacctgcacagcatacggcaaagcccttacctgagcaggctcgctcgctgcggcaatgcctgggactgcctctccacccctcctggcaccgtgcgcggcaaatgttaacgtttgaacgacggggcggaagatgggtgtaaccatggtaccattgaagaggccggactccactctgcgagtctgatggaatccggtaacaccctggcagactgttcgagcaaccttgctctatggcaccgacaacttcgcacagattcacacatgaatgcgcacacaaagtgtgcatgggccatctaagcagtctgcaacacctctcggtggaacctatcagcagcttccgtccaggtaatactaacgtcacaactgctagcgcctctgcatcctacaggttttcaaagtcctcacactcaaacgcactgcacgtacacattctgcaaacacacgctatggaaacctccaggtggagacgatacgaattccttcctggcagggtcttgcgaccattgtctagcctcggccaccacgaccttccaaacatcctccaccacgttctaagaacctctacacagtgggaacacttcacatcttggcgaccgaatagtccaggccacacccttagggaaacccctgtttggaccgcaacagttacgcacattggccttgaagagaaggccctgcgaagcctcctcatgaaccttgtgcacgcgctaacccaacgcttgacactgacgtacccgaagacgcaccgacgtacattcaaaagccgtgcttgggcgccccaagcattcacccaaaacgcaggggaatcggcgaactcgaccccggagagcgcaccacgggaacaggcaacccctgaacgccacggagcgccccgaacgcggcacgggcggacgggaacgaaccaacgggacagacgagacgaaagcacccgcgcaaacgcatcgcgccacgcacccgcggcgatcaaaccacagggtgaacaaacgcaggggacgacgcgcgcagcacaaggacgcgccatcagaagcctaccacggacagtgaggacaatagccacgtggacggccaccaacattcgaagcaggagcacgaaacggcagcgtaccgaggagcgacataggctagcgaaacgaagcggcgcccccgccgcacacaaccagagggagggacaagaagcgagaagaacaggagaggaagggagggacagacggtaaagcgtggcccagcaccgagcagagagcacgcacgacggggcagccatctccccttagcgacgtgaccgagccaagcaaggacagtcgagaggacgcggg

SEQ ID NO: 633733 - DNA, 99 bp, Homo sapiens
aaaaaggggcaaattttttttagtttgggcccccccccggggttttttcccaaaaaaaaaagggggggggggggggcctttaaatccctttttccctca

SEQ ID NO: 633734 - DNA, 3647 bp, Homo sapiens
ataagctgaattatggcagcccagtcaagtttgtacaatgacgacagaaacctgcttcgaattagagagaaggaaagacgcaaccaggaagcccaccaagagaaagaggcatttcctgaaaagattcccctttttggagagccctacaggacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtttggtggcccctgcccagccgccttctcagacatttccacctccctccctcccctcaaaaagtgttgcaatgcagcagaagcccacggcttatgtccggcccatggatggtcaagatcaggcccctagtgaatcccctgaactgaaaccactgccggaggactatcgacagcagacctttgaaaaaacagacttgaaagtgcctgccaaagccaagctcaccaaactgaagatgccttctcagtcagttgagcagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcaggggggaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctccaaaagtgccagcagtaccaagagtcaaccacaaagactcttccattcccaagcagagaagagtagaggggaagggctccagaagctcctcggcagacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcaatgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagataatgacatcttcctatgtcaccatcacatcccatgttcttaccgcctttgacctttgggaacaggccgaggccctcacgaggaagaataaagaattctttgctcggctcagacaaatgtgtgcaccttggccctcaacagcagtttggtggacctggtgcactatacacgacagggttttcagcagctacaagaattaaccaaaacaccttaa

SEQ ID NO: 633735 - DNA, 1218 bp, Homo sapiens
gggcagtgcaagccgagcgggcgctggcacagaggcctgaccatggacgcggaatacgatgtgatcgtgctggggaccggtctcaccgaatgcatcctgtcgggcatcatgtctgtgaacgggcacgaaggtgctgcacatggacctggaacccctactacggtgggcgagagctcctccatcacacgcccatggatggagctgtataagcgtttaacagttgctggaggggccccactgagtcgatgggccgaggacagagaacttggaatgtagacctgattcccaaaattcctcatggctaaactgtggcagcatgtgtacaggatgctacttgtatcacagaggtagacgtcgcataacatggacttcaatgtgttggtgcgagtgggcaagctattgtcctacaaaggtgggcgcaagcatctacaaacgtggccgtaccactgacgactgaggcctatggcttccaatctgcatggtgcatgttatgagaaactggcgctatcctgaaaagtatcctggtagtaatgtggccaactaacgatagagcaatgacacccaaagcagcttttgcagggggccgtatgaccacacacaaggaagtaccccagtaaagtgcgatgaaccggtcttaacccaggacacagtatatatggaatcctggcggacccaagggaactaggttcacaaccgaccatactatcacactggggacccattgcacccctagagggcgagacatacttacacctgcagaacctggagtggaacatagaccccatagggaaacccaagaaccctagaccccttatgaaagacaaaccccgataccgaaaaccaggggagattcaacaggactcgatcaccgaagagtggacggagacccatagggagcaaccagagtagcaatgggacaaaacgaaaaccacgccgaagataacttagataaataacgcacccggggataccatacaacgaggagcataatggacacaggcaaggccgttggcacccaacaacgcggcaataatgaggaacacacgcaaactataggcagcgggggcgcccaacaccaaatatgtggggaggaggcagaacagttacggtaatgagacgatggcaccaagaaaaaagcacacagagaggaagggaacaggaacacagacaccacacacgccagggaacgacagcacggcgaccacaggactgagagac

SEQ ID NO: 633736 - DNA, 2614 bp, Homo sapiens
gcaaacagaaaaaagtggctccccgcccaagtatccctgtaaaacaaaaaccaaaagaaaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcaggggggaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctccaaaagtgccagcagtaccaagagtcaaccacaaagactcttccattcccaagcagagaagagtagaggggaagggctccagaagctcctcggcagacaagggttcttccggagatactgcaaatccttttccagtgccttctttgccaaatggtaactctaaaccagggaagcctcaagtgaagtttgacaaacaacaagcagaccttcacatgagggaggcaaaaaagatgaagcagaaagcagagttaatgacggacagggttggaaaggcttttaagtacctggaagccgtcttgtccttcaatgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagataatgacatcttcctatgtcaccatcacatcccatgttcttaccgcctttgacctttgggaacaggccgaggccctcacgaggaagaataaagaattctttgctcggctcagacaaatgtgtgcaccttggccctcaacagcagtttggtggacctggtgcactatacacgacagggttttcagcagctacaagaattaaccaaaacaccttaa

SEQ ID NO: 633737 - DNA, 127 bp, Homo sapiens
gatcccttaagcagctcgttcttccatggagcatctgtctctcattagtaatgttcttcttctttgactcagttcaagtagttttacaatatgtacaggagttcttggaacgatagcttttggtttt

SEQ ID NO: 633738 - DNA, 696 bp, Homo sapiens
  misc_feature (209)..(209): n is a, c, g, or t
ggatgttcggtcctgttctcctgtgcgagcgggtggcgccgcgctctcttggtggcgcgagggtcttctcggtccccgtgggggggtgccgttgagtatcatacgacacgcgctggttgcgttgggtcacctcgcgttgggtcgcgggcggttgcctaaggtagatatccttcctttgcaagggggggttttccgcggctcctttcccncccctccctcgggggtaagagcgccaccaggagttttttttttgggcgccccgggtgggggccccaccacaagtgttgggttaaccaagggccccggcgcgggcccccaggtggggtttttttctctcgggggagggggggctttcaaggggggaaaaaggttttctttcccccggggggggggggggggggttccctcctaccccttttcccccccttttttggcccccccaaacccccggttttgggatttggggggggggggcccccccccctttttcggggggcccggggggaaggggaaaagggggcccctttttccccttttttggggggggggtcccccttccccttggggggggggggggggcccccgggccccgggggtttgggggggggggttttttggggggttttttttttaaaccaggggggttttttttttaaacccccattttttggggggggaaaaaagggtttttttgga

SEQ ID NO: 633739 - DNA, 413 bp, Homo sapiens
gtcaggagttagaggtggcagtgggcgtgcaggagaagctgtaggtcaggaggtagaggtggcagtgggcgtgcaggagaagctgtaggtcaggaggtagaggtggcagtgggcgtgcaggagaagctgtaggtcgggaggtagaggtggcagtgggcgtgcaggagaagctgtaggtcgggaggtagaggtggcagtgggcgtgcaggagaagctgtaggtcggggggtagaggtggcagtgggcgtgcaggagaagctgtaggtcggagggtagaggtggcagtgggcgtgcaggagaagctgtaggtcagagtggagaggtggcagtgggcgtgcaggagaagctgtaggtcgggaggtagaggtggcagtgggaatgccaggaagaaactgggtcttcggggtcgacgc

SEQ ID NO: 633740 - DNA, 394 bp, Homo sapiens
gtcaggagttagaggtggcagtgggcgtgcaggagaagctgtaggtcaggaggtagaggtggcagtgggcgtgcaggagaagctgtaggtcaggaggtagaggtggcagtgggcgtgcaggagaagctgtaggtcgggaggtagaggtggcagtgggcgtgcaggagaagctgtaggtcgggaggtagaggtggcagtgggcgtgcaggagaagctgtaggtcggggggtagaggtggcagtgggcgtgcaggagaagctgtaggtcagggggtagaggtggggagactgactcaaagccatgccaaggtacagagtagagcagatgattaaacatcatgatgtgaattgcttctgagcagggcccataaataactatcattttaagtcgacgc

SEQ ID NO: 633741 - DNA, 466 bp, Homo sapiens
  misc_feature (135)..(135): n is a, c, g, or t
  misc_feature (163)..(163): n is a, c, g, or t
  misc_feature (175)..(175): n is a, c, g, or t
  misc_feature (236)..(236): n is a, c, g, or t
gccgggcgcggtggcgcgtgcctgtagtctcagcctcctaagtagctgagattatggttatgtgccaccacacccagctaattttgtatttttagtagagacaggacttcactgcgtttgccaggatggtctcanactcctgatctccggtcacctgcccctnttggcctcccanaatgctgggattacaggcgtgagccaccgttcccagccaagtaaacccttttttaaaaaanaaaagaatggatgttcttataatgtattacctaggagattatgcatttatatattctgtactctaaaaagaaagaggttagtaacatttttctttctaaaaacgttttcccccttcccaaaagctgccttatgaggatacatagttatgaggatattaaaaataggaacaaaagaagaatgtgagcagtgacagggatacaacatggcaccttccaagaggttaatactg

SEQ ID NO: 633742 - DNA, 322 bp, Homo sapiens
gtcaggagttagaggtggcagtgggcgtgcaggagaagctgtaggtcaggaggtagaggtggcagtgggcgtgcaggagaagctgtaggtcaggaggtagaggtggcagtgggcgtgcaggagaagctgtaggtcgggaggtagaggtggcagtgggcgtgcaggagaagctgtaggtcgggaggtagaggtggcagtgggcgtgcaggagaagctgtaggtcggggggtagaggtggcagtgggcgtgcaggagaagctgtagggagtcgcttgactgcttggcccgggtaggccggtgtggctgagtgtccagtcgacgc

SEQ ID NO: 633743 - DNA, 118 bp, Homo sapiens
  misc_feature (5)..(5): n is a, c, g, or t
  misc_feature (109)..(109): n is a, c, g, or t
gtctnggacctactccggggcctgccgcgtgtgagcctggccaacttaaagccgaatcccggctccaagaaaccggagagaagaccaagaggtcggagaagaggtaganaatgtggaa

SEQ ID NO: 633744 - DNA, 379 bp, Homo sapiens
  misc_feature (47)..(47): n is a, c, g, or t
  misc_feature (51)..(51): n is a, c, g, or t
  misc_feature (138)..(138): n is a, c, g, or t
  misc_feature (200)..(200): n is a, c, g, or t
  misc_feature (203)..(203): n is a, c, g, or t
  misc_feature (257)..(257): n is a, c, g, or t
ccagagttaaatatgcccaggctgaaagaaggtgtataatgtatggncgtncttataccaaatgatttctttggaatttaaacaaatatgtttagtattttattcctaatttaggaagaaaaagcaactaaagttgtnctgacattgtacacagatgagtagcacgtaacttttatttagtaagccccataggatagtanggnataaaagttgttagtgagcaaaacaggagtatcctgccatttgctttaattctncttgtgatagttttgagggtacaataattcctgtgtgcgtgtcactcaagcaaaccagaaagtgtcttttgtaaatacgcattttgggcctcatcctcatggaggttcccgttgtttgttgg

SEQ ID NO: 633745 - DNA, 1690 bp, Homo sapiens
tgtttgttttcgtcgtttgttttgttcttgttatgttgtttgtcttgttcggttttctgtgtgtgtgttttcttctttgtttgttctgttgtgttgttgtgtcgttttggttcgttctgtgtttgcgtatctgttctttgtgttgatgtttggtttgtcagatgaggtcgcacgcaggcggcgacgtgcgcggcgccttgcgacgacagcacgagtatggtcatcctctatgttggcctgtcgcgccgttgtgttttttttcgtagacaggtggcttgtctgcttggtggatgttatgtacatcacacgagggcggcgtagttgtgggcccccgttgaaatggcgaggtttccccgagagaggaaaaggcccttggtgctcacattttgttgttgcgcccaagtgttcgctcggcccgcggtgttctcgcaatggtccttgtgtgctcatataattatcccgcgtgtgtcagcaaggggcctgtgagattgtgcggtgaccctcttgcccacagcctgcccccttgtggaatcccatgtttggaggtccctttaatggaatgaagcctggtccctctcccttgatgtaggaccccatctttgtgagggataatctcccagataaccccgtttatgggggccgcccaagttgggggaacgccccccaacggtcccaaaattttgggaagaagtgtggaatatccccccccgttccccgggggctgtaccccgaatttctgttcctggctccgcctcaggatgtctccccttgggatatggtggaccccaataggcttggagaagccgccctcaataaatagtgaagagttctcaattgtgtcgccgggacagcctcgaagatctaccctcgtgtatagagtatagtcgctgtggaagcccccttgtgggtgtcgcaaccacacaagccgccgggggccttggagacagagaagtgtgtgaccccccggggatagtggtctccactggtgcgcaacacacacagggagatgcactgcgcctctccacagaggttgtgcgccaccggggtcatcccgacagggtgttatactattgagactccctgtcggggcggcgcaccacccccctttctacagggtgtcttcttgtagcagagattctgagagcgtctcacgattcacacacacgcgctgagcgccactgtgagaaggctgcgcctctgtgagaagaccaccacctgtgccacagagaaaacgcgagggccgcgcctcttggagagaccccacgcctgtgcgcactatatcccagcgcgcctgaatcacaccgggtattctgtacaggcccccgcctggggcgaatgttgcgaagccttaatataggtgagcgcgtcacgagattcacaggagtataccacagcgcgctcactggagcactcacacatttcgcgcgctggagagaacgcgagagttgccaccgctatccgcacgcctcgcttcgaagggacccacggagaagaatcacactacacaccacacatttgttctgcctccccaaggttcctctctcgaaggcaagcccaggactctgcgggcttttgtctgtcccttggagggtgttttctgggtagagggatgtggaaggaagggaccccttaccccccgctcttctccctgaccctgtcccaatataaaattttatggtcaccaagggga

SEQ ID NO: 633746 - DNA, 204 bp, Homo sapiens
  misc_feature (113)..(113): n is a, c, g, or t
gctccacgacggggtggcctagaactgaacacacaatatcttcaaggtcagcctatatgagagacagcctcctgctcctaggccacagacctgtaaagcatgttactgtacgntgaatactgtagagcaaattgttacagcatggtaacgtatttagtcgtcgtctaaacacagtttaaagcacagaaaaaagtaggctgggat

SEQ ID NO: 633747 - DNA, 140 bp, Homo sapiens
  misc_feature (42)..(42): n is a, c, g, or t
  misc_feature (81)..(81): n is a, c, g, or t
  misc_feature (128)..(128): n is a, c, g, or t
  misc_feature (137)..(137): n is a, c, g, or t
cttccgggaatcttggtctgaaacaagccgggcctccccagntgcctgggcttaaccggcggggagcctggttggcctttnttatttatatagagaacacttcactgttttgtacatttttaagtggncttcagggnagc

SEQ ID NO: 633748 - DNA, 110 bp, Homo sapiens
  misc_feature (2)..(2): n is a, c, g, or t
gnttacaaagctgtttaaagaaaaaggtatatataagggaagtcctaaattaaagaatagaactagataatgctggacatgtagctgacctgtcttttgcatttgcagag

SEQ ID NO: 633749 - DNA, 1112 bp, Homo sapiens
  misc_feature (906)..(906): n is a, c, g, or t
ggccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttccggttatgggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcattttatcatacagtagattccntccattcactatacttttcataactggagtttgtcctacatggcaacgtaccgtgttttaaacgggtcgcacggcctcctggtgcctgtccctggtaagttgggcaatttaaaatttactttaacccaaaaaaacaacaacaaggacacacgaacacaaaaacctttgcccggcctcttcgggccccgaaaagaggtttgtatacg

SEQ ID NO: 633750 - DNA, 980 bp, Homo sapiens
ggccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaatttctcttcttccggttatgggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacagctatcggtgctttgcaggaggcaagtgaggcctatctggttggcctttttgaagacaccaacctgtgtgctatccatgccaaacgtgtaacaattatgccaaaagacatccagctagcacgccgatacgtggagaac

SEQ ID NO: 633751 - DNA, 690 bp, Homo sapiens
ggccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaaaaaaaaacttttggggcgcctgcggcccgaaaaaattttttaaacacattccgttgggcgccccgggccccctggttgtacctgtggccacggtccccaagaaacacccggggcccgtgtctggggttctcctccccttaaa

SEQ ID NO: 633752 - DNA, 348 bp, Homo sapiens
  misc_feature (348)..(348): n is a, c, g, or t
actggatagaggtcaggtgcacggatgtgagaagcgaacctgggcctgcttgatagaagcctatgaaagggaaagcgatcagagctgtgagcttaagatacgccatggtgttgatcgccagggcaagtatcctgaggagtgctcactctgaggatcatgtgcataactgaaagaaggactgagagagatactcatgcggagcgtgaagaatagccgataacagtgacagcagagcttgtacgctctgatgagacagcatgtacacactggcagctttcggggactactatctggaaatggctgactagtgagcactgcaagctcctgagagtgtgcttctagcggccn

SEQ ID NO: 633753 - DNA, 823 bp, Homo sapiens
ggccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaaaaaaaaaaaaaaaacttggggggggaaggggccctaggagaagcctctaaacaccaacagaggggaccgcagggcccagaagggaacgcaaccggggacaaagcgcggccccagagaaacccgggcaagaaaaaggggagcgaatacacgccacagaaaaaagcgcccggggaccccacgagggtcaggaaacaaacccaacagagacccagagagagcaaaacgggacacccacaccagaggaccacagcagagaccacattacaatataggcc

SEQ ID NO: 633754 - DNA, 377 bp, Homo sapiens
gagccacggacctagccctgaacatacgtcacccactcctgcccccgacaacccaaccacaaggcccccacagttattttcaaaactctggaatgacatgttttcctattacaaacaaggtgacaatgtatcttcaaaggaacgttgaactcggggtttgtaccttcacaagtgccttctctctcccgagggggggaattaatctctaggaacctgtattggtgcctctgccctgtcctccccttggggggacacagacttcgggttgggatttgacagcaggggggaagtgttatcgaatcttgggccactgcgctgctacattatatcttagggggaggggacaacccctaccgggttttacatgatcagctgcg

SEQ ID NO: 633755 - DNA, 626 bp, Homo sapiens
ggccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaattttctttactccctgttatgggaacttcaaacggtaaaatatttattgggcctggaaattaattggcagggaacccta

SEQ ID NO: 633756 - DNA, 477 bp, Homo sapiens
  misc_feature (27)..(27): n is a, c, g, or t
  misc_feature (29)..(29): n is a, c, g, or t
atcctcagggaaataaaagttttccangncctcaatgaccacctatcattcctatttgtttagtgttaagatggtttttgttgttgctctgtagtatattttacagatgaaaatggttgatgatgtaagtttaagttagcctatgtcacagggaggtttctctgttgtccagctttgtgatgttaagcatgaagttaaagttagataaaccattgcctgaaaactgcctaggctaagcactagattttccatgagaaggttgttttcgattctagtcttgttctctgcaaaagtaaatgggatttgccactagttaaggaattctgtctctggcaaaagtgtcgtgcaactgagagaagtaatagcggtgcttaaaattttcgagatcacttctgtttaccaagtgtaagctgtacaaacactcagcaagtaataaatgagtctgaaatagtcctcaaggataacgatgaaaaaaaa

SEQ ID NO: 633757 - DNA, 743 bp, Homo sapiens
  misc_feature (537)..(537): n is a, c, g, or t
gcggccgcctactactactactactgctcgaattcaagcttctaacgatgtacggggacatgccaaacgtgtaacaattatgccaaaagacatccagctagcacgccgcatacgtggagaacgtgcttaagaatccactatgatgggaaacatttcattctcaaaaaaaaaaaaaaaatttctcttcttccggttatgggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcattttatcatacagtagattccntccattcactatacttttcataactggagtttgtcctacatggcaacgtaccgtgttttaaacgggtcgcacggcctcctggtgcctgtccctggtaagttgggcaatttaaaatttactttaacccaaaaaaacaacaacaaggacacacgaacacaaaaacctttgcccggcctcttcgggccccgaaaagaggtttgtatacg

SEQ ID NO: 633758 - DNA, 184 bp, Homo sapiens
tagtagagacaggatttcaccatgttggccaggctggtctcaaactcttgacctcaagtgatctgcctgccttggcctcccaaagtgccaggaatacaggtatgagccactgcaaccatccacattttttatttttgtactatatactgcggttctactacccaaaaaggaactactgccttat

SEQ ID NO: 633759 - DNA, 132 bp, Homo sapiens
  misc_feature (114)..(114): n is a, c, g, or t
gggttgttgacacatgacagaacagagaggcttttttatatatactgatgatcacagggggcagatttgcataaaattaccatgattgctttatgtttatatttaacttggatntctgaacaaacaagattg

SEQ ID NO: 633760 - DNA, 150 bp, Homo sapiens
acaacggactgattcaccgcaagactgtgggcgtggagccggagccgactggaaggtgtcgtggtggtcattaagcggagatctggccagtggaacgctgccacctcctatgtgcggacccccatcaacaagaatgctcgcgccacgctc

SEQ ID NO: 633761 - DNA, 252 bp, Homo sapiens
  misc_feature (2)..(2): n is a, c, g, or t
anatcaagtgatcctctgtcacaacaaaagaattaaaaaaagagacccagaaggacaggttcaggaagcttctgggtgggtgaacacattcaggttgtttggcagagctgtgccacggcgggcatggaggctccatacatcctgcacccagcaccttgcgctgtgcctggcttctgtctggcacttcctgacctgctccttcataacaaaaccccaagctgggagggaaagtgctgtcccgagtcctgtgag

SEQ ID NO: 633762 - DNA, 128 bp, Homo sapiens
ttttataggataatttttttatttcaactttttagattcgggggtacatgtgcaggtttgttacatgggtatagtgtgtgatgctgaggtttggagtactattgtaggataagtatttaaagaaataa

SEQ ID NO: 633763 - DNA, 422 bp, Homo sapiens
gcgatgggggcgcgtgtcgacatgtttgaggtgggtttggcccctgtgccctccctcttcaaccaaatgatccttattaggagggtggggcgctccctgggcccgcccaccccaacaatggggttggcccccccttaggcccctgccccacaaaaactgggttttcaactggcccaaaaaatgggccgcctgggggggaaccaccaacggggggttttcccccaacaggggcccctcggggggttcttcccaggcccaaagggggggttcccccaaaaaaaggggttcctgggccccggggggttcccccccccaccgtttccaacgggccttttggctttcccctttgttttccccctgggcccccccccccttaaggccttaaccccccccccggccctaaaggggtgttttaagtttga

SEQ ID NO: 633764 - DNA, 130 bp, Homo sapiens
tactgatggagtgcaagctcgaaagagagagagagaaaacacttgagacagatagtggagtgaaatggcggacacagatgggcctgcagaccatgcccccaaccctccgctgcccatcccctcctcccca

SEQ ID NO: 633765 - DNA, 832 bp, Homo sapiens
  misc_feature (30)..(30): n is a, c, g, or t
  misc_feature (80)..(80): n is a, c, g, or t
  misc_feature (123)..(123): n is a, c, g, or t
  misc_feature (125)..(125): n is a, c, g, or t
  misc_feature (169)..(169): n is a, c, g, or t
  misc_feature (200)..(200): n is a, c, g, or t
  misc_feature (209)..(209): n is a, c, g, or t
  misc_feature (224)..(224): n is a, c, g, or t
  misc_feature (240)..(241): n is a, c, g, or t
  misc_feature (264)..(264): n is a, c, g, or t
  misc_feature (275)..(275): n is a, c, g, or t
  misc_feature (291)..(291): n is a, c, g, or t
  misc_feature (296)..(296): n is a, c, g, or t
  misc_feature (384)..(386): n is a, c, g, or t
  misc_feature (394)..(396): n is a, c, g, or t
  misc_feature (416)..(417): n is a, c, g, or t
  misc_feature (434)..(434): n is a, c, g, or t
  misc_feature (451)..(451): n is a, c, g, or t
  misc_feature (485)..(485): n is a, c, g, or t
  misc_feature (582)..(582): n is a, c, g, or t
  misc_feature (584)..(584): n is a, c, g, or t
  misc_feature (677)..(677): n is a, c, g, or t
  misc_feature (735)..(735): n is a, c, g, or t
  misc_feature (748)..(748): n is a, c, g, or t
  misc_feature (755)..(755): n is a, c, g, or t
  misc_feature (830)..(830): n is a, c, g, or t
aggtgggtggtcaatcaagcagggcttggnccaaccagttatggcagatgaggtgtcccttgtcctgtggggactcactnctcctgggtgccccaggagatgttatgtctggccgtgtggccncntggtatctcattcgatgagctgctgcacaatctccctggatgtntccatctctatcaaagttttccttgaacatntcctccttncggaactgctccagnaaggcctcccgcttanncagtcttttcatactggcgacangttctctcgangagcgatgagattctngtgtngttggccatcatgagcccgctgacccggtgggccgtagtggcaggtagggagacttctctcgacatggtgctctacctggatgcttgnnnggccccannntatgaagttgtccaacttgnnttcccggatcctcttcnagctcttgttgacctgngtggggtccacctctccctggatgattttgatgntggcgatgtagcagtggttggtctggcggtctcggcctgtggacaccatcacgttctttggctgcagctgccgcctcattgacatccaggaccgtgntnttcctcacgctggccactgactggtccgtagtgagaggggtgtagccggtcatgaggaagtggagccgtggggtgggaatgagcgaggcgatnaggccgatgaggtcattgttcatgtagccagggtagcgcagggtggtggtgctggctngacatgatggtanacaccanctggttgatctgggagaaggatgggttctggatgtgcaggcggtctgtggcaatccggttcagggctgtgttgtnca

SEQ ID NO: 633766 - DNA, 1581 bp, Homo sapiens
  misc_feature (1101)..(1101): n is a, c, g, or t
agcgtgctacgacctgtggtggagcagcattttgtgtggcccccgtgaccgaagaaaggtggatggagtggagattctgttgccagaagtgttgtgtttggttgagtgtccgcctccccagcatgctgtgttggtgttgggggggatacaaccccctctcctcgcgggggggagagaagtgtctcccctttcttcgtcgtggtgagaaccccacggtggggatgatagtggggccgacctctctggtgggacgaccgccagagaagtgagacttcgtggggaagaacataaatgtggtgagacgcgattgaggcgttgtttgctggtgaatagttcaccggccgccgccaagactcggtttgaaggatgtggttggccccccccgccccccttggtgagttgtgggctccgcgcacccacaaagaccccgctgttagcaccgggaaccgccacatttttgtggagaggggcgcctgtgttcgcccttgcgagcattcggggagccctgtgttagagaggaggcccccccgcgtgttattgtccccgcgacagttaagagtgtggcgaaaggaagagttccgccacaggaggggaagttcttttttggtaagggggagtacaaaaacgaccgcgcttgggagtgtggagcctctttgttctcctcttataatatatggagcaatttggcccacctctggaaccccgcggagtttggtgccttaacaccccgtcttgtgtaaagaaacaccccacccccctgtttccccgcacacattgtggtccccccgtcgaagaactcggcgcccactcgttataagatctctaatgtgggccccctcctcccacagcgggggcttcgcgagagattgtatagcgtatatgggagaagagggttatagtgtttatatctcgcgagaggagagtttcgtcgaggatggctcttcgtgaaaaagaggtcgacacaccgagagactttgtccctccgtgtggcacccaccgcgttatatctcatggagatatatatgatatgtagaaagagcccactgcgaggggagaacactcttaagtgatataagagagagtgatttgagacgccacccnccacagagttctcgagaagagaagtgtgtggcttgtgttctggagaacccacgagagagttggtgagagcagatatgtgcactcttctctgctgcgagagctctggcacacttataccgctatattcccgcaaagaaagagaggggaaaagggctatatgaaagagtgtaatggagattaacgctgttcacaaagagaaattccacacaacactgagaggagaggagaagagaatggagctcgaatgagcgaccctcggtatgaatctctctaaccactttgaaagttgagtttttcacaatgctatactatatcccacgaagaaagtaaggaaagcactatcacaaacgtttaaactttatatttataaaaggtatataaatgtgaaaaacactataaaatatatttaaacttttttattgttttcttttcccctttcaccagtaacctttatggttaaatataaccattttccaaaga

SEQ ID NO: 633767 - DNA, 256 bp, Homo sapiens
tcagctcggcacctcttattcatcggcaccaggttggtctggaattctgtcggtcaacattcaggtctccatcaaatctcaggcaagcagtgatggaggacacaatctggctacactaaggcggttaaggttgacgtgtagagtaggcgcgctcgactatcgaaggtttctacggacagatgtcatacgatggcctcattgatctaccatgaagggcacaatacagagtagcgccagggttggtgatgggtggctg

SEQ ID NO: 633768 - DNA, 257 bp, Homo sapiens
gtgaccaagagctgacgtgtgcagaagtccttcttgtcctggtcgttgttcccgtctgagtaccagctccccactgcctaggcgggccggcctcgcggagggaaaaggagaggagaggaattgtccgatccctcagtggtccaagcttccgggtggccagtctttctgtagttgcgcaaacgcagcaaagagagaggatttatctatcggtgagtcgattgagtctctgagcgtgctcctgagcaggagagttctca

SEQ ID NO: 633769 - DNA, 213 bp, Homo sapiens
attttaatataatacagttccaatcagtgtataaggtgaacagtagctcataatgtgacaaatcggtgggcaaggagtgtttcagtttctcaatattctctatgacagtgacgttcagggagtaaaggtaggaattgcatcatactttgtacttaatcatgagcctagcgatgagtatgttggcagatgggtcatcccttctgtcgtcttctc

SEQ ID NO: 633770 - DNA, 185 bp, Homo sapiens
tgctgcggcgttctagaggatcccattatggacgtgaccataagcatgttctgaagttggtggcgccatcaaagccgccttggtcagggctaatgcgccctgaaggcagagtccaggaccttgacccagcccctctcagcagacgcttcatgataggaaggactgaaaagtcttgtggacacctg

SEQ ID NO: 633771 - DNA, 151 bp, Homo sapiens
  misc_feature (67)..(67): n is a, c, g, or t
aagcgggggattgttcacccactattagggccagacgaaaaccctactcccaggtcggacgaccgantggcacgtcaggtcttctacggacctccaccacgagccccctctggcttcgccctgcccaggcatagttcaccatctttcgggt

SEQ ID NO: 633772 - DNA, 577 bp, Homo sapiens
  misc_feature (9)..(9): n is a, c, g, or t
  misc_feature (25)..(25): n is a, c, g, or t
  misc_feature (73)..(73): n is a, c, g, or t
  misc_feature (178)..(178): n is a, c, g, or t
  misc_feature (194)..(194): n is a, c, g, or t
  misc_feature (213)..(213): n is a, c, g, or t
accggattnggtccatagggattcntggatccatatggaatccaaccggaaggggggaaaaaatatttaaaangacttaaaatgttaatggattgaggaactgttgtatagtggtatatgggaattctttggactaatcttgccaatttgtctgtatatttaaaattatttaaaatangatattaaaaggctanccttttaaaagtgagacanggaagtttcaaaactaggattcaaaacaacaaactgaaataagttagatctgagttgtctagaaaaacacataagccgggttcttactgacttttcaatgaacttcaaaacaggaacagacattttggttgcctattgataaatagaattatgatgatctgtggtttgaatttacttatagtctcattttggggttcttgtttctaacttatttacaactttgtaaactcaccatgattcatgacttctgattcatattgcctagtttatgagactgcattgaattcagaatgcgtgctgtgatgccaaatttattttactagtttcttattgaatatttaggactattgaattactttaagga

SEQ ID NO: 633773 - DNA, 328 bp, Homo sapiens
tagactaacgtgtatcaatatgtgagatccaggtagtgttatcttccaccagacaaggtcatgtttccctttacttgtacctgcaatgggctggtcgtttgtggttcgaagctgaccaccttagttccatcatggactgctttggattaatcttgggttgcagttttagtgtactttgtttgcccttcttggtaggatatggctctgcagagcttttatactctgcctgatatgtcatcgtgtttttagcaccagagaggactatagaaattcctgctcttcacagaatccttgtctgttcagcctcctgtactctttcgttttagaa

SEQ ID NO: 633774 - DNA, 181 bp, Homo sapiens
cacagtcatctcaacttccaatctatatattaaaatacttgcacacagtatctaactgaaatgtatgacatcatcatttgcatccccaattgcaaacaacatacaatccatcattttaacaacatttgagcacaatccaggggcaatttgcaatcactcaaatggcatatctgcattcaca

SEQ ID NO: 633775 - DNA, 208 bp, Homo sapiens
tccttggtctgtgcaagctacggtcgcgtcgctagattcccgtgccttgggcgatgtgggcagtgatgggtatggaagcattcgcggggttcctgcgaggcccaacggtccatccccatcttggactttgtggcagatgtggtgctgatgtgtgttgtcgacagcttggtgctatgtgctactggtttggtggtttgtgctgtggttc

SEQ ID NO: 633776 - DNA, 137 bp, Homo sapiens
gatcccccgctattggttgtgacagcacggcgggacgcacggtgctgtcggatgaatttgtgtctagtgtgtcgggtcatatccttgcatatctcattaaaccgaaccacagccctgtggagaggtactggggtccc

SEQ ID NO: 633777 - DNA, 873 bp, Homo sapiens
actatctttctattctcttttgtttatttctactctaatattttatttccttttgctagctttgggtttatttttttcttcttatggaattgtctttttatagttattttgtttgaaacaggatctaaaaataggtctatattttgcctgtggtgtatttcttcagtctccttaagtctataacatccccttttccttattttttatcatttatttgttcaagttatctgggtcatatgtcttaaaattttatacattttagattttggtgtcatttaacatgttcatattttctgtgagctcatagagctaaagctctctaaaggttagagctagaggctggttggattcaggttcaactttttcgctttttgggtaggaagaattcattgcttcactgatattaagattgacctgttggtccaggtgttgtcagcttgatccctccactagaaaattccacattatctttccatttaatgtttcagcagtcattggtgattgttgcctaatgtcattatttcactaaagattgcagaatagtgatttgtcacaaacaaaaacaaccccaaaaaaacttttggggcgcactaggcccttggaaaagtttttaaaacccattcgttggggcgcgggggcccattagtttacgttcgacacttggggccaaagcgcggtgccccccagaagaaaaaccctgggggaaaaaaaaaatgtgggcctggagttttctccccccaatataaaaaacccccggggggggaaccaccgaaggtctttttggaacacattcccaaatgggagtcacagagggccataacgcgaggctcttatacacaggaggttcacaaggagagagctcgaatttaaata

SEQ ID NO: 633778 - DNA, 315 bp, Homo sapiens
ttggacaaccctcgggtcaggtcaatgcctggagaccctgtagcaaatctgaacaaatcttcctaattagcacaccttcaaacaaaacctcattatttgactgcgtgcgataagtctggagaaaatacagtactggataggctgcgcatggtggctgtctccggtaatcccagcactttgggagactgaggcaggccgattacctaaggtcaggagtacaagaccagcctggccaacatggtgaaaccctgtctctactagaaatacaaaaatcagccgggcatggtcatgggtgcctgcaatcaagcctggaat

SEQ ID NO: 633779 - DNA, 324 bp, Homo sapiens
accaaatatggaccctactatgcaaacagggatacaaactatcgctgttcattatagctactctcataaccgtcaccacccactggccttttagccaaaaatgtgcccaaagccctactagattttgccgcctgccaagcaacggtgggccaatccctgctaaacgaaatctccaacacatatggcctagactacgtacataacctaaacctactccaatgctaaaactaatggtcccaacaattattttactaccactgacatgaggttccaaaaaacatataatttgaatcaacacaaccacccacagcctaattattagca

SEQ ID NO: 633780 - DNA, 938 bp, Homo sapiens
  misc_feature (220)..(220): n is a, c, g, or t
gggcgggatagggactggcagtcccctgacaccctaagagcggcatctgtcgatgttatttccccagcatggccgaaacagaagccctgtcgaggcttggggaagacttcagttgatgcagaataactccgtctttatggggcgccaggggagaagccggcggagtgctctagggaaatcctggagcagtgcctgtttctccaaagtcacgctcattggncgggaggaaagctcacccttcgaccgaggaagcttataaaatattgtgattcacgaagtggtgccctttgacaatgttggatgaactacgccttctgcctttcaaggtcatgatgtggattctgttgcctggtaccacccagagggcaacgctggggccggagggatattgtcgtgttgaccgagtattatgtgctgaagtcttgcagagttggcaaaagctggaggggtgcaaatttttcaagttttgctatcctctaaaggagctgatacatcaggcaattttcatatctacaaggtagggagaatgtagaagccagggttgaagaatccaattggatcgtacctctgtattagggctgagagtctgttatgtggtaggcaagaattctcgcccagtgtgaatgggtctggctagaagagttctttggctcctttaccagaacctctgggggccaggggggatttctgggtgctgtggtgaccgtggttagagcagctggaccaatgtggttgcacccgagaccacgcgatggacggtggaacacaggcatcatgacgggaggcctgggccctccaggctaacccatgcgagggggtttggcaccataccaccccacgtgttttggttcaaaccactgtagacgtgggcaacccgcacctcaccaaaaggcgcacgcgacgaataaacacagcaaagcccacacaagagggtcgca

SEQ ID NO: 633781 - DNA, 246 bp, Homo sapiens
  misc_feature (158)..(159): n is a, c, g, or t
  misc_feature (172)..(172): n is a, c, g, or t
  misc_feature (176)..(176): n is a, c, g, or t
agccgcgcagtgggcaacacgtgagagcgagcagttttatgtcacaggattcccaaaaagcagacacacattgtgcaggtcactgcagacgggaggtggtgatgaaataaggaagactgggttcaaagtctgtttaagacacggtccaggctgggcanngtggctcacgccngtantcccagcactttgggaggcccaggcgggcggatcatctgaggtcgggagattgagaccagcctggccaac

SEQ ID NO: 633782 - DNA, 371 bp, Homo sapiens
gcgccgaaccagcctctgactctgctgggctcccacatgcgcgcggctaccacttgcacatgtcaccactctgcacagcttccacccactccccacgagccaacgacacacagccagcaaccagcagctcaaggcgtcctggcaccagcaaactgcaaccacctcagcaacctggcaaacgggccttccagcagctagcgaaccagcaagctcataccttgcttctccttccttctaacactttacggccttgctaacaactgctgccctgacttgcctggcccctccttctacactaaccctggctccacgggcgcagctcctgactgcccttcttctggcactcacacctccgctcccggcacctcgac

SEQ ID NO: 633783 - DNA, 103 bp, Homo sapiens
ctatcaactaactcaaacaaatgatacccatacacaacactaggacgaactgatctcttatactagtcatcttaatcatttttattgggacaactaacctcct

SEQ ID NO: 633784 - DNA, 493 bp, Homo sapiens
  misc_feature (293)..(293): n is a, c, g, or t
  misc_feature (300)..(300): n is a, c, g, or t
  misc_feature (378)..(378): n is a, c, g, or t
cgtacaaaccccaattgaccccttaatttacaagacactaagggctcctcacccaaccccctttcgtaaggagttggcctgggtaaacagatcctcagcatttcaaaggagcctaattaactgataaggtacgaacaccaacaatatatgaagttcccaggaattttctccaagagataacaacataaaaccttgagttcgtgtctggcgtagaccctatatctaattataatgaaagatttagaatcttgcacctggtactgttgctcttcttgtaaccatttgtcttttangttgttnatcactctgtaaccattttgattcttttgattcttgcatgtttttacttctgtagaattattacatttaagtcccccnccccttcctaaacctaagtataaaagttaatcgagccccttcctcgtggccgaaagaattttgagcattagctgtctctttggccgccggcttaataaaggactcttaattcgtc

SEQ ID NO: 633785 - DNA, 206 bp, Homo sapiens
ccaggtggcaactaagtggctacaggagcacgtcctagctgattaccaaaacccccaagaatatgtaagaattcagctgccaggaacagacccccaatgggacctgaacaagagaccagacatggaaaggctaagacggtaccgtgagcattaatagaaggtctaaagaaaggggctcaaaagactacaaatgtaaataaggtctc

SEQ ID NO: 633786 - DNA, 92 bp, Homo sapiens
tgctgggattacaggcgtgagccaccacacccggccctcggcttttacaattttagaaaggcttaagcatcaaatccaaatttccacctctt

SEQ ID NO: 633787 - DNA, 402 bp, Homo sapiens
cgccctaagtcaacgctccattgactgaagacagtccctatgcctagaggggttgagcgttcttcctcctatgggttggaggagaccagggtgcctcttatctccttctagacggtctgcctctctggtacctcttggggggatcggcaaaacaggctacaccctgaggtcccatgtgccatgagtgtgcacatcatgcagtgtgtctgtgtagtagtgtgaatagtgagagagacacagccctcctttcagaaggaaaggggcctgagatgccagctgtgtctctgtgttaggggttgtgggtcggccccttctcagggaaaccgacgggcacgttccctctctggtgctgataatcggcgtcttagagaaataaaggtacgggtgggaccctcggtgcgt

SEQ ID NO: 633788 - DNA, 814 bp, Homo sapiens
  misc_feature (149)..(150): n is a, c, g, or t
  misc_feature (156)..(156): n is a, c, g, or t
  misc_feature (165)..(165): n is a, c, g, or t
  misc_feature (281)..(281): n is a, c, g, or t
  misc_feature (310)..(310): n is a, c, g, or t
  misc_feature (327)..(327): n is a, c, g, or t
  misc_feature (370)..(370): n is a, c, g, or t
  misc_feature (455)..(455): n is a, c, g, or t
  misc_feature (480)..(480): n is a, c, g, or t
  misc_feature (498)..(498): n is a, c, g, or t
tctccttattggagataagcgaaaagtgaaatatggacgaatcacgttcccccttcagccgcgaaactgatgggtcacagggttctggtactatgacatgtgcagtgctcacaagatgtcattccaaggcagcgactttgcatgtcttnngctaanatagctgtnggtaccatagcgaaatatactcaaaaagaacactgaaaggaatattcctttgacgctggtctttcaggacatgtagaatcttagataagtgaccttgattaagccaagaatatttnaatgtctttatatacacactggacaacanattttgtccttaaatantgtttgaaaataggtgaagatgtcctttgctgatgtggaaatnggtaaaggagaatgctgctttgcaaatgatctattctaactcagttcacagttgagaaaattaaagcccgttaggtccactctgntaaaataggactggctccaggattnccagctctggactaacanttagcctcctttgagccttaagtctggacatcttcattgtaatgggttttatttctgacaagtagaagggcatacatgttaagatgataggcagtataggatgttgttttttatttttttaattttttttgcagaaattctttcattagcatgaacgctgattataatgttactatacctggtactgagtctattttaaataattcacacatatcgaagaggcataagaatcatgttcgataatgatgtattatagacgaaacaactaagttttgtaatccatggatttatatgtggtatatcaacatgaatgctc

SEQ ID NO: 633789 - DNA, 975 bp, Homo sapiens
ttgtatctccctgctgattattctctccccccgagaactcttcgccaaagttgggtggttctcagtaagtttttgctgtctcggcccacctgtggtggccaccctccctcactttgggggcccgcgcattctactctggggggcctctttcttactgatgatgttccttggcacagccctttttccgggggccacacccctgttttttgtgggtgttgtgagcagcccaccacggggtgggtagccaaactaccaccttctttctcgcgggggcggttcttcttttgggggtcccccggcccgcctgcacccttggtggctgcgggggtgtacactagcacacattttgttcctttcgccgccattatgtggggggccttttcgctccctccctacggtgtatcatcatcaaggggggggtcacactcccccacggggggctttataattgtgggggctattctcgtcctcctgcgggagatttttctgcccccactcattggtgttccccccattttttctcgcggggacacccccccttgggggggttataccccttagtcttatgtttttgtcccaaggacctctcttacggcgatgtgtgtaaataatggcgctcctgtttctcttttagaggagcctctgcttgtcccccaggggggatttctccggggatattgtgtctttctccccccctccctcgggtgttctccttgtctatacgcccccggggtcaccactggttcttagagggtctacggcccttcttgggtcctatttgccgcatttcccctctcgtaataaaggtgggcgctctatcctcctccccccggagaatgttggttttgcaccttccccccttcttctgcgccccccagtggggagggggcccccccccgggttttaaatttttttaaaagggtttttaacccccggggaaaaaggggggggggaaaaaaaaaccctttttttata

SEQ ID NO: 633790 - DNA, 114 bp, Homo sapiens
ttggcacgaggaaggtcaccatatctgggcagcatgtcccaggcggaaggagtcacagagacaattaaccctgcttgtcgtaagctccctccttgtgacccgttgatgctgccg

SEQ ID NO: 633791 - DNA, 145 bp, Homo sapiens
tgcatagagttatgtctagggtgtagcctgagaatatggggaaatcatgtgaatgaatgcctcctatgtatggcaaatacatgactcctattgataggacatagttggaatgtgatgctacaatgtaataatgtgtctgtgtagt

SEQ ID NO: 633792 - DNA, 154 bp, Homo sapiens
cattattatacgatcgaaacttgtacaacaacaaaatggtgagggaacgttaggttgtttgtattagtgtaaaacaaaaggaaacacccacagtacggaattgaggtcccagatgttcgaagtgttcaagaattatgtcgatcgacttagtaaa

SEQ ID NO: 633793 - DNA, 261 bp, Homo sapiens
agaggagcgtaccggtatcccaccccgtacatagccaagtcactaacaatgttacttctataaaccaataacgaatttctgacagctttctatcagttccgtctgcctttcttttggcctttaaaaatatacttgtaactgcttctaattggagtgtatattcagggcagctttatagtccagggttgcaatcttcaagcgttggcccaaataaactctcttcttatattatgtttaccccacctttttccttttaggctc

SEQ ID NO: 633794 - DNA, 369 bp, Homo sapiens
aagggcagatttgactatttcactctccttaagcattttagggactcccttgatttataggattgagtccagcctccatcaaaagggacaaaagacctttttatgttttgattccggcttatgtctccatattttatttccattttatattttaggaaacaagagtttgtagaaacctgtaaatttttgttttgatgtaagtcattcctctgcccgcagggtccttttccaatttattttatgggggtaaagcctgctcatttttcaaagcgcagcccatttactgccttttccaggaagcttttttgaatcctccagtgagtaaggcaagtatcactttgggctcccatggcctccatgactttttca

SEQ ID NO: 633795 - DNA, 219 bp, Homo sapiens
tacatttacaatacgagattcaaacaaaatcacaccaacaaccaatttatgtcagattggcagcacaagaaacgcctctctgatttttgtggcagtgacgccccagaattgtgcaagagttagaaataattacataacgtaacactacacacaaacagcaacttcagtaatttttggttgcaacaggtaattaatgtcaacatctgtaaatacctttgg

SEQ ID NO: 633796 - DNA, 102 bp, Homo sapiens
cagaggccggacagccgcatctcatgattgcctgtatcccaaagaagggaaaggcttgtggccgggaaccagctggctgccatgctgatgatggagtgatag

SEQ ID NO: 633797 - DNA, 119 bp, Homo sapiens
tgaatgcaaaggacacaataatattttccaaagatccatgtgaaattgtctcccattttttggcttttgggggggttcagtttgggttgcttgtctgtcccaacggtgaccggcgactt

SEQ ID NO: 633798 - DNA, 181 bp, Homo sapiens
  misc_feature (18)..(18): n is a, c, g, or t
ttttgccaccttgagcantgcccggatcccgtgcaccctgggacccaaaagtgcccccgccatcccgccaccaggattgttccccgccagcaggtccagagcaatttaccccggccagccagccctttcacccgaggatccctaccccctggccccccaataaacatgatttgaagcagca

SEQ ID NO: 633799 - DNA, 215 bp, Homo sapiens
aaactaaattttttttccccggggcccccccccccccccggggggggggttgttttggggccccccccccccccggggttttttttaaaaaggggggggccgggggggcgggggggggcccctttttgcccccgggggaaatttttttttttttttttttggaaaaaaagggggggggttttggggaaaaaaccccgaaattttggggggtttta

SEQ ID NO: 633800 - DNA, 423 bp, Homo sapiens
tgatccggagcgacaaatacaagttggccgtatctgaccgggaaccgaataggtgtattttaccttgtagcttgagttcagcggaacacaaaatggcttggggttaagccagaaaggacagcgtaaagagcaagacaaaggcggtagccctgatgctgagagccgaattggacatccgaaagtgccgggttcatccatacctaaaatgtaggacgacctgccctggacctttgggcgcgactgctgctgtagacagagcagacgttctgcataccttaccgaaaaggacctgacctggaagaaaagtgcacaagactaacggtaatgcggataccactcgcacttgcatgtgtattccggaaagcacaatttataattgggaagaagggcaacataacaatgcctatgggcacctgggttcct

SEQ ID NO: 633801 - DNA, 493 bp, Homo sapiens
agcgtaaaacgacgcccagagaatccgaactactgctctatgttaccccccgctagaaaaacgcccccttgatgccagaattcttaatgcagggcagtgcgggagaataacagaaccaaaaattcctgtctgatagcattttcctcaattaatgcagctttatcctcttcatctttaattatttatatgtgtggctggatgttttgctgaatctttcatttatttccttcgaataatgcaataaatccccaggatctactgaaaccccataattagatccctcaaatttactgaaatttactatagacttattctcacagatgtaatgcccaagtgttcaatctatgacccattgtccctctcatagaaaacttggttatacaggcagacaccatggaggctcttgtctgcgtccagtttattcctaccaagagaggcactctctaggagagccccaacctgggaatcagttaggtcttggtgtgttgatcag

SEQ ID NO: 633802 - DNA, 359 bp, Homo sapiens
gccatatttctttctctctttctctcctgtagcctctctctcagtcaatatacttaatacatttaaaagtcagatacatagattgaggtgtgcgatacagttgcccgacattacaagataaattaatactgatgtaaggaccacatgaaagacactaatgtgatagactcacaatctgtaattccagtgcgtagagaggctgaagtgaaaagactgacttgaagccaagaaagtagaagctgcattgagccgagatcatgccactgctcaccaacctacgcggcagagagagaccatgtccccccccaaaacaaaacaagaacaaagccaaaaaaaaacaacaaagacatatcttgtag

SEQ ID NO: 633803 - DNA, 261 bp, Homo sapiens
ttagcatcctgatatctcatagatcatcccggaagatattgctcagcgccaggataatctctgcagcttataagtactctttttggtaagtatcttctgttataacctagatcctcagaactcactggtacactatgcggatatagattgttggctctcataacatcctctcggctttttcatgcttttgaactgaacacatgccttgaagggagctggaacaaatcacacagtactgacagaaatttattgcttccagga

SEQ ID NO: 633804 - DNA, 110 bp, Homo sapiens
cgcatttcgaatagaggagggtggtcgtccatcttcttgtccttcagcctgtgggtgatgtgcggtagtgcatgccttccctgcccatgggcctccccagaatgccactc

SEQ ID NO: 633805 - DNA, 864 bp, Homo sapiens
  misc_feature (393)..(393): n is a, c, g, or t
tggcaaacccccccgccgagaaaacccgggtactataacccagggtcaacccccccgggtcctccaacttattgccgtcaaccggccaacccctgtgggccgggtcccctttgagcctgttggcagaacaaggtccccaaagaacagccaaaaatattttccgttgccttctgaagccatcgggaagaaaaagaggtattgggtttataagggtccctcgtctttacacagaatattatatcccgagggttatatgttgtccagggtggttgaatcttccacagcgccctaatatatgcggccaatctggtgtgggcatatgtccctatctctatatgggggagaagatatactttgagacaattatttcgacaaatcttcactatcctctanaaagcctataacagggtgtccctgggctatctcttgtgtccactatggtgcaatatgcgctggagccccaccaccaccatatatgtgtgtcccccccatgttttactcatctctcgtgcactgtcgcccaaaaacactgtgaggtgtgcgttgcaggagtatttgagaccaacgccactgtgtgtggtgtgttgtgtgcgcacacatgttgtagaaaaagaacgcgcgatagtcgaacatactctgtgtgtggagaccgcgccccatgtgtgacgcccgctatgtgtggggtctccccagaggatatgtgcggtagacagaaccccactgcacaggaaaagattccacccattttggcgtgccctgtgtgtggcaccaaactctcggaaatttataagtttgagacccctgtgtgttgctttactacctcttttatccccccccaagaatttaattctccctttccgtgat

SEQ ID NO: 633806 - DNA, 104 bp, Homo sapiens
tgactacgagtttgcttaaaatgcagtaggggagccaggagcagactcaatgaagtttgccaactgaggcaccgcttagaccagtccgtaccttgactctcgct

SEQ ID NO: 633807 - DNA, 1046 bp, Homo sapiens
tccccccttaattccctttattttttttggtataaaacccctttttggtccccccgaggggggcccggaccccggggcccgggaaaccccggggggggtgtctggaaagggtggtgccaggtgagacctcctcgtataggggaaatctgggggagattccaggttccttttctctccacaagagtgtgggggtgtccagtgaacgctagtagtgtcctacaaaaatgtgggccatcaaagggtgtcgctctaggagcagaatgtgtcgccacatgatgtgggcatgtggacacccccggtgctatagtgttgtacaaagcataatctcgagatctcacccacgcaccatatcatagtagagcgacaccgtctctctatataagcggcaccagtgggtgtgcgagagaaaaacaatcgtcgccagaggtcgccgcctgcgtggtctcgctagaggagatctagagtgagcggatcccccaacgacaacaaaaacgcccgcgaaagcgggcgcctagtggtccaccctgtgtgacaaagggggagacacgacgtgagttggggggagccttgagccagagatctctgtgtggtcccccccacagatatatcgccttctggtgcgccgcgtgggagccctcattggagaagacactttggcgcccagtagtgttattgattggcgctccccctgggtgtggtggggggggggtcgaccaccttcttgtggtgagtgccttttaaaccaccataaagcgcggagtgtggcggccactggtgagcccccgcgagtaaacaacaaaagtggccttgtgaacacctgggtggacgctggaagccggaacagagtaatacggagctctgcgagggggggaataaatccttcaaaaacgctctctctctggggaaaagagggcccgccgaggaaagaagaaccagaagatcctcgagacgcccaacagggggcgggaagaaagaaaagcagatccgcccgcgggagatgagatgactagctctggcaacaaggggcccattggtggaggggcacc

SEQ ID NO: 633808 - DNA, 711 bp, Homo sapiens
ggcaatgacaccccgccctaggacgggaggaagacccccttttggggagacctcttaaaattttagttagaacgccccaccccgtgtatccctgtacccaaacacccccacagggtccccctatagacagttccccaaacacgtgcccactttgtagaataattttctgtgttttgtgggcggaaccctctgggggagaccagagtaccccccacacttcctcggacgccagttaaccatagcataaaggacattctgcacccagtgctcaaagcgggacatttacttatatacctccaatgtggatccccccatatagacactgtgggacaccaaccggggcaccacaggtttacccattaggagggtaacaccagcgcgccaatctccttatttattagagtccccataatcaccaccaatagggtgttacagacctctgatgttggagtcaaggacatctcccgagtggtgccacacccgcgtattataaggttctgtttgttcaacgatttaagtcctaccgtgatctgagttcagacccggggttatccccggtccggtttcttatcttacacttccaaattctcctcccctgtaccgaaaggaccagagaaataaggcctactttacaaagcgcctttccccgttaatgatatctatttccacttaggattaaacccccaccccccccaggacagggttttttta

SEQ ID NO: 633809 - DNA, 190 bp, Homo sapiens
tacgtgatcccgtctgatagtcaacagcatgcgttcatcttccctaaccagtatggacctagtgttggctaccttgtggcacatcatcagactcctacagccaaatagtacaggcaggggccatatcaccaccgagatagcagtctcacttctccaatgccacgtgaacttgtactccaaattacagtcc

SEQ ID NO: 633810 - DNA, 396 bp, Homo sapiens
agaggatcccgtgctgcacaaaggatgcaacacctaaacttacgccggccctgccctgccaggtctacgtgaatcatggcgagaacctgaagacggagcagtggccccagaagctgatcctgcagctcatcccccagcagctgctgaccaccctgggccctttgttccggaactcaaggatggtccagttccatttcatcaacaaggacctggagtctctcaaaggcctctaacgcatcatgggcaacggcttcgcgggctgcgtgcccttcccccacacggcgccctgtgaggtgcgcgtgctcatgctcctgtactcgtccaagaagaagatcttcatgggcctcatcccctacgaccagagcggcttcgtcaacggcatcctttgtggcagca

SEQ ID NO: 633811 - DNA, 771 bp, Homo sapiens
cttccgtggacactatgaagtataggatttaaagccaaatggcaaagttgcatccgtggcacatggttaaatcatcatcactgtcgggcatgaacccctgcacgccctctcatgacaatgtggagaaactctttccaggttttgagatagaaactgtgaagcaacaacctcaggatccttttataatcaatgctgtcaaagcaaacgtttagatgacagcaccagcaaggcattggcatgccttttcatccagggggcttggcatcccagcttggttgctagccaaatctgttgcaagcagctgaagagaagcccaagtacagtatccatctccagacatttgcaagttggcatggacagacagccccgatttactggctgctagaaaggtggcagatcatattggcagtgaacattatgaagtccttatataactctagaggaaggcattcaggctctggatgcaagtcatattttaccttggaaacttatgacattacaacagttcagtgcttcagtcaggtatgtcatttaattatccaagtatatccggaagaaccacagatagcgtggtgatcattctactggagaaggatccagatgaacttacgcacaggacacatatatttccacaaggatcctttctactgcaaaaagccgaggaggaaagtgaccggttcatgagggtaactctatacggtaagatgtactacgcggcacatcgaactactgatgaccctggatcttgaaatgagagtcccattactagaa

SEQ ID NO: 633812 - DNA, 473 bp, Homo sapiens
gctctttgttctgaaatgtcttcatcagtgaaagttgaagagatatgctcagctgggatacagtgaactcaatctactcctccaggactggatctgcagaactcagatctaccttccatgacagcttctggccgttggcatacagagctctcctctctctctgcacgtagcttgtcactcactcagcttgtattgatggggtggggcagtctcagattgttttataggtgcaattatttaacttctttagatgagggttgtgctttatgttactctctgaagcctcatttatttgccacatggtgggtacatgaagatacatgctaaatgaaagttgtgcaaagagctctgaacttggaggcagatgaccttggacttttactcagtctgtgttacacatgagcttggataagactgatctttcagctttcttcagaccttaagcatgagatataaaacaagtagaacatata

SEQ ID NO: 633813 - DNA, 161 bp, Homo sapiens
ccccccccccatcattgtttttaaaaaattaaggcctggcgcagcagctcatgcctataatcccagcactttgggaggctgaggcgggcggatcacttgaggccaggagtttgagaccagcccaggcaacatagcaaaaccccattatgctttaaaaaaaa

SEQ ID NO: 633814 - DNA, 429 bp, Homo sapiens
  misc_feature (1)..(1): n is a, c, g, or t
nattacttcctggagaagccaaagggcgctcccctaagaggcctggatgtgaaggtagagtgagacgccctgggctctgggtgcaaaggtcggcgcctgccgctttcaacactcaggaggcgcgtatcagccccgctggcccccggccgcagactcggagcgctgagctcccaccggttcccatcacccgactcacttcccaggcatgattagcacccgggaagctatcagccactacacgaaggaggcgccaagcccaaaactcctccccagctaacggcggggtctgtgcagagcccgcgggaggggcacacattgaaccctggcacgcagcctcaggcaggggcaggctggaaatgaccctgccctgcagctgggccaatcagcctagacacctgccccctaacgctataaactgggggtacccga

SEQ ID NO: 633815 - DNA, 182 bp, Homo sapiens
  misc_feature (5)..(5): n is a, c, g, or t
  misc_feature (10)..(10): n is a, c, g, or t
gaganacatnagttagaggatgtggaagaatatgtgggtacagagtaggtatcgttggaaagagcggagtactcggtggtgaatgagcaaaaaagggtactcactgtgtagagttatgctgccaaagaaatatgcctcagccgtaccttcaaaacataacggcatgagaggtcggccggggg

SEQ ID NO: 633816 - DNA, 726 bp, Homo sapiens
ggccagtgctgcgcgggaaggcaccagcaccacagccgccgccgctggccagggtgctggacaagacgggcccgtcgggcacctcgccaggtcaggcacccgctgcagccgtcgctgtctcctcccagaccggtccccatggagggagatggaagaggagttgaaatgccccgtgtgcggctccttctatctgggagcgccatcatcgctgccctgctcatcacatattgtagtgtcaagtgctgtgcgcccgcaatcatcgctggtgcgagaccccgagtagtctgagatccccccaggagccgatcgggccgcgggctccggggtctccgactatgactatctggacctgggacaagactgacgcctataccatgctgaggcgtgaccacgctggctagtggctcctacggggggttcgccagtcgcccccactatccccgtggcagaagtcccccaagcggcgtccgcgtgtttcccccgggctctgccagcatccgtacagtccagcttgtcatgcggccctggggcccggtgccccgcaagctcctgtatcacctgcccccagtgtcaccgcagcctcatcctggatgaccgggggctccgcggtttccccaagaatcgcgtactggaaggggtaattgaccgctaccagcagagcaaagccgcggcctcaagtgccagctctgcgagaaggcgcccaaggaagccacgtcatgtgcgaaa

SEQ ID NO: 633817 - DNA, 1050 bp, Homo sapiens
agcggagcgtgccgattctgcatagagagatcatctaaatgggcagaagcctgcacaatttatgaagtgctgatttaacaccagcctatgcaaggctggactgtttagaaagaagtgatgcactcaattctgcaatagataaaatgaccaagaagaccagggacttgttttatacgctccgcaaagctgtcatggaccacgtctcagattctttcctggaaaccaagtgtaccactttgggtactgatagaagctgcaaagaatggaactgacgaaagaagttaaggagtatgcccaagtataccgtgaacatgccaacaaatggatcgaggttgccaatcttggcctgtaccatctcaaataactgaagaaggtgtaacagcttgtccgaatgtctgcaagccagttagaaagccctctgttcctcgagggtatattaatgctgcactggcctttagtcagcaaagcaccaccagagtaaactggcccaaagaaaacatggatctatagacacaggaacaatgggacaaacaagctccgagtcacacacagatagctgacgatgacacttactctcccaatgactgacttcctgggctggcctcacgagaatcacatggccggaagatgtgacacaaaatggtgtccaatgggctactcccaagagaaccgaaactgagatgggcctcggacccgcgacagccctggcgcgcacttcgacggcccggcgacatgacccggggtacacttccacgctactcaaccctcaggaccactggcaccatctatgagcccaaggagaggttcctaaccaccacccggagcgaacagagcgtcgaaaagaaaaaagccccaacaatagccttggccacctacaagacgcgagaaccaatgaccaccgcataatcacctaggagacgaacgtgcgaaagcaacctcagacggcaacgaccccaccaaagctcacgcaaacgcctaacccagcgcccactgggaataacgaacaagggctacaccgaagagcgaccgcacgcgccgtgatcaaccgag

SEQ ID NO: 633818 - DNA, 621 bp, Homo sapiens
ggaataatgaagattataagaaaaccaagcgccaggcacggtggactcaagcctgtaatcccagcactctgggaggctggggtgggtggatcactcaaggtcaggagttcgagaccagcctggccaacatggagaaaccccatctctactaaaaatacaacaaattagctaggcgtgggagcgggcgtctgtaatcccagctacttgggaggctgagagcaggagaatcatttgaacccaggaggtggaagttgcagtgagctcagatcgcaccattgcactccagcctgggtaacaagaatgaaactccatctcaaaaaaaaagaaaaagaaaagaaagaaaaccaaggtccctctccctctccctctccccacgggctccctctaccctctctttccatggtcacggtctccctctgatgccgagccgaagctggactgtactgctgccatctcggctcaggtgcaaaactccctgcctgattcatcctgctcagcatgacgagtgcctgcgattgcaggcgcgcgccgacaagactgacatggtttcgtattattagggtggagacggggtatcacatgtgttggacgggtggtctccagatcgtaacgagagtgatc

SEQ ID NO: 633819 - DNA, 463 bp, Homo sapiens
gataatataatcttatatgcagaaaatcctaaggattcgaccaaaaagctgttagaactaataaacccagcaaagtagcaggatacaaagtcaaagctcaaaaatcagttgcacttctatacactaacagtgatcaatctgaaaagaaaattaagagaatagtttcatttacaataccatcaaaaagaataaattaattaggaattaacttaaccaccagaaggtgaaatacttgcactacaaaactacaaaactgcaaaacatttctgaaagaaattaaagaagaacagaataatgggaagacatcccaggctccctaggttggaagacttaatactatccaaaccaacctacagatttaatgcaattcctatcaaaatcccaatgactttttgtagaaatagaaaaactcatcctaaagttcatatggaaactcaagggatcctgaatagcaaaaaaaaaa

SEQ ID NO: 633820 - DNA, 414 bp, Homo sapiens
gcctgccggatgcacactgcacactacgtcaaataggagtggtgagagagggcacctgtcttgtgccagttttcaaagggaatgcttccagtttttgcccattcagtatgatattggctgtgggtttgtcataaatagctcttattattttgagatacgttccatcaatacctagtttattaaaagtttttagcaagaagggctgttgaattttttttttttttttttggagacggagtctcactctgtcacccagggctgggatgtgcaggggtgctatctcgggctcactggcaagctccgcctcttgggtgttcatggcggttctcctggcctcaagctctcccgattgggctggggactacagggcgcccggccatttacgcctgggctaattttttggtattttacagt

SEQ ID NO: 633821 - DNA, 279 bp, Homo sapiens
  misc_feature (7)..(7): n is a, c, g, or t
  misc_feature (73)..(73): n is a, c, g, or t
  misc_feature (98)..(98): n is a, c, g, or t
  misc_feature (106)..(106): n is a, c, g, or t
  misc_feature (111)..(111): n is a, c, g, or t
  misc_feature (118)..(119): n is a, c, g, or t
  misc_feature (130)..(131): n is a, c, g, or t
  misc_feature (144)..(144): n is a, c, g, or t
  misc_feature (149)..(149): n is a, c, g, or t
  misc_feature (168)..(168): n is a, c, g, or t
  misc_feature (206)..(206): n is a, c, g, or t
  misc_feature (239)..(239): n is a, c, g, or t
  misc_feature (242)..(242): n is a, c, g, or t
  misc_feature (273)..(273): n is a, c, g, or t
tgggcgnggtcccggtgtatggggacgccccggagcccgccgctttggatcccagatcggcacccccgtcacngtcagcacggtgatcagcaatccgngcaggcanacganccattgnnaggccgtgccnnacacgcgcgccangtgtnatgcatagagccagctctngaccgtgttgccgacgtgctcgcccgtcgggcggaacnatctgatttcctcgccggtgtctccgtcaaacnggncggacgtgcttcctcctttgggggcacgctngaagaa

SEQ ID NO: 633822 - DNA, 83 bp, Homo sapiens
cacgaggtccccggctgaagttttctgagattccccagcgcctcacagccctgctattgcccccccgacccaattgtaagaaa

SEQ ID NO: 633823 - DNA, 305 bp, Homo sapiens
  misc_feature (26)..(26): n is a, c, g, or t
  misc_feature (33)..(33): n is a, c, g, or t
  misc_feature (302)..(302): n is a, c, g, or t
ccaacacaccaaaatggacacatgtnatacatncgaaacaaatctgcacattgtgcaacatgtaccctagtactttaagtataataaaaaaaagaaaaaagaaatcaagacaagaaatttattcaaaatcatacaattacatgaaaattcaataacctgctcctgaatgacttttggataagtaaggaaattatgggcagaaatcaagaaattctttgaaacttaatgagaacaaagatacaacataccagcatctctgggacacagctaaggcagtgttaaggtggaaatttatagtactnaaa

SEQ ID NO: 633824 - DNA, 135 bp, Homo sapiens
acaaaacctcacacactgatactatacacacacacacacacacacacttatatatataaacaagtctatgtatatatacacacacacacataaacacagacttgctttatagatatatcacatggccactcaata

SEQ ID NO: 633825 - DNA, 1556 bp, Homo sapiens
  misc_feature (1339)..(1339): n is a, c, g, or t
  misc_feature (1481)..(1481): n is a, c, g, or t
ggccagcatgatccggtgggcccccagagcgtctcctggacagagcccagtcaccctggacgagctcttcgcgtagcctcagaccgtccttgtaaagaggtatgactgcagccgattatgggcctacgcgctgtagtgtcgtgcgtctcggggaactgtcatcattgagaataagcgctagctcttcatccagagaactgggcgcgagggatgggattcagcatatgctggacactagttggataccggtaacaggtgaatggaccagcttcgtagcgcctgtgaatagcgatagtcctgttgtcactgagcaggccggactcagggagggagtgcccatgcgagcaaagtgccgataactgtcattcgagcatcatttcaattctactccgcaacaagtccgtgtcgcgcatcgttgagctttcatctgtgcttgagggggagacggcgtggtagcgtagagaccacttgcacggccttggtgccttgcagtgctctcacccaattccttcatgagcaggcaggctcacagccatgtaggctagatgaagtattagacactacggcatggagagagcactcacaaggagcgcacattccatggtacccgtaggtgatccccaatcccttgttgggcgtggcgtggcatcgcgggggattcgttggcattcaagtgcccatttggaacgtgtcccaatttcgagtgggcgccaataggggcgttggagttgcccccaatcggagtaagtacctttcgcaatgggcacacaaaccaagttaatatttgggcttcggggaaggaactagaagggggcgacacgaaccaaggtggctttagacttcgcggccatctcttggggggggtttttctcctatgggggagaagttccatcacggtcatttgggaatactcgcattggtctgggcaagggggggggtcccccttggccccatggggcctgcctaggaaacagctttggcgtgggggtaccctcggggggccaggccccatatggcggtgtgtggtgcaaccacgagttcgttccctttgtaccaggatgggccgccccaggaaggcgtcccttcgtagccgtgggctgcgcaggaaggtcataaccctgggtgcttcgaagtccgaacggtgaagccgaggacacactgggcctgagtcacgcgtggctcccccgataggagccagggggctagaccaatagtgtggcgccgggacctggttcatgggggaggaaaagagggcgccccaatagtaacatgggtgggggcccccaccaaacggcggtgtcgtaaaagtacggtcacccggtgtgggggggcgaagacnccccacttggggggtgctgcacatagagagggcaccagacttctactcaagaacatgcggcaggcgcctaacaaaagaccgagacaccaggagggacacgcagagcacgcgcgtcaaccaactgcgcgtctcctcagcagcnacagtggagcgggcagctcgacaccaccagagtggttggcacaccacacccacgtgacacgacagtagcagtggc

SEQ ID NO: 633826 - DNA, 495 bp, Homo sapiens
tttacggtgctcaccaccacacccagctaatttttgtatttttagtggagatgggtttcaccacgttggccaggctggtcttgaactcctgacctcaagtgatccgcccaccttggcctcccaaagtgctggaattacaggcatgagccaccacacccagctgttgttgcagtttggagtctacccagtcctccaacaataacccctctgaggcccatgaaagccctgggctcagccagagttgagcagatgagggaacaaccagctgcagagaggagccaccttctctgctgagaacttcagagatctgcagagaccaccaaatgaccaaatgacctgcctgcagggaggaactaccctctccaagggcctcctctctgctgagcactgaacactgagggtatgacctgcctgcctacagaggggagctacccactgtgggtctcctctgagctgttctaacactaaataaagctcctcttcatcttcttcacc

SEQ ID NO: 633827 - DNA, 374 bp, Homo sapiens
tcagatccccgccgtgctcccctctggtcgcgctcgtctggttgtaacgtgcctggcgtgagcgtgggcagctgaatgcatgggcgcatatcgaccctgtgggggtttccgagctgcgattggctcttggcgttctttacctggtttctctgaggtcttgccgccctggtgcagatcatatgctgcctcgggcccttattcccgagagtgcagacgtgggcgccaaggtcgtggtcgaaacggaacggagccctcatggactccagggtccgaagttccctcgggaaaccagcaggaggtgggaaaagagccccattagggcagtagatggagcaacagcactgagtgagattccagggggccacagcaatggg

SEQ ID NO: 633828 - DNA, 196 bp, Homo sapiens
ctccaagaatgtttagggccgtagctgggtggtccccaataaagaaaacccacatggctgtgtttttggagcgacccaaggcacaggatacaaacctgtccatgccccaattattgcatttattaggacgccctgattaaaattttgttttcccctgagaagacatttatttttcaataaattcagggaaccctta

SEQ ID NO: 633829 - DNA, 967 bp, Homo sapiens
gctgtagagggcggctcgcggcgggcagtggcggcacgaatgtcggctaccagggctactttagccatacctcggcaagcgagccaatttccacctctgtgtgctgtacgagctcactgaaacgtgttcgtgaagagcgaagacttttcgctcccagccttatatggatcgcgcgtgaccaccccttgccggcaggtggcccatgtcaagcacctgtctgccagccagaaggccactgaaggacgacaggacgaaggccctcctggagcagccctctcccaatggatgcagaaacgctccacgctcgcactcgcccctccaccccctcacaggcccgagcccccggccgacacacgacaccccggcgcgcccccgacacgcacctcggcacacacgggcggcgcggccgcgcgcccaccgcacccccccccggtccccaccgccgccccgcccatccaacgcgcccccccaaccccacccactgatcgcaaccgggcccccccctccccgcccacacgccccacggcaccacccgcacgcgccgctgcgctcgccaccccgacccacgcgacgcactgcccggcaccacttgaccaccgctgaccccccccaggcccagcgccctataccccactccccacgctgggcgacctaaccgacaccaccacaccgacgcccgcaacccacgttgacgcacactgcacgccccatgccccccctggcaccctcgcccccctgcgccacagcacccccggccccatgcccacacctccccgctggcgcccgagtccaacctggcgaaaccccctggaacgacgcccaaccaacacgcgtggatcccacagctggtaaacacaaccgctaccagtcgtacaccaaccaaacaccagagcacaacaaaagaaccagcaacgccagagagcgcagtcacacaagcgccgcctagaacaacacgtcacaacagcat

SEQ ID NO: 633830 - DNA, 154 bp, Homo sapiens
tgaaccgagtccccgatcgatggcgcactcgttcacgaatccgactaggtaatcattaggttgtgggttcgttcccctgcacattgctcatctgggttcccagatccggcgttgtcgctgagctcgaatgctatgttcgctggccctgcccgta

SEQ ID NO: 633831 - DNA, 358 bp, Homo sapiens
ggatgagctgggcaaagctccagagaccagtgtgcccgggggttcccaaatttcagccggtttttatacaccacctctataatttggctacatctggcacggcctatatcccagttgccggaattacttccttggaatcaactaatttttaagttcagtaaatgtattttaaaaagacacggtttcacggtgggaaagggaaactcagtatcacttcaccagagatagaaagtaacggtaaaaataaatacaagggaaacaaaagggtgtcatccaattctatctagatccttcggctggcctaggctctcaggggagagtagcaatgggccgggggttaagaggggtacggagctcg

SEQ ID NO: 633832 - DNA, 991 bp, Homo sapiens
ttttgctcggatgggatacccgcaccgccggaggttgtgcggtccccccactataatatctcgtgggggggctccccacgaaaagtcttttttttcgttgctgcggaagaaacacatgctatagtcctctgtcgctgtacatgcggagggaagaatattgttttactggcccgtgctcttaaaaaaaaggggggtgtgctggtaacccctctggtgtatggaggccaacgccccacaaggggggggtttaattccccccgcggttgtggcgaccagagagaagtgcttgatagaccgcctttgggacggccacacaaaaagccaatcctttgagggcggctccctccgccgtcaatcgctacacttttttgggccggaccacttccgccccggaccggaaggaagaactactttctttgtgggaacgcccgctgggcttgcttaaacgaccccgcgtgttgttgtcgggataagacaccaactggtttctatggcgctgcgcgccacggttgcgaaagaagttacctttccctctcgcttgatctgcactggtaggctactcgcgtttttccgccaccgcataccttggcgggtcgacccacacaagtggcttctgcccccagttgcccgggggacctcttctccactcgatggcggctgcggcgagaccaccactgctgtgtggtgttcaaacaggcaggcccaaccccactgatggcgccgcccccctcttccttgggcaaaagcctggcggggacacctgggatacattctagcacccacggcgggaatccgccaagacctggggtgagggaatcaaacgtgctcctctcacggacttgcgtttagaggtgtggagcgcgcggggaggcacactcacaacaccgcggtgtctattgcccctcgccttagaacaaattagaaggggcttttcttatatatctctgctccttcaaagatcccagaattcaccccaacaaaaacacccatg

SEQ ID NO: 633833 - DNA, 169 bp, Homo sapiens
caccgggagctggaagagaaaggaagggaagggaagggaagggagggaagggagggaagggaaggaagggaggaaggagtaatgtatgtcttgcttaacgtacatatacctagatttgattatatcatattagtagtctatttacagagataaaatacactgtagcttc

SEQ ID NO: 633834 - DNA, 1060 bp, Homo sapiens
cgtagggtattaacccgcccctccggtttagcgggatctgattatactccttgacctttctggctgatgtactgagggcacctgagacagagtgtgtcggtgtgaaccagtggtggtgcagtgtccctccaaccacacagcactgactcctgggactctgaagaatcacagaaacactttttatataaaataagaattataccatagcaacaaaaaaaaaaaaaagacaaaaaacaaaaaacaaaaaaaacaaacaaagggcgacaacacaaaaaaaaaaaaaacaaaaaaaaagaaaaaaaaacaaggcacggcgggcgcgcccggcgacacacaccaggccacctcgagggcccgccagtcacgcagacaacagaagccaagagaagtgaagggccaccagtcgaacgcctcatgagtacgggaagggatgcgagacaacgtgcagtaagagtaaacagagggctacaagtggaggtcaggcgtctattcgtgaaaagaagcgatgagggcgagagaagagcgtagtagtagcgtaggcgggacagacagcagtacccgtgacagctgaagtacaagcgcgagatggcgaggtgcgaggacaggcgcgcggtacagaggaaacgacacaggggggcaaaggagcagacagacgcgccagcgacacatcaaggaaggcagcacggaaaggagacaacacacagacagagggcgaggagagggaggaaaagcgacgggacgaaacaaagaaggggagcataggagaaggaggaacagcgagggtgacgaaaccaaacgagaagagccgagcaggaagcagagagcacgcggggggacagaagaggaagcacaggccaaagaaactccacgccagagggcagaagaacagatagaacagagcagactgaaggaagcgggacagcaacgcgaacaggagaaagcggagcacgcagcagaccgagagaggagaggcgaagaacagagcaccaacgcgagcgggaagaggacggacgcacgggaacagggggagcagagcgagcgcaaggacagcggcgcgcac

SEQ ID NO: 633835 - DNA, 142 bp, Homo sapiens
atccaaagaattcaggcacgaggccgggctgaagaggagcgtggctgtctcctctctccggcataggcgtgtaatcgcccaatgatatccggtgtactccgaaaagggggagatcatcaagcaaaaaagtaacttaaactga

SEQ ID NO: 633836 - DNA, 1340 bp, Homo sapiens
gctgaagcaggcgctcttgggctcggcgcggccgtctgcaatccgtaggaggagacgcgccgccgcagccaccatcatgcctggggcatccttacaggcaaggcttcggatgcggtggtcaccataccgattcgagccatgttatttgaccggactgatagtcgtgacccctttcgaggtgctgacaggcacgcagagaaacagggaaaagaacgaacgtccggcgggaagcggcgcttgtgcgggccctgagggccatgcatgcgcacgtgtcaggccgtcggcgcaggacctaacttcctagactgcgcgctagggcggagacattctcgtcgcaaggtacgtcccaggatacagagcgcaagatcccgggtgatcgcccagcagtgtggtgttggttcgacagaagaatcgaggagaccgccagcgctgctccgtggcgcttgagcaatagaaagcgaataaagaccgatgtatggaacagaatgactcgtggactcattcagatcttgcagtggctgacattcggcagaccattacctttggactacgagagaatcaggagcaagggtgaacgcagccctccgttgtagaccagatagcaatatcgagaggcagccacacatgtgcctgtaccaaagggttgtacacggccgggtgcaatacagtaagagcgggctaccgtaactatgtaccccggcatattcacttggaacacggtccacataagtcctggcacagactctgtccgcacgtgttgcttcggtgtccctgaacggttcccgccacaggggcgaaggccccgtgggaaaacctgcctgttgcaagaagggcgacccagatagtgaacaggcaattgtgttcttcccgcacttcattccttgccggacgcgaaagcgtatgaatacttggcgaaataagtgcacttctcggtgcaacacgctgggtattgaagataccctcccaacgttcgtagaaccagcgttatcggtaccattatcaggtatgggggatggaaacccggcggcgtcggttcttagcaattagcacatatgaattaagacaacggctaggaacacttaatttacccgtaacattaccggttggaacattcggcgtatgatacaccccaaaagaggtagtgtgcccctatgaagcgccaccagggacagtgggaatacggaagagatatacacaggagggatttagtgcacagggttaggtcgaagcacttcccctagaagaaacagtttaacaggccgaacattaaaaagcgccaaaagagggcccgtgtaatgccattaggggagaggagttcctcaccaggggagagcattacg

SEQ ID NO: 633837 - DNA, 186 bp, Homo sapiens
gagatgcagcgtgacatagcatgcggcgagtatcatcgagacatgccgagttctcgcgggaccctgcactggcacgagcaaggtggcggtgcaggctgtgcaggccatgaaccgcatctgtgtgctggccgtggacctgcagcgtgtgcggcacatcaaggccaccgatctgcggcccatctacat

SEQ ID NO: 633838 - DNA, 265 bp, Homo sapiens
atcccggacactgttaggggcagtactctaaacagacaataaagtatagaagaggaatttctggcaacagcaagaatgatgcaagacaagagaaaagaaaataaagcaacagaaaatggggaaacaagtaagtaaacacaaacacattttcgtttttgttctctaaattttctgcaggagtttcaaattgctcaactggccatcgctaatattaaggaggaaagagatctagggaatgaggcaaaaaataacattcttctctggt

SEQ ID NO: 633839 - DNA, 120 bp, Homo sapiens
cggctccctgacatgtgctgggattacaggtgtgaaccactgtgcctggccaaaattaacttcttaaagatgctttatctttgtcttgtatctccagtaccccacaataccctggggtgt

SEQ ID NO: 633840 - DNA, 489 bp, Homo sapiens
accttaagtagatgtgagtccttatgtataaggtgagtctctgaatacagcagatacttggttggtggattttatcgatcctgccattctgtatcttttaagtggaacatttaggccatttacgttcattagtattaagatgtgaagcactgttatatgcatcatgctagttgttgcttgaataccttgttttttccccccattgtcagttattgctttccctgtgagatttatgctttaagaaggttttattttggtgtacttcgaggtttggtttcaagatttagaactcctatagcatttcttgtagtgctggcttggaagtggtaaattctgtcagcatttgtctgaaaaataatttatctctccttcatttatgaaccttaggattgctggattcaaatttcttgcctgacaattatttggtttaaggcagctaaagataggaccctaatcccttctgatctgtgagatttctgctgaaaaatg

SEQ ID NO: 633841 - DNA, 372 bp, Homo sapiens
tattaatactgaaactggtgatcagcagcttcccgataagatctcaggagctgggcgagtgggctcaagcatgtgcactaagaggcaacatggtggagttaactggcatatgacctgggagcatttgactggtaaaggaagaatgcctcaagtgagcatgcgcacttcagtaaacaagctgcgcatgaggcccctccggagcgctggatcggccactgggcatggggtgctttacctgggcgtatgcccttgaatgcaggtgtgggatgaatgacaaggattgtatttgaagagcagggcaaagggcacaggttgttgaaaccaaggcaggagcgggaaggcattcaatttgccatttgatgacctgcatgc

SEQ ID NO: 633842 - DNA, 723 bp, Homo sapiens
cggcgcggctacgggcgggtctggcggcccaaccccctgctgccagtcagggcgcacaaaccccaggagagaaggcggaagcaggcagcgactctaaaggcagccccaggctggctaaattgcggttcctggtatgtgaaacctaggcccgcgagtgcccgggcccagtcccgtgcctatgttcaggaagcggctcagcccctaggggcagcacatacagagacaccatggaacactagtgcattcctctgccgtcgtgctgggaccaggctttcctgaccaatatcaccttcttgaaggttcttctctggtgggtcctgctgggactgttatgtgtgaactggaattcggcctggcatattgtgtcctgtccttgattctagttggatgtactgtcgtggactactgaggccctgacatgagaagtacatgagggacgatgatatgagccgcctactctggtgttcaatccaggctgtgaagccatccagggcactcctgactgcagagctagttggaggcgcgagttacagcttgagacccctgggcagggagatacggacacagctgtgctgtccatgcagactaaacgtactgatgtggtctcctcaaccatggctattggatttgattcaggtgtataggactaagggccgcatgcgggtagctctgtgactgcttagtaactaacgttcttccctggacacttggctgcatttgact

SEQ ID NO: 633843 - DNA, 373 bp, Homo sapiens
taggtgaagccagagctgtacagagaagattcctctattttctcagccagtactcctaggcaacctatacatccgtgagtgggggtggaggatatgcatgctggaaacttcctatgacaatttttatttgactggtgttcttgttagatctgttagtaatgagaaaagatgggactggaacttaaaaaggtaaaaaatttacagactttaggcgaatgcactaaccgagaatgaggttgttatagttttataaattatgctacctgagaatatgtaatactgatgagtcagagagaaaccttgaatggtgaattcctagaaaaatcaaacaaattctcaagcaaattaagttctgctgctgaagacctgtttg

SEQ ID NO: 633844 - DNA, 112 bp, Homo sapiens
gctgagggtggaaggggagtgagcagacacactcaggaggtgtcttgagattatcatccaccctcagcggatgataatctcaagaaactaaggaagaataaataaataatat

SEQ ID NO: 633845 - DNA, 909 bp, Homo sapiens
  misc_feature (368)..(368): n is a, c, g, or t
  misc_feature (405)..(405): n is a, c, g, or t
  misc_feature (409)..(409): n is a, c, g, or t
  misc_feature (414)..(415): n is a, c, g, or t
  misc_feature (740)..(740): n is a, c, g, or t
ggtgttttttttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgataccaccggcctgtgggtctctganagggacccccccccaatcggactgccaaattctccantttnccccnngatattatagaaaagttaatttgtatgaactaatgaatcattgaaacaggctctcgatggctgggtggacaagatgggcaagttgtatgaggaaagatgacaagaaggcacaagaaggcgtgagctagaagcgggaggcgtgaaaaagaagaataaaaaattgtgggctggaggcctatttgtgggtttgatacgtgcctcttttttggtgtcaaaggggaggcgattcttgggagtgtgacccctggcaaagaaggaaggaggctgttggtcagtggcttactctgaatggtaattctgtgcttaattatatttgttgaaattnaaaaattggagtgtggttcaaacttggtgtggaatattgtgaaaggatgtttttgctatttttgagacaaacttgaggagaggaggaatgagacaaaataagtgggaggacgcatgggaaattaagcccaatgagggaagggtagaattgttttagaaattactaatgg

SEQ ID NO: 633846 - DNA, 166 bp, Homo sapiens
cacagacaggcacgtgtatgcacattcacaatggaggaagaagggatatggtgtgcactgaggtaacgtgagcagggatacagaagagagctggagccgtcacagtctgattctctcattgtacataacctttaaggtcttagtttccctgagttctctggtatgg

SEQ ID NO: 633847 - DNA, 726 bp, Homo sapiens
tggcggcaaaaattaaagggtgatctaagccgtcgtgtttgtaaaccggtggtcgtcttgggtataagccgaaggtttgcctccaagtttttcggtaataatgcgcctgggattgagttcgaagaaggcccgcttaaaatgaaattgtccgttaaagttggcgttttgcccaaagaattggtggggtgccgcgaaggcgcgtgggcgcttaatgtgtgtggtacttaatggatccccgaaatgtggacaaacagttccaaaatgacatgggtactggactgattgggtgccctgtgtatgcccaagtaaaagtgagtgagtcttcctgtccgcttccatgagcgggtccagcaagcacacgttcccctatggccattgcgctggtacttgagcatgggcgtgttagggacccatggacgggcaacctcaattgaatgccaatcgaccgtgcaatataaggcaatcaggcaaatcgcggtaaatcatgagggtcaccgacaggaatcggcgtaataggaaggtcataggaatttggaatagaatataataactgggcaggtaatgcgaggggccctttggtggctggatatggataaacatgggtcgatttggatctcggtatgaacatgggcaggggtcgaagcggcggcggtaggtggcggcgatcggagatcaaaaatggaggaagagagcggcgcgcccggcgtgccaacgggcaacggctca

SEQ ID NO: 633848 - DNA, 441 bp, Homo sapiens
  misc_feature (368)..(368): n is a, c, g, or t
ggtgttttttttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgataccaccggcctgtgggtctctganagggacccccccccaatcggactgccaaattctccgcgatcgaagtgtggggatacctctagatcagccccac

SEQ ID NO: 633849 - DNA, 362 bp, Homo sapiens
  misc_feature (11)..(11): n is a, c, g, or t
ggattttcccnaacacccaccctttcccccttcagccatggtgatggcagagaagataagaacttggagcccctttctcactggagaggaaaacttgtcatttggcttgcggagaaggttcccccccacgcccggaggaccatatctttcctatggggtaggaaatcatatttaaaaggcccaaaaaatgtaaaaaacttgaatgggcttggattatacccttaaaattattgagaggatctgctttcccggctgaagggattcattcattattctagtcccgctttagccccttgtaatttgggggaattaagcttttttttttaaaacaaaaaaatggataaaaataaacccttgaaaag

SEQ ID NO: 633850 - DNA, 715 bp, Homo sapiens
ggtgttttttttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgcggatgcctcggcggcgtgtggatctactgaggggagccccccagcgaagctggactggcctaatttgtctccgggatttaagcccgtgggatacttgatacgaaacctttatgtgtactgaagtagtgcatgtttagaacactcctcgggccttaatatgtaatttttctttttaattactttagagagctaggggatgcaaatgttttcagttagaaagcctttatttactttcggaaatgaaccaaggaaatgcatctgtctaagaaacttgcagattatcggaatgtcaggtaaaacatgtactggtttctctggcaagtggatcacgcactttgaaaatgggatgttggaaaacaattttcttaattaaga

SEQ ID NO: 633851 - DNA, 396 bp, Homo sapiens
ggtgttttttttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgatcaccgcctgtggttttaggaccccccatcggctcaatttcggttgccggaatttg

SEQ ID NO: 633852 - DNA, 346 bp, Homo sapiens
ggtgttttttttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccactgctcaatgtgtctcatttggtcggcagggtgtcttctccgcgattaaactgtggccga

SEQ ID NO: 633853 - DNA, 130 bp, Homo sapiens
tgtcggacatacttctggtgggcactgagcagaaacttgaggatgaaatcagtgagctgcatgcaccttgaaaggcttgggctgatctcctcacttgagtgcaaggtccatcgaccaaagccctgttctg

SEQ ID NO: 633854 - DNA, 360 bp, Homo sapiens
gtaccatagcagtgaaatagcccaacggtagaagtaacacagtggaatttatgattcaagcttaagagctaagtcttccaaggcagaagctatgactgtagatgatgaaaacttcttgggaaggtagactctagcaggcattaaagggtagagcagattttggttgtggagtgggaggaggtattttgagtggtaaagtcacatatactctcgctccctcaccactgctgcatatgctcgttacatgtgtggagatttggagttgctctgcacacactatgtctcagctcatggcagatgtctacattctctggttatgtacagtctgagtggctctcatctcacagtgccttacatagg

SEQ ID NO: 633855 - DNA, 396 bp, Homo sapiens
  misc_feature (365)..(365): n is a, c, g, or t
gaggcaggaccgtgcgacctttgaaggataataaggaagtgtttggtacgcacatgcgagcggtggagaaggcgggttcatcaaatggaagataaagtgactagtccagagtaaagcagaatgagagcatagattaagaatgcacatggtagtatcctgcatctggagacgaaaacgcctggtagggttcatgcatttctctattaggtggaacatcgggcttgcatgaaacgggtcgacaaatattttgagttctcggggatttacaagcactggtctaaaggtctgttagttgtaatgatacatagtcgaacttccctagctggcacgctcacgtgagtagagaacgagagcgttcagctggntgtacccacaagttccactagctctcgctaa

SEQ ID NO: 633856 - DNA, 913 bp, Homo sapiens
gacgtctagaacccaggaagtgctaattgctcaggaagctgtagttgaattatcacatgttgatggtgcccccacacgtcatgatctgagcatctgagtcaaggaatactctgaaatggcgtatatccttgatggcgtgtttgcacatctctcattgggtgtggtaccctatttgcaaatttgcgtgacgatttaggttggatcatacgtgccctagctgtggttcaccattaatgagtgcatcatggcggcgatcagattaggatttcgtgcatcaattctccaacctttggatagttcctctcactctattgaggttcataccagtgaccggatcatggtgagttgtgggattaagagagcttggtttcaaggtgcattagtggcatgactttcacgtcacattcatgtttactctcaggtagcacagtaatttttgcacgcaggggagccctgtctgttatttgaaaggttgacttagttaatattggtaagatacttgactgattgctgttatgactaattccttgatggtggatactacaattttgaactctaagtggaagataatacattgcaggaatttccggttaataatacgtactgtggtgtggttctccaaggacacacggacgtctttacgttgttgcacaactatattcgagtgggggtgttcaagtctcaggaagattgttttccagtacacccagggaggtgcgtgcgggggactaccgtaagaaatcgaaggtctggtataaaccttgttaatagtggtacctgcggataataagagagggttagtttcctagacatattaagcggtgagggagctaacagggtggggggaagaaaaatctaagtatgttaagagggaagggggtacatgggggggagcggaacaagattgagtggg

SEQ ID NO: 633857 - DNA, 134 bp, Homo sapiens
tctgtgtcctctatgacgctacagattcctaagagaattctagaataagaggaggggggtcgaaggcaagcaaggaacagtttctaggcttagggcctaaacctttgcatacgaggatcagcaggggatcctct

SEQ ID NO: 633858 - DNA, 348 bp, Homo sapiens
  misc_feature (9)..(10): n is a, c, g, or t
  misc_feature (59)..(59): n is a, c, g, or t
  misc_feature (161)..(161): n is a, c, g, or t
  misc_feature (248)..(248): n is a, c, g, or t
  misc_feature (276)..(276): n is a, c, g, or t
  misc_feature (279)..(279): n is a, c, g, or t
  misc_feature (284)..(284): n is a, c, g, or t
  misc_feature (286)..(286): n is a, c, g, or t
  misc_feature (300)..(300): n is a, c, g, or t
  misc_feature (309)..(309): n is a, c, g, or t
  misc_feature (313)..(313): n is a, c, g, or t
  misc_feature (329)..(331): n is a, c, g, or t
  misc_feature (338)..(338): n is a, c, g, or t
ggaaaaagnngggcccaaacaagctgaagatgctgccaaaagcataaccaatggcagcnatgatggagctcagccctccacctccacagctcaagagcaagatgacgttctcatagttgattcggatgaagaagattcttcaaataatgccgacgtcagcnaagaagagagaagccgcaagaggaaattagatgagaaagagaatctcagtgcaaagaggtcacgtatagaacagaaggaagagcttnatgatgtcatagcattaggttgacagantgntctananagaaccttttattntttagtttntttnggagaaccagattttnnnttctttntttcaaaggg

SEQ ID NO: 633859 - DNA, 492 bp, Homo sapiens
  misc_feature (3)..(3): n is a, c, g, or t
  misc_feature (77)..(77): n is a, c, g, or t
  misc_feature (99)..(99): n is a, c, g, or t
  misc_feature (262)..(262): n is a, c, g, or t
  misc_feature (309)..(309): n is a, c, g, or t
  misc_feature (406)..(406): n is a, c, g, or t
  misc_feature (433)..(434): n is a, c, g, or t
  misc_feature (455)..(455): n is a, c, g, or t
  misc_feature (469)..(469): n is a, c, g, or t
ganttccccaaactaaattaaaaattaagggccaccaccaccaccaccaccaccaacaacaaaaacaacaacaacancaaaaaaggcagatgggtcccngggtttctttttctttctttaaaaaaaaaaagttcaacccccaagcccagtcaataattccctaaagtagcagaaactccctccgaggtagatatctgagtcagacactctcgtccaccgagcgattcttttggtttaagatgagctgcgtatgaggtaagtnagccgtccgcggggggcgggggtgggggtgcctgggggcgtggcccntgtcctctgtcccgaagtcctgtccccctttttggcatctctgattgggcagggctggcgtctccccagattcccgagcctaccagtggggtggggnaggggaagtgggggggccccggggggnnacagaattgttgccagtgggngtttgtgtgtgtgnggtgtgggggagggggggagaca

SEQ ID NO: 633860 - DNA, 457 bp, Homo sapiens
gacctgttcgagaagtgtgggcttgttgtggggtttgtttgagaactcaacaacctcggtcacgacacctgccgtccgcccaggtactgagccaggaatcgttacgtcgcaagaaacaggtcgatctggttttcagggttcaagaacccgtgcccctcgtcctctttcaccatgtattcgacctcgacgccacgggccctcagtgcggccacgatgttgtcggactccgcttggaccacacgaacatcgttggcgccctgcacaaccagcaacggggtgcggatctgatccacccggctgatgggcgagcgggcgagcatgtcggcttcctgctccggcaccgcgggatcgccgacgtagcgataccagttgttggtcaggttcggacggacgaacgcgggaagggtgcgcatgaagttggccaggttggagatgcccacgtaatcgatggcggccg

SEQ ID NO: 633861 - DNA, 1211 bp, Homo sapiens
  misc_feature (982)..(982): n is a, c, g, or t
gatcacagctcctcgctcgtttggacccctaggcggaccttcagttgagggcgcccaacttacgactgagctcgctacctaggggaggctctctgctactccacagttcgctgggtagccgggactcgagtaggcaagagcgtgtgaacggggacggcctagtgccctcgcgtatcggggagagagcagtcgaggcgatggcgtcagtggcctgaacttcaggactgggctatccgtgttcagggcgaggtaggtcgctcgacagccgccgtggcccctgttccccttgcgggcatgcatacggggaccttcgccagtacttatcccctaccgtagtcctggcagcttcccgcgcggtacgagtcgggtgaggactggggatgggctaatagcgacgacagactcactagagaaggttccggagaggtccccgccgggtcttccatcctcggtgtacccaacccagctcaggtgaggactacggccatggggattgccaaccgggctacccgttccgtcaaagaatccccaatgcagcaccgtaatcccggcccccattctaccgtggcaagagtggcatgcactgcgaagcccttcagcacgaagctactggacgtcccccgggccatggcgggcttcgggcccatgctgggtgggggctcatccccgctgtccctcccgtccggtagcggcctggtgggcagcagtggaagcagcagcacgttttggttggcctgtagccatgcagcgacgcgtcatgggctaccaggtgccatggagccatgcaggtgacaccggggggcgtcccatctgcattcttccttctcctccagccccggaggccacgtaccggcgggcggtctccaggcccacgcccgccgtggtcaagcgggggccgaaaaagccttactaggggctaccccgaagggacccaccagttggggaggtccccgcggatagaccctccggggaaaaagactanggcctccgattaaaatccccccgagatgctgcacaggcagcaaacttattcggtccagactgttgtaacccccgggggtgctccccccaaagattcatgtcgggacactcaacaactggcgctcacacagagaagcccgcgggtgtattaccaccaattgcacaacgggagcgtccacaacaccctcagctagactacaacaagcaccagcgtaggagcaaactaccgc

SEQ ID NO: 633862 - DNA, 328 bp, Homo sapiens
tgaacaatctcatctcactctataccacttccaatacggctacacttttttttttgggagacagagtctcgcttccttgtccaggctggagtacagtggcgccatcttggctcactgcgacctccgcctcccaggttcaagcgaccctcctgcctcagcctcctgagtagcaggcgtgtgccaccatgcccggctaattttggtattttaagtagagacggggttacaccatgtacgtcaggctggtcttgaactcctgaccttgtgattcgcccgtctcagcctcccgagtagctgggactacagttggcacggcaccacgcccaag

SEQ ID NO: 633863 - DNA, 346 bp, Homo sapiens
tctgagacagggtcttactctgtcgcccaggctggagtgcagtgatgcaatcacggctcactgcagcctcgacctccccagctcaagcaatcctcccacctcagcctcctaagtacctggtactacaggcgcgtgccaccacacctgggctaatttttgcattttttgtagagacagggttttgccacgttgcttaggctggtcttgaactcctgaactcaagtgatccgcccacctcagcctcccaaagtgttgggattacagacattaggccatcacggccttgccctaggaaacagtttttttaatagggaggattattttggaggagggcatttgagggtta

SEQ ID NO: 633864 - DNA, 211 bp, Homo sapiens
  misc_feature (20)..(20): n is a, c, g, or t
  misc_feature (96)..(96): n is a, c, g, or t
  misc_feature (139)..(139): n is a, c, g, or t
aactgactttaatatacgcnaatttaaaaaattatttgaaaggttgggagttctcagaatgaaatgcatactgtgacaaaagaatctaactgcatnacatgtacaaaacaatctcactaaaaaaataaggagaaaaggntctggcttaagaaagtttgaaaatgagtggagtctgtaagactaacagcaaataaacttcatgtaagtattg

SEQ ID NO: 633865 - DNA, 207 bp, Homo sapiens
tgcttgcgggctctgggtctggccccatgttccccatgagcccttggggaaggtccgggagcaggggggcctcagagcagcctcgctgctgaccccactggagaggcgccggcctcggcccctgggggagctccgtggctcttgctgacctcctcgcaggccaaagctgcttgcctgtgttcccctgcccagcctcagcccctgcgt

SEQ ID NO: 633866 - DNA, 358 bp, Homo sapiens
gagctcagtgtgttctctttcaatctacatcaaatcccaagcttcaaatagaactgtaaaattctgggtgatccattattttatctaccagtagaatgagtaatttaaaagattctaaaaatgcagatctcaatttatcattagcctctcaaagcttggccccacatgttcgtcatcaccatcactgcaccacaaacaccatcatttgcttgcaccatttcatgcatcatcaacacaggtcaatttttgcagtgttcagccaacacaccacttctttcaacagcagcagttaccagtgcacacacgtcatgcaccaacacgcattttcatctgttttcaggaaacccaacatcatttg

SEQ ID NO: 633867 - DNA, 437 bp, Homo sapiens
gggggtctgagatgcagacaccctgtggggggctgcggacgtcgctctcactcgttccagaataaacgtcttaagcttttaagaatggctaggagaatgagctgtatccacttcgatactgtacgccctacaactgagatgatacaagcctatggcgagaggactcttgaatgtggtttacgcgttacaccttaccgctcacatgtaacacggcaggacacaggaaagggatcacacatacattatgaggatgatgacatggcattgcctaattggctgtacgtacttctacatgacaaagcagcgctgactggaactggaccgactctggggtacgcatttagtacggattacactcataggctcatttgtgagcactatctgaacgatgactcgaacactctgggtgccactggccaatagatgttgcgcccttg

SEQ ID NO: 633868 - DNA, 168 bp, Homo sapiens
actcatcatgctgcattgctgttgtcaatgaacacgtgaacacgcatgcacaacgttcacatatgcgaccaccactgtagataaaagcatggagactataagacagagttaaggcagctcagccatggaggttacaccagtttatccatgggcagccagcagcagtca

SEQ ID NO: 633869 - DNA, 464 bp, Homo sapiens
  misc_feature (38)..(38): n is a, c, g, or t
  misc_feature (57)..(57): n is a, c, g, or t
  misc_feature (63)..(63): n is a, c, g, or t
  misc_feature (99)..(99): n is a, c, g, or t
  misc_feature (259)..(259): n is a, c, g, or t
actatttccccctaagaaaaagggggaaccttacgaanggcagaagactttcccccngggagnaaattcttttcaaaaaatcctcctggtcaattcaanaggcctcccagatttggttttggcccacctacaagaatcccaggttcctcatttctccccccaattatctccccaggcttgtggccgtcctgcccccatgttagaaaagcaaacccccaggacagagccctccccccggctacaagcagttagtgctgantgctgtattgtcaatattaaggttgtccagttcacactcatcccctgcaccactctctcccttctgattctgcccacacagaatagaccagtgcatctcaagttatctatgatgaaggacccagagtttgtttgtttgtttgtttcattcctcccaaatctgtcatggaccaatatctttgtagacaataaaactaaattaccaa

SEQ ID NO: 633870 - DNA, 180 bp, Homo sapiens
ctgcgtgtatattcgtaattaagattgctcgggggaataggttatgtgattacggagtagggttagacgatgagtgggaagacagacacagcagaggaagtcaaggttctaatctatcgccttctcttggcgttcgaggttactatgaggctttaactagctttattcttaactttattt

SEQ ID NO: 633871 - DNA, 319 bp, Homo sapiens
  misc_feature (4)..(4): n is a, c, g, or t
  misc_feature (18)..(18): n is a, c, g, or t
  misc_feature (44)..(44): n is a, c, g, or t
  misc_feature (61)..(61): n is a, c, g, or t
  misc_feature (78)..(78): n is a, c, g, or t
  misc_feature (102)..(102): n is a, c, g, or t
  misc_feature (132)..(132): n is a, c, g, or t
  misc_feature (225)..(225): n is a, c, g, or t
  misc_feature (257)..(257): n is a, c, g, or t
  misc_feature (308)..(308): n is a, c, g, or t
tttnggcccacccccttnggaaaccacccctcctaggaaccggnaggctggaccagccccntcgtgaagtcaggtggncggtgtgcctttcccagaaggtcncctggaaatgtcctcggacttgggtcccgnagtgccccgtgaaccgtgtttttgctcctgaggtgcattttctcatcatccttgctttaccacaatgagcaatgaggtcgggttttatatgcnacttattgtatctgaattcctgtagcacaccncctaggtatgatttttttaaattaaagaattcagaataaacattttttggntccttgcgtga

SEQ ID NO: 633872 - DNA, 350 bp, Homo sapiens
tgctgggattacaagcgtgagccactgcaccgggccacagagaaagtacttctccaccctgctctccgaccagacaccttgacagggcacaccggacacgaagaccgaatgtcaggacacgaatgttcataggtcaaggtgtagcccatgaggtggcaagacatgggctacattttctaccccagaaaactacgaagcccgtatgaaacttaagggtcgacggtggatttagcagtaaactgagagtagagtgcttagttgaacaaggccctgaagcgcgtacacaccggccgtcaccctcctcaagtatacttcaaaggacacgaggacacgaaggacacgaatgttca

SEQ ID NO: 633873 - DNA, 846 bp, Homo sapiens
  misc_feature (245)..(245): n is a, c, g, or t
  misc_feature (442)..(442): n is a, c, g, or t
agctattgaaatggttgccatctttttttgaaggcctgctttttattctatggtgtctattatgttttctttttctttttttttgagacggagtctttgctctgtcgcccaggttgagtgcagtggcatgatctcggctcgctgcaggctccgcctcctgggttcacgccattctcctgcctcggctcccgagtagctgggactacgaggtgcccacccaccatgccgggctaattttggtcttntggtagagatggggttcacgatgtgtggccaggatggtctcgatctccttgacctcgtgatccgcctgcctcggcttcaaagtgctgggatgcaggtgtgagccaccaacccagcaatgtttctaaataagtatagtcccctagggaaagttcctccatttggtctagtacatatttgtacactatatcactgtgtnggtgtcgggatgtaagtacggcgatgtcctagacctccatggaggtatatagataactcatcttgtctaggcagtcccactttttctgaagaatgttttacaggcaaaatttcctattttcctttattcataatagtgtcccgtccaaccatgtccgcattccaaaaacactagtttaatcaaattctaggcggtaataatagacctgcggaggtttggttctgagccaaaccctgtctatctatttataattgcgcctcttttgtttcggcgggcgcaacaaattttctccttctacaaccccacggcgacttgggctctttttttcacaccaattgggtttcgcactgtcaacggcttattgtgcacagaccggtcccatagcccatggttttctcgtaaac

SEQ ID NO: 633874 - DNA, 550 bp, Homo sapiens
  misc_feature (5)..(6): n is a, c, g, or t
tcagnnttgggtgacgaggacatgtggccacaccttgctacaggcctccagaaattatgttgaattccaagggctacaccaagtccattgatatttggtctgtaggctgcattctggcagaaatgctttctaacaggcccatctttccagggaagcattattttggcgcggggggccacattttggccattcttggatccccatcacacgaagacctgccctgtataacaaatttaaacgctaggaactatttcctttctcttccacacaaaaaaaaggcgccatggttcaggctgttcccaaatgctccccccaaagctctggacttatagcacaaaccgctgccatttaaccaacagacgcggatccacgcccaacattcttacccccatccatatcctaagcagcattacggcccccgatgacgagcccatcccctgtcctttcttgctgccccccccccctctctcccactccggcccccgttttcaccgtcacaccccccctccccctttaaatcgcgtccccactattctccgccatgccgcat

SEQ ID NO: 633875 - DNA, 315 bp, Homo sapiens
tatgacgccatggtgcgtctggcgcaggacttttcgctgcgtacgccgctggtcgacgggcagggcaatttcggcaatatcgacggcgataatgctgcggcgatgcgctataccgaagcgcgcctgacgcaggcggccgccgacctcatgtccgggctggacgaaggcacggtcgatttccgccccacctataatggcgaggatgaggagccggaggttttccccggcctcttccccaatctgctcgccaatggcgccaccggcatcgcggtcggcatggcgaccagcgtcccgccgaacaatgtcagcgacttg

SEQ ID NO: 633876 - DNA, 414 bp, Homo sapiens
  misc_feature (78)..(78): n is a, c, g, or t
  misc_feature (90)..(90): n is a, c, g, or t
  misc_feature (94)..(94): n is a, c, g, or t
  misc_feature (126)..(126): n is a, c, g, or t
  misc_feature (129)..(129): n is a, c, g, or t
  misc_feature (145)..(145): n is a, c, g, or t
  misc_feature (308)..(308): n is a, c, g, or t
  misc_feature (322)..(322): n is a, c, g, or t
  misc_feature (373)..(373): n is a, c, g, or t
  misc_feature (402)..(402): n is a, c, g, or t
gccatcacactatccatttccagaactttttccgcttaccatattaaacctctgtacccaataaacagtaactctcantccttctgcccngaancctgagcacccatcattctacttggtctctangtnactggctattctaacnatcttttataaatggaattacataataattatcctgttgggtctggtttgtttcagttagcataatatcttcaaggttcatccattttgcatgatgtattgggaattttgttccttgttaaggttgaataacatttcaatgtatagatacacctcatttgccnacccacttatcttngcaatgggacttttgcagttgtttccagttgttcgctagtgtggagtaaangcttctctggaacatcagtgtacaagtanttgttccaaatt

SEQ ID NO: 633877 - DNA, 982 bp, Homo sapiens
  misc_feature (982)..(982): n is a, c, g, or t
tcaaaaaaaaacccgggcccccgggggggggggaaaaaccccccgggggggggtcccccccccctttttgtttaaaaaattttttagggggccccgagtgggggggggggggggggggccctaccttactccccccccggggggagggagggggggctccaaacacaaaaaggaggaactatccagaccacaaagaaggagaggggtctaagcacacaaagaaaaaaatataaatagcacgggggaggacaacaaaaggagagccccacacaaaaggaaagtcgaagcaaggagggggggcacagcacacgggaggaacaccgacaacacacgggggggatcacgcagagatcaaccaacaagatttggtggcggggaaaaaaagatcaatatctacgccccccgaaataatataagaatgacacgaagagatatggggcggcactagctagacgtaaggagctagcgaccccgaaacaaagagaggcggacacaacatgaaggaggagagcgcccctcctcagaggcgagaagagagaaacgcccacaacaatgaggaacgaaacagagtgggacgcggatcacccacaagagccgaacggctgggaagtaaaacgaacacaacaaggaacatgacggaacaacaacacccgacggagcagcccacgaagcaggaaaagagaacaacgtacagctccagtgcgagtcccaaacaagcgtgcaagaccacaatcatgtatcgcagcaccaggcgagaggcagaggcacagcaacacaataccatgcgagcgggaggaagacaaaatataagacgggggggagaaacaacgcgcgtcatgagtacaaccaacagaataatgggccgcagcaacagccagcagcaggatacgcacagaacaacatttcacggcaggagcacataccaggaagtacgggagaaacatccaggcgcagattgaacaacctcacccagacagctggn

SEQ ID NO: 633878 - DNA, 404 bp, Homo sapiens
acacataggcatattagtaaaatctcaaatataataatcaagctgaaaacgaaactagctaatcttcctgaaagaaaccttttctaccagcagtctttctcatactcagttgataacagtccatacctatccaattgctcaggccagaaaccttggaatcagccgtgactacctcaaatatcctctacccttcgtctttcttcacctcctataatcacatataaacccaaaccatcagaacattctgaaggcttaccttcaaaatacatccaaaatactgaacatcttttcctaatttagtctgagccagtaccatctcctgcctggattactgctattttatagtctggtctcacaaaagcagtcatagtgttcctttttaaatgtaagtcagatcatgtgac

SEQ ID NO: 633879 - DNA, 209 bp, Homo sapiens
tgatcatccaggtctctctgctcgaggggcaacagagagatggagcacgcagagaacagaactggaggcagtccatctagggaatgggactgtgaggccatacttgtgaacacgtctggactgctattctagagcttttatttggtgtgttcgttgcacagcagtatgaaatgtataataaatctttataaacttaacaaaaaaacaaa

SEQ ID NO: 633880 - DNA, 328 bp, Homo sapiens
  misc_feature (60)..(60): n is a, c, g, or t
gccccccccatggggggggttactcacgccctccccatcccttaagggtttctggcctantgcatccttgtgggagtcaaggaggagggcccgttgggtaaatggggccaggcttctttcccccccccccgcaaattttttggtgcttcccctgaaacccttttggctggaaagaactgggtgggcttgtcagggggccccccaaaaagggggcccttccagggaactgggggagtggcatggggcaggggcccagttttcaacaacaaaccctttggacagttttttcaaaccccggttttgaaaaaaaattttcagcggcccggga

SEQ ID NO: 633881 - DNA, 82 bp, Homo sapiens
catggatttgctggtgcagtacaactaggcttaatagggacatgccagcctgggcaacagagcgagactccatcacaaaaaa

SEQ ID NO: 633882 - DNA, 853 bp, Homo sapiens
gaagaaggctgactattcctatgggagagaccacacagaaactaaaaatacttggaagaggagaggggctcagttgagcccaaccttccagccaactccagcagggtggcaagtatgagagtgaggatatcttggagcctcagcaacctgtgctatccaatagctatcagccacatgtgactactgagcactcaaaatgtggagcatcctgcatgattctatagcactcaacaggtgtctgccaagcggacagactacagacccctccggccgcatgatgctgagcttccccttggacacatgaagattaagttagtcaagcatggagattcctccctctccttcacaaactccagatgtttggcatctccccaatatcctaagacctcctggactgggaacaaaatgagcgtagtgaaagaggaagcagctttagagaaagcaccacagggaacaaaccaataaaaaagcaggaaactcagcacaagcctgatttatgtcactgcacttctctactctcagccccattcccccaaactcccagcaagcacacaagcacacacaggcacacacatgcacatgcgcacacacacatgcacatacacaacacacacacacacacatgccttctgccagcagctctctttctcactctcacttttcttttcaaatgctggcatttgaaaaaatcccctattttgtttcaccctccttttctgcctccctaaagagcttccgaagaggagttttgatgttgcatctgagtgttaatagattcgggagtgtgaagctgttgcctgaatctcattccctgagagtgcctttctctttttaatagctgagaaagaattga

SEQ ID NO: 633883 - DNA, 222 bp, Homo sapiens
tagcctccaacgcgctcatagccgtaaagacaaggttaaaaggaaaaaatgaggagacttacataattccttcgaaataattatccttaggccagtcgtgacagttcacacctgtaatcctagtactttgggaggccgaggagggcagatggcctgagctcaggagttcgagaacagcctggccaacatggcaaaatcccatctctacaaaaaatacaaaat

SEQ ID NO: 633884 - DNA, 187 bp, Homo sapiens
gggggggggttttttccccccccgggggggggggtttttttcccccagggtttcccccctttttttttccacaaccccgggggccctttttggggggggcccgggggggttttttttttttttttaacgggggcccccgggggggttttttttttttttttttttttttaaaaaaagccccccccca

SEQ ID NO: 633885 - DNA, 116 bp, Homo sapiens
  misc_feature (26)..(26): n is a, c, g, or t
  misc_feature (28)..(28): n is a, c, g, or t
  misc_feature (55)..(55): n is a, c, g, or t
agagaaagaggtaagaatcagatcangnacagctttgagtggcaggcttacagtntgaatttgttatgtaggcaatgagaagtcatgtacgtttttgagaagggaggtgtcattat

SEQ ID NO: 633886 - DNA, 89 bp, Homo sapiens
gacagcagcttctacatctgcagtgctagagatccccacccggggggccgggatacgcagtattttggcccaggcacccggctgacagt

SEQ ID NO: 633887 - DNA, 918 bp, Homo sapiens
gactgcctggtgcagcggggtgggccctggtgtgccctggtggacctgggatggggaacctgcggtggtgcttcccgctggagtgtttctggcatgctggcatcctggggcctggtggtcgctggctgtggactggtgcctggggcctgatgtgcccgctggatgctcgctgtgatgtgcaacggccgagtgataagtgaggtgtgattgccctgtcaccaatgttggtgccagcttgtgtcaaggacatgaagatcaatgtccctgggatggagatctatctcttctccctgcccattaatggaatcatgagatcattagatttcttcctgggggcctctctcaaggatgaggttttgaagattatgccagtgcagaatgcaagaccctgtgcctggccagcgcaacagagttcaatggcatttgtatgctatcggggactacaattggccactgtatggtctcgggtgttaatgttgctccaacggagtgttggcactgacaatcctgtggggccatcatcctggcaatgctctccatcgtccccgtgcgcagaggctactgtggggaacaagatcggaagcccaactgtccattgcaagtgtgacagtgacggtgcatgatctgtgctggtacgctcatccctgcaccccagggcactggcatcgtcattcggcaccttgtgcctaagacgctgctcatgatggctgtatacaatgatgctacacctcagccggggctgaaatgcaaccctggacaattcgcaagcaaatttgatgcattcttagactaaaggtactgacaccgacactgacgcaatgatcacaagttcacaataggagtaatgaccactgtaagacaaacaaaactcgacaaaggacaaggaaatggaaaattagttttaaaaaacaaaatcgc

SEQ ID NO: 633888 - DNA, 836 bp, Homo sapiens
gaatccaggactcggtactgaacgacgaggattcattccccgtgggggtgactaagatggtgcgagaggcgagcgttgtgagtgcatccgttgcgatggatcgtgaaagagccgctcgagggcatatgtgcgagggagcactgattgctcagaaggctagcagtgcatatctaaaacacgtgttacggtcgggacagacgtgagagagcgttgtgagggccgagggagagagtcgtgtagagactgagagaggcgagagatgtgggtaggcagtgcttcgcagtctgtgtgtgagcgaaactctgcgagagacagctagagtcagtgagcaagagtaaaaatcaggtaaaccgataatcggaggaatggacattagtgatagtgttggtaggctcgatactaaggaaggtgaatgggtgtagtgtacgaacttagcatctgaaggaacaagggtaagaagtgtgagcatggtgctcaccataggaaaccggtggttgacctgagcgagagatcaagtttactgtcagaggcaggcataatgtcgtcgcaaggacggataccggaggaagtgtagcaagatactcgaagatctcgaggacctggtcatgctcgcgtgcctgttccatggcatagacagccgcatctcctgggagtgtgtggtggacctcgaattgcatgatcgatcacacggggggactacggatgcatcatatcgctcgagcggctagcctcgggcgtgaccgactggatcatccctgtgtctctgtccactctgtggaggcacgcgggctggacgtagtgcgtattgcagagcgcaggttgcttgcacctgcgtg

SEQ ID NO: 633889 - DNA, 118 bp, Homo sapiens
cacgactgactgagtcctatttcaaagatttttaggggaattaattctatgcgacgatggatattaaactgtggttcgctccacagtatttcagagcattgaccgtactatacccccg

SEQ ID NO: 633890 - DNA, 899 bp, Homo sapiens
atgcgcctcattgacagtaaatattatactagcatttaccatctcacttctaggaatcctagtatatcgctcacacctcgatatcctccctactatgcctagaaggaataatactatcgctgttcatatgatagctactctcataaccttcaacagccagtccctcttagccaatagtgtgcctatggccatactagtcttggccgcctgagaagagccggtgggcctagccctactagtctcaatctccaagcacatatggcctagactagtacataactaaactactccaatgctaaaataatcgtcccaacaattatgttactaccactgacatgactttccgaaacagacatattgtgtgaatcaaacagaaccacccaagcgtaataatatagcatcgatcccttctatattgtttacccaaatcaagaaaacctatgtagttgtcccccaacttttcttccgacccctaaaaaccctcttcctaatactaatactgatccttaccctcaaatcatgggcaagcacgcaattatccggtgaacatatcacgaaaaaaactctacctctctatagtattgtcctacaaatctcttaattataccattcaaggcacgactaatcatattgatatctcttcgaaacaaatatcctacttggtatatcaccggtgaggacagcagagcgggaggagggaatatttctattaaactagaggtcgtcctataatggatttagcaaacctggtgccaaatataataactctggcaaagataacgggcctatgtgtgtacaagtgtgagacttcgcatcacccaaggccgcagtgctgttatatgatatctatccggacctcaatctcctcacctttactctccactcttgttgtatatggg

SEQ ID NO: 633891 - DNA, 284 bp, Homo sapiens
actagaggtataccttcgacggtgttctggaagagttctcgctgctcctacagccatgccacactgctcagacaaatccatcacatacaggactgcagcacggaggtgggccaggtcagtgatggactgcatctcgatggtgtacctatcctccagagggtggtccaggatcccaggagtgtctacaaactaaacacagccagaccttgtcactgaaagcacactcacccacaagcttcttgtccagcacatcccagaagtcactcacaacacacccaaccaga

SEQ ID NO: 633892 - DNA, 669 bp, Homo sapiens
  misc_feature (547)..(547): n is a, c, g, or t
tattggcacttgcttttttgccggggctttttttccttcccaaaaggggtggagtctgggaccaagacaggaatgtgttttggggaaagaccttggggttggggacccctagaaaaccgggtgggggaagcccctttttggccttttcccaaatgggggttaaggaggaccccttaattttaggggccttttaaaaagggggtattttccccctttttggggggggaggaaacaaaaaaacgggggggggggggcggccgatattttaaagcccccccccccttaaaaggggggggggagatttttttaccccccttcttttttttggggggggggggaaaaaaccacccctccttctttttttttttggggggggagaaaaaaaaaaaaattttccgccccccccaccatccggggaggtgtttccaaacaaaaaaataatgccgggtttcccaaaaccccccttttctttttttttttaaaaaaaaggggcccccccccccctttttttgtttttggacccaccggccccgcccaaaaaaaaaantattttggggggggcggcggcttttttttggggggggggggcccccccccccccaaaaaaaaaaaattttttttctcccctccggggggaatttaaacccttttttttttgtggcgcccccc

SEQ ID NO: 633893 - DNA, 223 bp, Homo sapiens
ggcccagggccttgggggcccccccccccccatggtccagggccctgggggcctccccctggccatggcccgggtccccccccccgggtccccatccttgaggaagtaaaaaaaaacgggccccaagatggcaagcctgaaaaaattgcccagctgccctggaatggggcctaaaccccaatttttttttcctaataaacagccccctaggggccccctttta

SEQ ID NO: 633894 - DNA, 128 bp, Homo sapiens
  misc_feature (7)..(7): n is a, c, g, or t
agcccgngtcgggggggcgaaaaacaattttacgaaaaaattttttttgaccctggggtggggggggggaaaaaaactcttggtgggaggtggttgaaaaacccttttttaaagcaaaaaaaattaaa

SEQ ID NO: 633895 - DNA, 221 bp, Homo sapiens
catctgcacttcccagatggagctgtgacaaaagactggaccatctgcgggagctaccatagtaacctggtctcgcgatcacatatagagtgggcggctggtacgttcagatgtagccatgacgggagaacatacactgagaggtctggtccttccagatgggtggacataaagactgggtgctgtcgacacacagagcgggactgaagcaagtcatcatt

SEQ ID NO: 633896 - DNA, 333 bp, Homo sapiens
agatggcggacattcagactgagcgtgcctaccaaaagcagccgaccatctttcaaaacaagaagagggtcctcctgggagaactggcaaggagaagctcccaggtactacagatacatctggtctggggttcatgtaacccaagtgaggctattgatggcacctacatttacaagaaaatgccccttcactggtaatgtattccatatgggggcggattctgtctgctgtggtaccaacatgagtgtccagagcaccgttctatcccgggtctatctcactcatccgcagcacaacctcttgtggagcccacaggacattctcacacatctc

SEQ ID NO: 633897 - DNA, 347 bp, Homo sapiens
  misc_feature (233)..(233): n is a, c, g, or t
tcctctaagtcccttgcaggctctctacctatagggagcaggaagaagagaaggcgcaaaattaagcaactgtgcctgacatggcacaggatctgcctaatgagcggaggagtggggatctgaccccacaaccaccatctgggccagagcctcaccattccccgtgggccagaatgctggccccgagaagaacagcctgctgttctggaaatgagcatggcctcctgggtcangaatgacccatgttctgattgagcagcatcaccacttttctaatttacaacaggggggcaatgtcatctagaattctggagctttagtgtctttggagcatgtaaaattagaca

SEQ ID NO: 633898 - DNA, 258 bp, Homo sapiens
gctgaatcgtcggctgtaggaacgtggagtgtgccgggtgcggggggtctttttctcgtttaagttggcgatactgtcacaggggcctcccactttggatacattttttcataatcagaatatttgagaatggctgggaccttctcagagacaggagaagttgtgacacgtggcatatattagaatcagaaactggagacaatgtcgaagctggtccccaggctcctgagctctaggtttctggcctctgcaggaagg

SEQ ID NO: 633899 - DNA, 361 bp, Homo sapiens
gtgtcccatacaggcgattcttctgcctgatccggccacatgctggagggttcggggagaggctcgtttcagtctagttggcgatttcttggatagagaagttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 633900 - DNA, 2827 bp, Homo sapiens
  misc_feature (2000)..(2000): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgccgaggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633901 - DNA, 675 bp, Homo sapiens
  misc_feature (6)..(6): n is a, c, g, or t
  misc_feature (103)..(103): n is a, c, g, or t
  misc_feature (117)..(121): n is a, c, g, or t
  misc_feature (127)..(127): n is a, c, g, or t
  misc_feature (134)..(134): n is a, c, g, or t
  misc_feature (190)..(190): n is a, c, g, or t
  misc_feature (205)..(205): n is a, c, g, or t
  misc_feature (216)..(216): n is a, c, g, or t
  misc_feature (227)..(227): n is a, c, g, or t
  misc_feature (229)..(229): n is a, c, g, or t
  misc_feature (241)..(242): n is a, c, g, or t
  misc_feature (245)..(245): n is a, c, g, or t
  misc_feature (254)..(254): n is a, c, g, or t
  misc_feature (256)..(256): n is a, c, g, or t
  misc_feature (259)..(259): n is a, c, g, or t
  misc_feature (287)..(287): n is a, c, g, or t
  misc_feature (305)..(305): n is a, c, g, or t
  misc_feature (313)..(313): n is a, c, g, or t
  misc_feature (316)..(316): n is a, c, g, or t
  misc_feature (323)..(323): n is a, c, g, or t
  misc_feature (328)..(329): n is a, c, g, or t
  misc_feature (332)..(332): n is a, c, g, or t
  misc_feature (337)..(337): n is a, c, g, or t
  misc_feature (345)..(345): n is a, c, g, or t
  misc_feature (350)..(350): n is a, c, g, or t
  misc_feature (353)..(353): n is a, c, g, or t
  misc_feature (359)..(359): n is a, c, g, or t
  misc_feature (362)..(362): n is a, c, g, or t
  misc_feature (392)..(392): n is a, c, g, or t
  misc_feature (395)..(395): n is a, c, g, or t
  misc_feature (409)..(409): n is a, c, g, or t
  misc_feature (464)..(464): n is a, c, g, or t
  misc_feature (467)..(467): n is a, c, g, or t
  misc_feature (471)..(471): n is a, c, g, or t
  misc_feature (477)..(477): n is a, c, g, or t
  misc_feature (480)..(480): n is a, c, g, or t
  misc_feature (482)..(482): n is a, c, g, or t
  misc_feature (498)..(498): n is a, c, g, or t
  misc_feature (513)..(513): n is a, c, g, or t
  misc_feature (532)..(532): n is a, c, g, or t
  misc_feature (609)..(609): n is a, c, g, or t
  misc_feature (669)..(669): n is a, c, g, or t
aattcncttggagataaaaaatcttgtccccactcctcccccaatcccacacatctgtgctcttctgcctgagtaaattcagctttgctgaccctcctgcaanacctctgccccccnnnnncctcanccctganggcgaaggtgagcgtgcgccgctggtagtgcctagggtcacactccaagtcctcgntcacctcagccagcnggggggcccgntccacgcctgngnggggggcctcgnnggncaggggggngnagngcacatgcaggtggtagtgaggggggcnggtagtgcaggtgatgangggggggnggnctccctngcggnnggnggggngggagggnggggnggngggggnggngggggatgtgggtggggggggggagagtgntcnggagtgaggtgcgngtaggggtctgatgttccggcgatggcgagagggggatcaagtggaagtgatggngcngcgngtgggntgnanttggggtgagggatgngggggagagagcatnagagggagtgtgggtggtngaaaacaatcccggtccgcttcagccttctttgtcgagaatgttatacacccactggatgctgaggctctgggactncaggtggggtaaagtaatattcctgtagtcatctcccgtctctcggatcaggcggaggtnctggcg

SEQ ID NO: 633902 - DNA, 122 bp, Homo sapiens
aggatcccggttcactttctacacataaaactagacagaagaattctgacaaacttctttgtgatgtgtgcattcagctcatgaagttgaacatttcttttgatggagcagtttctttctgt

SEQ ID NO: 633903 - DNA, 341 bp, Homo sapiens
gtcctttccttttcctccctgtcgccaccgaggtcgcacgcgtgagacttctccgccgcctccgccgcagacgccgccgcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 633904 - DNA, 2914 bp, Homo sapiens
  misc_feature (2087)..(2087): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgccgaggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633905 - DNA, 132 bp, Homo sapiens
cacgatgcagacgatctcgcgggcatgcacggtcagcgacaggtcctgcaccgcatagcggcggtcgccgccgccgggcagccggacgtggagatgcggatgtccaggatgggcggtgcggagccggccggc

SEQ ID NO: 633906 - DNA, 492 bp, Homo sapiens
gtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 633907 - DNA, 1901 bp, Homo sapiens
ttttgcttatattttggaggggttgtctttttcttaacgattcgtaagagttccttacgtattcgatcattttgtatttttgtgggttacgtatctctttgtagcttgtcttttcacattagggcatttgatgtagattaaaaatttgtatattaacagaatcttgatatttatcttcatagtttgtgcttcttatgtcttgatttgtaatgacatctctatattgggttttcatagattcatggggtgctaatgtttaaatctgtaattataactatttttagtttcattataatttttccctatttaattcagtactttatttcccccactaccccccaccccccaagagacggggtcttcctttgttggccaggctgaagtgagtgcagtgacacgatcacagctcactgcaaccttgaactcctgatatcaagtgatcctcccacctcagcctccagaagaattaggagtacaggcacgtgccaccatgtctggcttatatatatttttggggggtggtgggggagagtagagatgaggtttcgctatgttgtccaggctggtctcgacctcttgggctgaagtggtcctcctgcctcagcctcccaaagtacaggattgcaggtgtgagccaccacgcctagcccttttataattccttctatttgttcattcattcaacaattcagtcagaaatactgagtgcccattacacactagatatgctgctaggtgctgggattacaggcatgagctactgtgcccagccagtttttgtatttttagaagagatggggtttctccatgttggccaggctggtcttgaactcctggtctcaagtgatccgcccgcctcggcctcccaaagtgctgggattacaggcatgagccaccatgcccggccgataaattttttaaaatcttctttctttatacatgtttctgtgctctgtttagacagtctcatagatatatttatttgttacgaattgtcccttcatcaggaaaatgattcctttttccctatttaaggtatttgttacgaattctagttttatattatctactatatcttacccttaacttttctgagtcattttcagtgtatcttttatagaaggctatggttggaatttttttaaaacctgagtatcattgtcttctgatacagaatctgaaaaccttttaaaaattagtgaggcgaaaaaaattagccaggcatggtgacgggtgcctgtggtcccagctactcgggaggctgaggcaggagaatggcacgaacccggaagccagagcttgcagtgagccgagatcgcgccactgcactccagcctgggcgacagagtgagactccggctcaaaaaaaaaaaaaaaaaaaaaaagtattcaggctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633908 - DNA, 455 bp, Homo sapiens
  misc_feature (23)..(23): n is a, c, g, or t
  misc_feature (25)..(25): n is a, c, g, or t
ccgcccacgcgtccgcggacgcntnggcgccaccgaggtcgcacgcgtgagacttctccgccgcacgccgcccgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctatgttttttatttttaagttaataaataaataattattcaaat

SEQ ID NO: 633909 - DNA, 2946 bp, Homo sapiens
  misc_feature (2119)..(2119): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgccgaggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaatcatctcagatgtgactcccaacccccatctcagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633910 - DNA, 456 bp, Homo sapiens
acctaagatccggatagtgcatgtgtcggtatcttcacgctgtcggtggcacattccccgctgctagtgctgtagaaattggcatcgtgtgtggacacacgccatgaggtcacgggcgctttgctgtttgctatgccgctgtctggacggtgggcgtggcggcagtgacagcaggcccttgcctcaccaacacggtgactgcggtgaagaatgctcagattgctcagtccccaatccttcttctgggtggggctgccagcactcttgtgcagaaccggggtgcgccccagggtgttgatcaggtgtcccttttccggccactctgtaagttttgggtgtcctgtgcggagggtggcggacaattgtgcccacccttaggggccgcgatggttgccgcccagtcgggcaacccaggtccggtgtttgtggagctgcccgttgacgtgctttaccccc

SEQ ID NO: 633911 - DNA, 647 bp, Homo sapiens
  misc_feature (90)..(90): n is a, c, g, or t
  misc_feature (270)..(270): n is a, c, g, or t
tcgtttaaggagaactgaagttttttgtcatctgctgtggctgttctatgaaccaccttcttctttctgcgagcagttcctgtgcccacncaatgcgcacttgtgcctgcagtttggcgagtttttcctggttcatgattgtttctttcattctttgttcgggagcgaaaattatacgggtggcccgcgtcgggggactagggttggtgctcaaggggtctcgcggtggaccaccgtgagattatggcgcacacacgcggggacgcaagncaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaactgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 633912 - DNA, 2852 bp, Homo sapiens
  misc_feature (2025)..(2025): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtcgtaggaagaaagtgctgatccacgctgcagcctggatgagccttgaaaacaccatgcgaagtggaagaagccggagacgaaaggccgcgtgtgtgtgatctcatctatatgagcagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633913 - DNA, 985 bp, Homo sapiens
  misc_feature (529)..(529): n is a, c, g, or t
  misc_feature (532)..(532): n is a, c, g, or t
  misc_feature (537)..(537): n is a, c, g, or t
  misc_feature (539)..(539): n is a, c, g, or t
  misc_feature (565)..(565): n is a, c, g, or t
ctaggagactcacaagttcccaccccttttcctttgggccttcttccccccaggtattacacagccggatttcccataatccctccggggatttcttccagcgttctcgggccttaccttagcgggttttagcatttccatcgaagggtttttcgatggagagggattcttcttcatacatccaccgaccttccttcttctgttgtgttcctcggttttctttgtggggtcgttggtcatttccttcaaagggctcttcacttgcttctctttggtattccttcgtctctacttactctctcattttttgttatgctcatcctggggtaggtcctagtaactcgggcctgctagagcctgaagtgtggtgttggctcttagttcttctttaagattaggtatattggtctcgtttgcattcttttttgggtttagttgttctttttggttttttttttctgcttattgttttctttgttgtgctggttgttgtttgttttgtttttttgttgttttgttttttggttgnccnttggngntgggggaggagttgccccctaggcanccagcaggtaggaggcgacgtagcgcatcgcggcggcgtctgcggcggaggcggcggagaagtctcacgcgtgcgacctcggtggcgacagggaggaaaagaagatcttggacagcgtgggtatcgaggcggacgacgaccggctcaacaaggttatcagtgagctgaatggaaaaaacattgaagacgtcattgcccagggtattggcaagcttgccagtgtacctgctggtgggggggaaggtgtgtggggtggcccagggtggccagcacccgtggccggttctggccctggtgcagtacatcataaggaacatgaggtgaagggggagtgtggacaggcccatgacctctcggcagtcagccgcatgttggtagggaggaggtgccctgcttgtaaatccttttttctcctctgga

SEQ ID NO: 633914 - DNA, 2969 bp, Homo sapiens
  misc_feature (2142)..(2142): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccggtaggtgtctcggggtctcatggctccaaggacattggaagatgcctctgttttcctggagtcaggggcccagttcatgcaggggttttcacagaactttgctaacttccggggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtcgtaggaagaaagtgctgatccacgctgcagcctggatgagccttgaaaacaccatgcgaagtggaagaagccggagacgaaaggccgcgtgtgtgtgatctcatctatatgagcagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633915 - DNA, 595 bp, Homo sapiens
ggggaacaaaaaaaaaaaaaaaaaaaaaaaaaaacatttgttcggcgcgcgcgcctcggggccctctggaaaaacgctttctctaaacaccattcgcggtgtgggggcgggggccccaagtgatgggtaaggtgagaaacggtggctcaaatgcgtgtgttcccataggagagaactcggggctcagagacactaagggctgtgggttttcttcaccaaattaaaaaagcccggggggaaaacgggagggttttgggcaaaaattcccagaagggggagttccgggggggatcaataggggggaacttatattcaaaggggggatcccaagggagaaaccgggaaaatattaaatttaggcccccggccggggggtgaaaaaacagggaatggagaagagaagaaaaaagagagaaggagggaaagaaacaaaagacgagcaaggacagaaaaagaaagaacaacagaaagagaaacgaaggagaagggagggggagagaagacgagagaaagcggaagacacaccgacagagaaaaacaaggagacgcaagacacagaaagaagaaagacaaaaagagagaaaaaaataagaac

SEQ ID NO: 633916 - DNA, 522 bp, Homo sapiens
  misc_feature (1)..(1): n is a, c, g, or t
  misc_feature (7)..(7): n is a, c, g, or t
  misc_feature (13)..(13): n is a, c, g, or t
  misc_feature (21)..(21): n is a, c, g, or t
  misc_feature (37)..(37): n is a, c, g, or t
  misc_feature (43)..(43): n is a, c, g, or t
  misc_feature (451)..(451): n is a, c, g, or t
  misc_feature (460)..(460): n is a, c, g, or t
  misc_feature (472)..(472): n is a, c, g, or t
  misc_feature (475)..(475): n is a, c, g, or t
nccctgncgctgnacggaatngggcacgaggtaaatntggccncggggcctgtacccatatccccagcaggtctcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaactngaggggggncccggtacccanttnggcctatagtgagtcgtattcaatttacttgccgtcgtttttcaacg

SEQ ID NO: 633917 - DNA, 2918 bp, Homo sapiens
  misc_feature (2091)..(2091): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgagatgtgactcccaacccccagccgggtgctccgagccatggccgacaccatcttcggcagcgggaatgatcagtgggtttgccccaatgaccggcagcttgcccttcgagccaagcactgactgcacagcagtgaacaggaccaacacagtccctggtcttaaagcacaggtgggcagaggctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtcgtaggaagaaagtgctgatccacgctgcagcctggatgagccttgaaaacaccatgcgaagtggaagaagccggagacgaaaggccgcgtgtgtgtgatctcatctatatgagcagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633918 - DNA, 743 bp, Homo sapiens
tacatgatacgactcgagctgagtaccctcgataagggggcaagccatgaacacagcgttgtggccagagatgtggatactggggcagcacactcattccctacctagttaggaacatgtctgtccagtggacctctgagggtggaggtggggaaattgggcaggcaggcagtgtgggcctaattcctagaaggcaagtccctggataggaaaggtggggaagagaagtccccgttgaggagtggctcagggagggagtgttcaggaagaacgggagacactggcatatggtgggtccagatatgttgggtgccatgtgccatctctggtgccatctaacttccctgtggaacagcctcccaggctgggcagctgctctggtctcacctctctgctttctgtaggtattggcaagcttgccagtgtacctgctggtggggctgtagccgtctctgctgccccaggctctgcagcccctgctgctggttctgcccctgctgcaggtaagctggtggcctggtgagtgggcaaggggctggggctcagacggtgttaaaacagtggggtcttcatggggggactggcctggcacttgggcagtgctcaccatgcctctcctctgttccacagcagaggagaagaaagatgagaagaaggaggagtctgaagagtcagatgatgacatgggatttggcctttttgattaaattcctgctcccctgcaaataaagcctttttacaca

SEQ ID NO: 633919 - DNA, 3119 bp, Homo sapiens
  misc_feature (2025)..(2025): n is a, c, g, or t
  misc_feature (2929)..(2929): n is a, c, g, or t
  misc_feature (3010)..(3010): n is a, c, g, or t
  misc_feature (3012)..(3012): n is a, c, g, or t
  misc_feature (3081)..(3081): n is a, c, g, or t
  misc_feature (3093)..(3093): n is a, c, g, or t
  misc_feature (3101)..(3101): n is a, c, g, or t
  misc_feature (3119)..(3119): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtcgtaggaagaaagtgctgatccacgctgcagcctggatgagccttgaaaacaccatgcgaagtggaagaagccggagacgaaaggccgcgtgtgtgtgatctcatctatatgagcagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaatttgcaccgagccagtgtgttgatcgaagaccacgattgcctgtgtttctgagatgcgtccatggaaaaatggaaaaaantgtggtgcgttgacttgctggaacccttcctaagccgcagtgaaaggaggggctagatctgtgtgtgttcatgcagctcananacctgatgctgaacggataagcaaggccatctacatacaaaagtacacacaaattaattcagaattgangttcttgcaaanacattacngtatgtatgcaaaaatcn

SEQ ID NO: 633920 - DNA, 109 bp, Homo sapiens
ttttttatagtgcttggcattttacgggtaacatattaccaaaaagctttatctgcgtagctttattctatgtacaatgcagtagaggatggcatgctaacaggtacag

SEQ ID NO: 633921 - DNA, 1793 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaatcaaaaaaaaaaaaaaaaaaaaaaaaaaaaaaaaaaaggggggggggccgcggcaaaaaaaaaagggggggggggggggggggggggggggcccccccactatttctaggagaattgaagcacagacggcgagtattttgtggggatacatgccattctggagagcgagaaatcgtgctccgaaacagtacgtatttgtgtggagaaggagacgaccttctcatcacacagaggagagaggtgggcggaggtgtgtaaaagcacgacgggaggtaggttggggacggcaggaaaaattgtttgtcatgggggggagcccgaggagggggggtgcaagattacatctacggcggggggagcgagggagttgttcttcaacaaatttgtgggggaaaaccagacgtgggttttgcgtgagaatgtgacctctaagaaagaggggcgc

SEQ ID NO: 633922 - DNA, 1642 bp, Homo sapiens
  misc_feature (29)..(29): n is a, c, g, or t
  misc_feature (55)..(58): n is a, c, g, or t
  misc_feature (815)..(815): n is a, c, g, or t
ggggaactggactgagatcaccccgtctnggtttgagatccacggggcccaaacnnnntttcccacaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633923 - DNA, 343 bp, Homo sapiens
  misc_feature (1)..(1): n is a, c, g, or t
natccaatctgttcacctcaatacatggaaaaactatatttgaccaaaaacaataattatggagtattagaaattgatatgaacttttttttcccccccgagacagagtctcgctgtgtcgcctaggctggagtacaatggcagtgatctcggctcactgcaacttccgcctcccaggttcaacaattctccctgcctcagcctcccgagtatctaagatttcagtcaactgccaccatgcccggctaatttttgtatttttttttcagtagagacagggttttgccacgttggccaggctggtcttgaactcctaagaaagggcatgagattgcggtgtttg

SEQ ID NO: 633924 - DNA, 1640 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaggggggggcggcaaaaaaaaccccgggggggcccagtgcgggacccacccatttttttggtacaggggggcccccatatagggggggccgcatataaaaaaacaaaagagaacgggcgggggttaaaaccaagcctcgggcgtgggggacacgtggccctggggacactctgggaagagaaccctatctctggggggggcaccatgcggaaccaccccacagagaattaccgcccaggggaaataaatcacgcggtatggggcaacaacgaatatgcgcggctgaaatggcagggtgttaacattc

SEQ ID NO: 633925 - DNA, 2647 bp, Homo sapiens
  misc_feature (1820)..(1820): n is a, c, g, or t
ggcacgaggccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccntgggctggcccaggaccgcgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 633926 - DNA, 1309 bp, Homo sapiens
gattctacacaagtggtgtttgccgtcagaacacaggtgtcgtgacaagactaccgcctagaaagccaaaatgggatcggcaaagatctcatatcaagcattcgtcgtgcattggacacgtagattcgggtcgaagtcgcaccaatactggaccatctgatgctatacaatgcccgtggtcgtacgagcaatagagaagccatttgaaaagatcttgagaagtgaggctagctagatgtatgcgcgcacaaggtgcgctctatttcaaggtgatagccgtggcgatctatggaataaaagttggatagagtcttgaagcagtcgcaaaccgtagcgtcagttcacccatttgactatcatcccttgatcgtgaacatgtatggacgaccaagcaaggtactaatgttgacttatgcatctcgatgtcgcccagtgagcacagtagtaacatattattccacaaaatgatgcatctaagctggtgaccatctccaggggctgaatttggttgcttgtcccctgatgttgttcgcatggcggggaagctggggttgaaggtacggaaagcctgggataatcgtcccaaacgaaatttgcggcaagaaacccctgacgcaagtcattggagcacctttaattgtgactaaacctctgctggagggtggttgcaaaccgcgagttagacttagaaccgggatggattggaaccaaaagctggaattttcccaactaggatgctcaggccctaaacactgggccaggacacgacgagtactgacgcaagacacgcggtctcaacggaaacgttcagcccactttgtacctttttccgcgaaatttgggggcaaatggaacacccgtaaccaacaagaagaccggttagatgccaagaaaatctgggagtggggacctggtgcaccagcactgcttggagacactaaggagtgacaaccgggtgcccatgagggtcacaggggactgctgcaaaccgtgcgcccccgtacagtggactgtgccacggtgtgccaagatgtggatggtcgcaccgtcatgtattttgaaagggtatctggtgacaatgtgaagtgcctataagaagaggagttggtgatgacactggtaaaaagcgccacttgtgtgcgcatgtgattatgacaaggacatgtttgttaacacaaagatgggggtggggaaatgggtaaagggccaaatttttggtaccagttggaagaaagggggtgatcagtaaaacgcgtggtatttgatgtgtgaacatagagggatgctggagttgatggaataagaagtt

SEQ ID NO: 633927 - DNA, 222 bp, Homo sapiens
gcggccgcctactactactactactgctcgaattcaagcttctaacgatgtacggggacatggtgaaaccctatctctactaaaaatacaaaaattagcctgtagtcccagctactccagaggctaaggagggaggatcgcttgaacccgggagggagaggttgcagtgaaccgagatcacaccgctgcactccagcctgggcgagactccgtcccaaaaaa

SEQ ID NO: 633928 - DNA, 1013 bp, Homo sapiens
gaccgccagacaggagttataggtaatatatagtatatatatagtagtatatccttgttatttatagctatgtaattagggaattcagctttactggtaacttccttatttagtatatttagtaggtcaactctaataaaatgaaactagggctgagctaagttagccctcactagccaaactgaaactctatgcaacattaaacagaagagatccatcatgtagcttgtgacacttttattttattagtcaccgggaaaacttttcagtgatgaaaatacacagggtacataaaccttcacatggcttcaaaaaggaaaaccaagcaaatcttctctaatctactcttactataatttcctaagtgtacaccagaactctggatttaaaaatctgaagtactatacgaacattaccgttgacagaattggaaattacagagtacgtattcatggttaagtctttcttatgctatggagttcgtgaacacatctaggtggacatgcatctgagagtaagggctggattgtaatccttcataagaaaccagccttgaagagttaagcaatactctacgattggtattctagacttcctaggatattcaggctacctgtacattacaagctgttaacagcctaaatttacaggactatatagaattcctatccatctcactttcacctacgactcgtctgaccctctgccatattgacaacacgtaccctgcaagaaatatacacagcccaacctatagttacactatactcctctaaaccggtgaaggactggaacaagattcaagaaatacggaaatatcacccggacaggtttaacagggaagaaatggacatgaatagggtataacagacccacttgggtgtacatactagagacactgacaacaagacaacaaacatggggcaaatgagcatttacctatactggggaactcagaaatgaataaggggaagagtacgcacaacaaacaaagagctagacgaatctacggg

SEQ ID NO: 633929 - DNA, 1025 bp, Homo sapiens
ggtcgttcaccgggaatcggtattctaaatgggtcgacacatcgtaaccactctccatggtgaggtatagttgcgcgtaccctggatatacattccctgaggtagtagactaaagcagacctccgagtatcggtcgaggcatctcgggagaactcaccgaaccactgagcgctcagctgatctcttgagccagaatatggttgcctgttgcccataagtagtctttatgactcgcactgtgatccttcccgcttgttcggctctgcctaacaggatctaggatgcgcgcaacgaatgatggcaatacggacatacatagagtcaaaacgaaggggcatacttcacttgggggaagcactttacattacgggccacaacacagatgttatgaacctagccactgatggatggttactggggaatgggcctcctttgtgtgctcctacacacagggtaagccaggcaggcctttggctattgatgaatttgctctttcgcttataatatgttctctcagaaaagagggacaagttacccgtaatgtacatgagccgcaaaaagcggttggatttcagcaggacccttaggatcccatttgcttgataattgcaaggtgtgagcaccggatgactctattccccctgtccatgttgccacagcacgtgtgactgtggtatcccgtatctggaaatgggcattccaactcatcagggatcttcatcgtccccctttcttgtacagtgtacataactttatgatgactatatgcagtaacttacctgccttcacagaaggaacggttacctataacttctacttccaggaaggatcactggtgaaagccagtataggcattgttctgggacagcgatatgtgaccctgcatgtcaatgggtttacagcacagacattggagaggtctcaaaggtgtttacctaatagcgatatatcagaacccccattgtgccacaagcgttgtcgcgcccgcgagatagtattaccgccaattgaccgtacagaacacc

SEQ ID NO: 633930 - DNA, 1111 bp, Homo sapiens
gctggctctggccctgggccccgcgcgatgcttgtcgggtcccgtcaagtcacgctaccagactgttgctgcagcacagcaggctctgtgtgccgccagcacggcccctatgtgtgtgctgtgcagaaggttattaggccactaataggaagtacttcacgcaacatgctaagcaagtggtaccaaaggaaaatctgtggcaaatcagacagatcatcatgctacgagatgctgtcctggatatgacaaggtccctggggcaggaaggtgctgtccagccatgactaccactctcaatctcgctttaccaaagagcctgggcagtctgattggatcctcctagccactctagctagtacatcaggaccgccacgtgaagaaagctgtacggctctgatgatgcgtagcgggccatggctagcgttctagcatcttcttcccttaacaagggagggcactagcgcgctcctgttgctagcttgaagttgcctgagaacctccccgtgggtcaggcaaggtgatccaaccctttgcagctgtctccaagtgtccctccggcatacgcactattgcgtgggcacggcgacctacctgatctgaatgactccgtgaataacgacgtgcattggacacccttcactctttctaatgtagccaaaaaaagatcccaatcaattccatgagtcgcaacacactattcctctactggggactccggtaacttggtgaacgtgttcccgcgagcttgctgcgacaggccgcacccacccatcgcaagcagaactgcgcgatagcgtaggcaccctccattagcatgtaaaagggtacacgcctcccaacccaatcgacccaaacgaaccatctccaaccacagaatcagctcgcggaatccgaggaaccacctctaggaaagcaagccgtgtcgggggcatgcatggtcgcctgcaagtcaaagggatacaaccccggatatgcgtctcgaaacggggtacaccggaacatagtaacaagcccatacaggaccccccacacccacacgacgcgcccctccaacccacgcatcccctaccttgacacctccgcacaccggtcaccctgcggccaaaccgac

SEQ ID NO: 633931 - DNA, 847 bp, Homo sapiens
aatcatgatccaggtaaaaactatgactgaatgagattgatctgctaatacggtgatgttgttatttacagtgatctttggaacatttgtaactgtaacatgtattgtcttaaagcaggagatctggtaatgtcctagtggattcattctacgctgcctgagtgggaaattgatgttgttcatcaacttaaaagggttgtcacactgtagtccacattgaacagttatgcatccactactgatgtgtcgagtgtagagtgcgaggggaggaaaagagatgaaattagtgacatacttttgctcgttgaggcgttcaacaccactgagcgagggatgagtgtgtttttatatcttctagacactcgtacttattgaaagcatatgtagggtctatggtagcaatcttcgaggtgtacgtcatagtttcagccacgctgtcttgttgcacttcgtatattattgttgcgttattccttgcctggtctaaatttctcccttggatactctaacagggactaaacttggaaaacatcactttgacctataagctcctagtacttcccaaataaattccatatctagcattttcaaacaaagccccaagatgaagtctaattctgaaaatatctcacaatttttgaatgttctttttatcttaccgacctaacttctcttttccctcccaattggctcccacacgttccatttcattttggccattatagtcacatccgtttgacattaggttgtgacatcttcctttcaggatgatggcaattcagatgcagtctgtctatgagtgagaattggtcaccattcagaggagttccctaagtgaagtgactaa

SEQ ID NO: 633932 - DNA, 1255 bp, Homo sapiens
gtggtacccgcattccaacatggcggcgggggcggtatctggtgctctatggccggaagaggcgctggagtgctcctggcatgtagggactgcctgccctgtgagaccccggtgtcgagaatgctcatgggtgctgttagacttccagtgcgttcagcgtttgtgggctataggtcattgatgactgagcacgaggcaggtacgacaccgcaacttcagtatgtctcagtacgcactacttgatgacattagagggacagaaataacagcgtgattccagagtgtcttcgtcattgcaccgcgcccaaggatactaacatgacgcaatgcgggcggtcagacggaatgaagtgatgtggactatttggcaaacgtgatggacgccctgacggaagaccaacggcatggctgtgacggtgaagcctaattggaggctggtgacaccgtggcagaacggagatggtaggacgtcaatgaagggccgcatgtgtaatgataagggacgtcccaaagagccgtcgttgcgaagtcgaccttgccaaggattgtgatgaaacgttgcatggagtagtgcaaaaggaaagcggaatgtgacataagaaggcggtaacgtaccttgcataggttgagatagaaacccatggtgacaggataacacggaggcctacaaacagcggatgacggacgaaagaacaccatgggaaggccaccaaatacggtgcggaaagggaaaaggcgggccaaacgcgggaccccaagtacgtgacaggaaaagggaatcccggtaagtccggacgagaccgagtggcacagcagtgagagaacgagagaacggtggaaaaaactatgaatagaaatcgccatgaaagcaggaaggaaaacaaacgagggcgacagcaagagaacagcgtacaagggaaatacagaacaaaagacacatacaatacaaaacaaagagatccccagaataacaagagccaagaagaacacaaggaagaaaaacacgaaaaaggatggacaaaaacgaaaggagaagaaaaaaaaacggacaagaaggaaaacgaaagaaacaaaagaggaaaaaaaaacaacatagagagaacacaaccagaccagaaaacacaaagagatagagaagggcaccagagcaaagaaaaaacacaacaaaaagaacaaagaaggaatgcaatggaagcgggaaacacacacaaacgagaaacataaaaaagaaaaagaggaaagaacaccaagcgaa

SEQ ID NO: 633933 - DNA, 113 bp, Homo sapiens
ttggtccgctcgagacattgggctgtcgtgattccacatcgaggtcgtcaaccctattgttgatttggcgtctagaataggattgcgcgtgttatcccgtgggtccgagggga

SEQ ID NO: 633934 - DNA, 910 bp, Homo sapiens
  misc_feature (251)..(251): n is a, c, g, or t
  misc_feature (270)..(271): n is a, c, g, or t
  misc_feature (639)..(639): n is a, c, g, or t
  misc_feature (724)..(724): n is a, c, g, or t
  misc_feature (730)..(730): n is a, c, g, or t
  misc_feature (733)..(733): n is a, c, g, or t
  misc_feature (908)..(908): n is a, c, g, or t
ggcggcgggaacagggctgccccgggccacctgtcatctcctccgccacccttccaacagttgcttcagactcaggagagaggccgccctggccccaggagcatgctgtcagctcatttctcgactcgccgccctgcccaaaggcggctgcaggagggcgcgcggcggcgtgggtggcagcggcgggaagctgcccgccaggacccctggccgagccggctcccgcggatcgcgcgccgcagccggaggtngaggcccgggcgacccgtnncccggcccgggaccccagccccgctgccccgccgccccggccgactcggacgcccgccgccgcccactcaccgccgcactcggcagagtactggtccccccagtccccggactgcgggctgcagccgccgccgcccgccggggcctcctgctgctgccggtgctgcagctcctgcttgagcagggagagcggcgagtagtgctcggtggccagggcgcctggccgcagccgggcggacaggacccccagcagcagcagcagcaggacacgccgggcggcgcccgcggcggccacagcgccgccccagaagcagcagcagcagcagcagccggcaggtgccatcttccctcaaggcgcatgtgcgacancccttgcccggctctcaggcctccccgcctctaacctacggcgggcaggtggaccgtggcaagggggcgggacaaggggagaagntttttntgntgggaatggtagtcccagctcggccagcccggggccgccttgccggtgccgggactacgaatcccaataagcccgcgcggcgcaagtcttccggtctggcgtctgacgtcttaccctccacagaatcggaagttctggactgcagttgagtggaaatgggcaacggcgggcggangg

SEQ ID NO: 633935 - DNA, 872 bp, Homo sapiens
tctgtgcacgagtgtccccccagcctcccctccccatacaaagtgctgacaggcctccgtcacctcccaccctggtccgcctccctggctggtcagccgagtgcctccgacccccctcctcagccctcccccacccacaggcccagcctcctcggtctcctgtctcgttgcttgcttctgcctgtgacttgtgggggagagaggcctgcagaccatgagcctctgcttgccctatatacttgtgcgcccccaggttctatctccccgtcacaccctgattgcctggcgttacagggagggagcggaccagccatacatccaggcccctgtaggttagcccctggactgtgtgcgctcttgcttgctccggggggtcggaggcatggcgatggtgtgtgatgcacggcctccgttgtcgcggccgcggcgcggtcccgtccgaggccccggcttgcatccccgtgtccaccaggccgcgccgttgatcagcttgattcgggctcccggtcgtagccgcagttagtgccattaacagtgctgtgaggttgtagcacggtgggggccttccaggtagagcgctcgtaggccttcctcgttgttatctttgcgtttagggcacaatgttggggccatccccctgtcccccatttcccccgtgataggggcggaagagcccgagaggtagaacccgagggtcgacgcggcggctcgtgtggtgtacgcaatgaatggacttgcatccccccgagggcgcagccaggttgcctttgggccagtcggtggccgggattacccagtaggacagggggcttgatgcaggagtggcatacaggaagggatcgcgggaacagccaggattgcgcaataggcag

SEQ ID NO: 633936 - DNA, 687 bp, Homo sapiens
  misc_feature (319)..(319): n is a, c, g, or t
ggcgacctcaaccagttcctcagtgcccaccagctggaggacaaggctgccgagggggcccctgtggacgggcaggctgcgcaggggcccaccatcagactacccaatgctgctgcatgtggcatgccagatcggctccggcatgcgctatctggccacactcaacttttgtacatctgggacctggctcacgctggaactgcctatagttggcgcgaagagatattccacgcgatcgatgcatccgcagcacgtttggagcatgaagcacggagactctctcatggctgcggtgagctacttacacgtgttgcagggnccagtggacagatgtctgcccatcctggtggatggcctgggagtgcatcctcatggggaagttcacgactgcgagtgacgtgtgggcctttggtgtgaccctgtgggaggtgctgatgcgtctgtagggcccaggccctttggtgcagcatcactcgacagagcaggtcatcggagaacgcaggggtgagttcttcctgggaccctgggctcggccggtgtacctgtcccggccaggctgcctgcccgctgggcctatatgaggctgatggcttcgggtgctaggaagcccggggatgtctggaggcagcgagcacccttttcccgagctgcatcggttcctgtgcctgaggatgctgtcaacacggg

SEQ ID NO: 633937 - DNA, 150 bp, Homo sapiens
ctcctcatactgtcagtgaacggctggtgtgtatgggctggtgtgtgacccatgtgccatcatggatgcggtgatgccacctgatgtatctcaaatgaccttttcctgcccgtggtcctatccttgtcctgtgcctccatgtggtggcac

SEQ ID NO: 633938 - DNA, 142 bp, Homo sapiens
cacgatgggttttccacgctggttttagctctcggcgtctgcaaaatgaacattgaggaggtgaagagcactacgatgacgcagtgcatcgcctcccacagccacgtgaaagggctggggctggtacatagcggcttggtca

SEQ ID NO: 633939 - DNA, 135 bp, Homo sapiens
atgaaaagtatgattaagctagctagaaaatataaggaaaaaattaacaaaataagtcattctttagatgctatataagatgacataagtaaagtagttgaagctataagataaaatatgtaaaatatactctta

SEQ ID NO: 633940 - DNA, 218 bp, Homo sapiens
ggggggggttttttttttttccttttgggttggggtgttggccccccccccccaaagaggggccctttcctttttccggggttttttttttggggggggggggggcccccccccccggggttttttggtgggccggggggtttttgggggggccccctttttttttttttccgggcccccccgtgggttttttgcccccccccccccccgggggggga

SEQ ID NO: 633941 - DNA, 264 bp, Homo sapiens
ccgttcgggtgggaggatcacttgagtccagaagttcaaggctgcaatgagccatgattacaccacggcactacaactctggtggcacagtgagaacctgactcttaaaaaaaaaaaaaaaaaaaaaaaaaaataactaaactttctaaaacattcttgtttcacgtttacccagaaactatacaagttggtttaccatgctttatcttactcaatccatacaaaattcttatggaggttgtagcacctctttattgataaccg

SEQ ID NO: 633942 - DNA, 922 bp, Homo sapiens
tctacggtcgagtccggttccgcgtgagaccccttcggggggtttccccgcgtcccccaaagtgtccttgtcttggcaatctcccgacgtccgcccgcccaagtcacacgtgtgctccggccggtctactttctgggggggtagaactgcgcccaccacccatttttcggcgccctaaaatgtcctccatctgtgcttggggagagttctggccgatagccccccttcatctcgcgcaccccttcgtgtggggggtctttctcgcctcgccgcccacctcaagtatgcggtgccccctacgccacattttacagcctttgggccaccattgcctcgcgcgcgctctctaccatttttggggctccactcgtggagcaccctctgaagcatacctggtccgcgcgccgaagcattttccctggaaggccccttcggtcgccacgtaatacctgggggggcaccgacagaccccccctgtctccaccgcttgtgtgcggtctctaccaccaactacgtcccgctcctttgctttcagcactccaggccgcgttcgttggagtctcctccgcggcgcacagacaccgctgtacgccggggccccttcaaatgctcgcccccccccgcccattggtggtttcagtaccctccttccctgaagtggacctttctctccagaacccctcggtccacctgtggagccccccgtatgccggcacctctcatttcctttggcacacttgctggcttgacatgcggccccacggacgcaattcttgtttcttcccgccactgcttcccgccccacatgttcttgtcgagtggttgacaacccggcccctggatgaccatttccaccgggcgggccccccaggaaaacccccggggttttttgctccaaaaaaacccccccgcccacataaca

SEQ ID NO: 633943 - DNA, 146 bp, Homo sapiens
gtgacctccagcaaacacatgaatggttatttcatggagaaggaagcacttgggggtcgtggtaattccagtgttttctgtgtcatagttttacactttctaacactgtcatttttgaagttttgatatatccacatctattgacc

SEQ ID NO: 633944 - DNA, 536 bp, Homo sapiens
cacagattatacatgatagacctcaacagacagtaaccagcttacgaatgtggatataggccgtctgctaatacatgggagactgtgcttatggtcacctttagggcgaaacactttagaagttgacagcatttaagccatgagtggtgtctagagcctgcatcaccaacattgcctcaagacagtcacgatgccattactcccatcagttgcttagacaatgaatcctgtgtctgagactcacttatgtcttcttacatcactgtcttcattgccagtgcagttcttgcatggtgacaatactcataggcatactaattcttccacgaatgggggataattttcaagggaccagattttaggatttttccaagttagagcatgcatccctttttagttatggcagatggtatacaatagatcccacttctgccaccatgaacaaccagcatgtgaaacagacaagaccttgcaagcaatactctagttccctttaggaagtgactttttactcaactctaccgcacaatgccatt

SEQ ID NO: 633945 - DNA, 413 bp, Homo sapiens
agaggaaccatataccaggatacgggtttacggacaataccattaaagcatgagatatatatgcatgaatcactgatatacacaggagactctaaaaaaactatctgcagccataacttgacagtacagttttaaagcagtgactacaagatatcacaaaaattcaaacagttaatacaagaaaatgaagtgaatagttcatgacactaaactgaactgttcgtgacacaaagtctctaaaaaaacaaatctcggctgggccagcactttgtgaggtcaaggccagcagatgacttgaggtcaggattttgagaccagcctgggtgacagagtgagactccatctcaaaaactgaaaataaaaataaaaatatgtattctcctaactgaaatatttacctaatctggaaagtg

SEQ ID NO: 633946 - DNA, 1001 bp, Homo sapiens
gctcctcactttcaggaacaagcactgacctgcgacagtgaatagatcatgactttgttctgtgctcgtgccggcattctcctgctgtaccattgctattggtgtcttgtctaggttcctcttgctttccccttgtgctgtagagaattactcgtggcaagactggatgaccacgagcgagaagatctatcatactcgaccagaggatctcgagggagtcactttcgtacccattctaaccatggagtcactcgcagaatttgggcttgagttctgtacttcaagccataatatcgacaagcgtagtctaaaacacgtctcagagacacggaacacctcatttacttctttccattgtcttcgacacccaggatagaaggcagtcaggatacgatgaacatctttgcatgatgtacatcatcgcccattgtggggagacccctacaacggttctattaacatcctctgacgtagatgatcaatccattgagaccgagagacctttttagaatattgacccagcgcctgtcaaaccgggattgaaatttcgctgcggagggaactcaagtattctcagatgggaaaagagctttatctccagagaggaaaaactgttccctgttcaccatcttgaacctctttcaaaaaccacaaggtgcaaacgaaaccaaagggttaagtttcctcaaccatagtttttgtggccacagagcaagggtcaataattggaggactctttcgatatactattacctacgacagaaaggggaagtctccggtttggaaaagagccctataggagtagaggaaattaaagacgttgttaactggcggcgcgcaaggggcattttggtataagaggccaaacaaggtttggggtccaacgcgggaacaatcccatttagatacggcaccattgttacccaacgcttgtgggctttccgcacaacccttttttccccgcggtgttggaactaacttcccaacactttcgacaggag

SEQ ID NO: 633947 - DNA, 323 bp, Homo sapiens
tattttggacacctagcccgaaacctcacttccttcaacctgtctcccagtcatcttcaatatgtggacgaccttcttctttgcagcccctctctaaaagactctcaaactcacacggacactgctctcttaaactttctcgctatcaaagggtatcgggtctccccctccaaggcccaactctccatctccatgatgacttacttaggaattcaactttcccctggggaacaggctatgactccagccagggcagcattaatagacaatctacccccaccctcctccaaaagcgaaatcctttccttcccagggctagcagg

SEQ ID NO: 633948 - DNA, 469 bp, Homo sapiens
cctagaaaggtgctgacagaaaataagtgcagtatggtcgtactattaaactctagtatcctatatgcttgcttcttacccccttacctaggtgaatactcccacagtggtctagtatctcaacattttctatatttaaaggaaaaaatatatatattatagtttcttttaatatgatcaggtctgtaaatgtgtactaaaaaaatcagagtatatttataaacagaatagtttatttaaagagaaggtctcttccttattgatatacatggtatagcattaattccatttgttactattgtgcacaaaagccctgttcacaggggaatggtgtaaacatttatactgttttgttcactgtatatagtagacataaactgttgaatagttactgaatcatgatgtacagaatatgtgaccatcttcaggtatgggatttctgaacgtttcaaatttcaatcaatgagca

SEQ ID NO: 633949 - DNA, 337 bp, Homo sapiens
agtgtaacgcttatctactgaggaacgtctcagttgcttcgacttttggtaattatgaaattatgaacaaggttcggtaattatgaataaggctgccgtaaatatctgtgtgcaggattttgtgtggacataaattttcaattcatttgggtaaatacaaagggacaaaactgctggatcacatggtaaaggtatgtttagttttgtaagactgtcgaactgtcttccagagtgaccaccgttttgcatccccacctgcaatgaatcagagttcctgttccacatcttggccagcactgggggttatcagtggtgtggattttggccattctaagcg

SEQ ID NO: 633950 - DNA, 512 bp, Homo sapiens
actctgatgtttctctgactgatcttcctctgttcctggatcagtgtagagaacagaagtagaacaagatcagagtgctgtcactctgagtcagaagcctcattgactaggaagattgtgcttccgtttattcttctttatcttttcttaattactttacttatgctaatctttcttcttctttttcttgtgtatctctataacttcaaaggaactggagctgatcctatcctcatctgaggtagaatcctccagataactgttttaaatgctgtatccttacgtccttttcatgtcgattattgtcatcgatatgatgtcatacatgggatcttcatgtgacactctgaactgctctaacttttggttgacttagataaagcaaagggcattcttagtcacccgatcggtgaccatcagcgttagcaacgccaacactgcataacttagcacttctttccccagtggcatccaaagtcctttaattggtgcaggagaacgcgtcaaaatcg

SEQ ID NO: 633951 - DNA, 115 bp, Homo sapiens
ctaggttttcttctccatgatgcagtgagaggagatggtgagaggggccaggtagagggcaacaccacggatgaagaaggtacagagaatggtcacctgggaggaggtccgctct

SEQ ID NO: 633952 - DNA, 393 bp, Homo sapiens
ttgtagaaagtattatttaatttaaatggatgcaggttgtctactaaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgcccaatccttcaaaaaa

SEQ ID NO: 633953 - DNA, 112 bp, Homo sapiens
aggatacccccagatgtggcacagtttatcagtttggtcctgggggtgaatggattcagaaatcatttgcactgtgctgttaatttgagttttaatgtttcaaaaattctaa

SEQ ID NO: 633954 - DNA, 331 bp, Homo sapiens
ctcgtagaggaggatgcttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccccctccaaggcccaa

SEQ ID NO: 633955 - DNA, 1499 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaacccggggggattttatgtgggggggggggaaaaaaggggtataaaaaaggggccaggggaaaacggggttcccggccccagtttctgggcaccacagggggaacacacggggggaccccaataagggggggggaataaaatgcgaaaaagcccggtaaccgggaaaa

SEQ ID NO: 633956 - DNA, 168 bp, Homo sapiens
agctcaggtcaggctatatacgtctatccgcgttaaaatctgacatgcagcttgccgaactagctatgaggaaacagttagtaataacttaccaaaacacacaagttaaggttaccaattaggtgggctctaacagaatgattgtgttgtaccaaaaaaaaaaactag

SEQ ID NO: 633957 - DNA, 1945 bp, Homo sapiens
  misc_feature (708)..(708): n is a, c, g, or t
  misc_feature (1945)..(1945): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaacccaggcgttccgcccaggcgttccgaaagaggtcccttagtcgggtgtgggctcgagggattcggggcctccaggaccaggggcccacccttttgcccagggagctcctagggttcccttgaggtcttcccgaagggcctctcagacccagttttcacgggttgttgtggcccgaggaaccctggacagcgccggtgggcctgctgaggcctctcttgaggctgtgcccggggggtccttgcttaccagtggctgacccagttgccctggggaccctctgacacacccttgggctgccccactgcccccctgtgtgcaaccctcttctacggtggccacggcaaaattgggcccttttgaaggggacatctgcgcggtacaacccgggtgtcgcgatgaggagcctcccaagagcccctcttcgagaggagaccccaggagataccccgggcagcggtgatcacgcgaacaagtatcctccgtgcgggaagagggcggactgccgcccgtgattcaccccactgattaaggaagcaccggtgtccttcaataaagagaaggtgcagcccccctgtggtgcagaacacagatgcgaccaagatacgaacctctctggtgatgcaattggacgn

SEQ ID NO: 633958 - DNA, 120 bp, Homo sapiens
acgttggctaatttgaatcattgatgaccacagagctgggacaattgttgtgaacctcacaggcaggctaaacaagtgtggggtgatcagccccagatttgacgtgcaactcaaatgacc

SEQ ID NO: 633959 - DNA, 125 bp, Homo sapiens
cagatagatcacctgacacctgctctggacactggatctccacaaggtagatggctccatgaggcgtggctgggcggtcagcacactggcgtagaggcatgcgccgtgccgttaggccgatctga

SEQ ID NO: 633960 - DNA, 1545 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaagaaagaagaagaaaagaagaaaaagacgacgagaacaaaaacaaaaccaccacgagggagcacaaaatatgaggcggggggggaaaaaaaagggaggatatatagcggagaacgacggaacaacgacgggtcacacggcgccacaggttagtggacacgagggggagaaacggggggacccccaaaggggagacgagaaaaaagcaagaagagccgaggaaaccgcgtagaag

SEQ ID NO: 633961 - DNA, 794 bp, Homo sapiens
gggctgcaggaattcggcacgagcaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633962 - DNA, 387 bp, Homo sapiens
ctctggcagtgcagtttcagagtctcctaaatttacggcaagacgaaggtgcgacaagggccctgtggtttcctggtgttcgtatgtgaatgtgctccagttagagcaacaggatgtatggggaatgaagggataagagctatggtatcactggatggggagaggtgatgagatcacaagaggaatttggagcccagggtcagccctctcatcctgcccaaatgttggcagaatctgggtcttagactagcataagtgaagtctggggagggccgaactccaaggcagaagaaagaatatctctcagcactaatgctccccttccctccccctaacccagaacatcccttgggttatcgcaggtgaatactccaatcagatgccaca

SEQ ID NO: 633963 - DNA, 800 bp, Homo sapiens
  misc_feature (29)..(29): n is a, c, g, or t
cttcgaggccaaagaaattcggccaaccnaagtgtcgccaccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633964 - DNA, 800 bp, Homo sapiens
  misc_feature (18)..(18): n is a, c, g, or t
  misc_feature (24)..(25): n is a, c, g, or t
  misc_feature (33)..(33): n is a, c, g, or t
taagcttacggctaggtncgggcnnggtgttantcgccacgcgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633965 - DNA, 473 bp, Homo sapiens
ctctaccggatccttttttttagacagagttacctctgtcatccaggcaggactgctgtggtgcaatctcaattcagcgcaactcaggctcgtggattcaagcgatcctgtgcttcagcctcctgagtagccaggattacaggcttgtgccaccataccaggctaatattattgtgtcttcagtagagacaggtttcaccgtgttggtcaggctggtctcaaactcctgatctcaaacgatccacccgcctcggcctcccaaagtgctggttttacaggcacgagccaccgcatccggccactgttactacttttttaagaaaaaaacttttaacctaccattttcataggctttacctgtgagcttgccttagtgctgaaccctgtgacttttcaaggcttcttccaggtctgtgtaactgcctaaaataccctgttaaatcttggtgacgattgtctacagacacttctga

SEQ ID NO: 633966 - DNA, 311 bp, Homo sapiens
  misc_feature (108)..(108): n is a, c, g, or t
tacctaaatggctgtggctgtagcacataggactttttacatggattactatctagaacatataaagagctcatatacatagattagaaaacatcaagacttccattntgctaattgtaaaacagaacaattagtcaaataaacacagcatggaacatgttcccatctctgagcagggatcacaaggaatgaaaaactttaaaaaccaaaagagccctatataaatttagccaaaaaaaatagttaagtccccacacattattaacgatcgaaagctagaagacaattctatatactcacttaggttaaca

SEQ ID NO: 633967 - DNA, 1041 bp, Homo sapiens
  misc_feature (90)..(90): n is a, c, g, or t
  misc_feature (270)..(270): n is a, c, g, or t
tcgtttaaggagaactgaagttttttgtcatctgctgtggctgttctatgaaccaccttcttctttctgcgagcagttcctgtgcccacncaatgcgcacttgtgcctgcagtttggcgagtttttcctggttcatgattgtttctttcattctttgttcgggagcgaaaattatacgggtggcccgcgtcgggggactagggttggtgctcaaggggtctcgcggtggaccaccgtgagattatggcgcacacacgcggggacgcaagncaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633968 - DNA, 853 bp, Homo sapiens
cggccgcgttgtactccaccggtcaggttgtactccaccggcaggttgtactccaccggcaggttgtactccaccggcaggttgtactccacgggaatggttgtactctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633969 - DNA, 810 bp, Homo sapiens
  misc_feature (23)..(23): n is a, c, g, or t
  misc_feature (25)..(25): n is a, c, g, or t
ccgcccacgcgtccgcggacgcntnggcgccaccgaggtcgcacgcgtgagacttctccgccgcacgccgcccctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 633970 - DNA, 135 bp, Homo sapiens
  misc_feature (18)..(18): n is a, c, g, or t
  misc_feature (51)..(51): n is a, c, g, or t
  misc_feature (75)..(75): n is a, c, g, or t
  misc_feature (110)..(110): n is a, c, g, or t
tcccgggctgcccccaanactccgggccctgccccctcccactcttgaagnggaggccgcctcctcggggctccnggctggcttgcccgcgctctttcttccctcgtgancagtggtgtgtggtgtcgtctgtga

SEQ ID NO: 633971 - DNA, 1723 bp, Homo sapiens
  misc_feature (708)..(708): n is a, c, g, or t
  misc_feature (926)..(926): n is a, c, g, or t
  misc_feature (994)..(994): n is a, c, g, or t
  misc_feature (1006)..(1006): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcacgccgccgcgtgagtgtggtgaccgggcccggggtgccgnctggggacgcggagtcgtggggatgcggggtgggcggcggggtatttttgggacggaggctacgggcnagccacgcgccntcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaagaaagaagaagaaaagaagaaaaagacgacgagaacaaaaacaaaaccaccacgagggagcacaaaatatgaggcggggggggaaaaaaaagggaggatatatagcggagaacgacggaacaacgacgggtcacacggcgccacaggttagtggacacgagggggagaaacggggggacccccaaaggggagacgagaaaaaagcaagaagagccgaggaaaccgcgtagaag

SEQ ID NO: 633972 - DNA, 438 bp, Homo sapiens
ttacaccagatgctcccacctggtgaggacaaatacattcgaaccatagcagcaggattcactatatggaccacgtcacatcatactctagtgccagcgtcactgtgtagtcccacccttgtgaaactagcattgcatctcgtggagctctggcttgctcggacacagtgctcaggatggaatcaggtagccaccaagtatataggtactagttgaccttggggcaggcatataagctaccccaaggctcaatatccccatccctacatggggatagtcagttgtaattacctacgtatgatagctttgcaggatataataagctgattacatggaaaattgttagctccatgtcttgtcatagaccgatttccacagctctgagctctgattgctgagatacgcttgtgtcttgcaccttccagggccggtgcctgg

SEQ ID NO: 633973 - DNA, 477 bp, Homo sapiens
ggtgtctctagaggatccgatcctacatagtgttgtcaagttaacggggcaaacacggagactaggggcagagcggtggattaggccaggtatgtaacagggtagttgtaggaggtgagagagtgctacaagatagcttggaaaagcgctccccaaattggttgactcgagacgatacacacacactataagagacgggaacagactcaagccactcatacatccgtggccatcagaagctgcacatgcagagatttcgagagaatccggcagagagcaaaagccagggaagagttggaactggcctgaagtaagaacgcacttccagcgcacatacagatccattagcagagagctgtgcgtttacgggccgggggtgtaaactaaaaatctcttaccaatctgactgatccctaaataatggagacagagaacccaaggaagccaattgatatcatagctcagaccatacctatg

SEQ ID NO: 633974 - DNA, 449 bp, Homo sapiens
gcaggcctctacctcatcgccacttccagcaccaggcaatgctaacatcttccacacggatcccggatgtgaacatgcggcacgtgttggtctggggcgaagggcagcccatcgagtacggcaagaagaagctgaattaccggccctacaatcaccagcacgaatacttcttccggatggggccgccgctgctcatccccatgtatttccagtaccagatcatcatgaccatgatcgtccataagaacggggtggacctgggccggggccgtcagctactacatcgggttcttcatcacctacatccctttcaacggcatcgggggagccctctttttcctcaatttcatcaggttcctgggagagccacgggtgggggtgggtcacacagatgaatcacatcgtcagggagatggaccaggaggcctaccgtgacgggtacagtagcc

SEQ ID NO: 633975 - DNA, 220 bp, Homo sapiens
gggttttttttttttaaccccccaaaaaaaaaaaattttttttttttggggccccgccccgctttttaaatttttgggggggtttccaaagaaaaaccctttttgtcccccccccccccaaaggggaaaattaaaaaggccccccgggcgggggtggacccccctttttgggttttggtggggcccccccggggggaaaaaaagtttttttttttttcca

SEQ ID NO: 633976 - DNA, 920 bp, Homo sapiens
  misc_feature (72)..(72): n is a, c, g, or t
  misc_feature (895)..(895): n is a, c, g, or t
cttgctctgtgcctcaggaggccctgagtccggcacctggccatgtgcaaccctgaggaggcagctctgctnggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatctgggcaggacgggtgcacgttnacctctcacgcccgagaagagtctc

SEQ ID NO: 633977 - DNA, 337 bp, Homo sapiens
  misc_feature (4)..(4): n is a, c, g, or t
gtantattcctgaagctctatgccagatctatcaggcctgctttctcagctcacaacgccatcctttaggttgctggagcagttcccaccgtctccggccttggtggaaatggggggaggggagacagctggctgctgaaatggagcagctgttcggtttcactagctttgttactagaactttacgtgaggggaggataccttgtatatttccttatgcattttgagcccaaaatctaagagaaagttggggcacacaccctcatgtgaacgggctcatgggaagagcattactctatactttgcagagttttggattaatactagatgcttaagc

SEQ ID NO: 633978 - DNA, 347 bp, Homo sapiens
tcaagccccgagttgtccctagaatactctctgtaaccatatctttccttctccttccttggttttttcaaagggcccaagacctccacaaagctactacctgcatttgtttgtcaatgtgtctccatgtccctggagaactcacctgtgccctgtgtggtcagagaggaatctatttcttacatcctattggagcctcatttgaaatcaaacactaaaaaaaaaaaaaaaaagggagcactcaggccttggatatctttgggacacttcacaaaagaagatcccgggaccccataggatgcaggcaacacagagatgtgaggtgagagggggcacacattatggag

SEQ ID NO: 633979 - DNA, 391 bp, Homo sapiens
tgtggaaactaattgccaggttcgctgggagctttttcagctaggattctgtctcatcagtgatgatgaagttgatgatgttatgtataagaaatggtcttgagtttactctgcaccttcctaagtactttatacacatcaactcatttgtaaccacaactccatataccaaactattataatctcatgctcacaaatgaagaaactgaggattaaagatgttaaatatccttcccaagatcaaagaattgaaaagctggcatatgctggaactggaatttgatatttggccagactctggaacctgtgctcttattcactattagcttgtatatcagaactaatgaaatgtgtgtttggcaagaactaataaaaacaaaggcagtagaaa

SEQ ID NO: 633980 - DNA, 575 bp, Homo sapiens
  misc_feature (537)..(537): n is a, c, g, or t
  misc_feature (549)..(549): n is a, c, g, or t
agagacagggtcccattatgttgcccaggctggtctcaaactcctgagctcaggtgatcctcttgtctcagcctctcaaagtgctgggattgcaggtgtgagacactgtgcccagcccccaaaattaatttttaaaataaaattttcaatttgttctgaaatcctttaaaatgtaaccaactatgaaaatatttttatacaaaaaaaaatttaaaaatatttaaagacccactctttttcatgttatttttgttagtagcagctttagtgggggaaatgacaatatgtgtgtaaaggaaatctacatttgttctgtttcatctgctttgagttactttttaaaagtctgggaattggtggctggatgtagtggctcacgcctggtaatcccattgctttaggaggccagggtggggagaatcacttgagcccgggagtttgagggtgcagtgagctgtgtttgtgccactgcccttcagcctaggtgacagaataagaccctgtctcaaaaaaaaaaagtctggggaatggtttgcnccacctggctcngagacccaagatgagcaccagttatt

SEQ ID NO: 633981 - DNA, 393 bp, Homo sapiens
ccagtgggtccggcctcttgggccttccagttatgccccttagatggcccccgtccaaaaaaccgggggtccctttttagattgtgggtcttcagaaaaattttgcccttttcctttcccttcctgaaaggcaggggcggcttgttaaaaggtgtttaaccacctgcttaatgtgaaatgtccaccccccctttaaaccttccctggtcagagcctccgatgaagacttccttggggtttatagtggcctttttatttttggtaggccctttaaaaagggggttttaaagttgttgtattctgtttacgattgtctgcccctgtcccgcccgaaaaaccctgattgtttttgggaaggatcttttataaaactggaaaccgtttggcttggga

SEQ ID NO: 633982 - DNA, 323 bp, Homo sapiens
cggcacgagggtgagcgccagggtgagtgtggcagcctccccaacccccacctgtttgaaatggttttcaaatgccaaagccagattgcccgggtttcaaaagttgcaaacagttggagtaaaacacgtgtgcggccctccagccccaaaggaatccgcggagtccagggcactgaaagaaaaggagagaggataggggttcaggaagggttgggggggagttgccttctcccggcaggtcggttttaggacccatcgggaagcacgttggaatctctcccttcggggaggaggggaggggtgggccggccggcttgcggccg

SEQ ID NO: 633983 - DNA, 1930 bp, Homo sapiens
atgcgtggtgcctgtgtcctgctctcgcccgctctctgcccgctcgccagcctggctctcctccctgcctgcaggacccgctgctgccgcgctcggggtgccatgcagctgcctgtgccatggacctgcggatgttgtcccggtgagctctccctctacctggaacaccaagtccgggtggggttctatcggctcgggggtgggcttatcccttatcctgccgcttcagcagtcgcttatgccttactaatacctgagacagcattgccaagaaaccccagttagtgaccgggggtgagagtttcagcccgacttccttcaagaccacttgtcccgtggttccagacacgtactacccgacggttctggtgctgggcagggtcggaggacagaccctgctttagacctttcatcacttccgaaggcccacggtgccagtacaggactgcacctcattaacacctgcagcatggacggacagattacactggactgtcttgatcctgatcaacagtaccgtgataatatgagatgccagaaaccgagagccaactatcaaatggtgacagggactaacgggcacacacgcaaggagtacaaactctccatatgaaacaacataatagaaagctaggacaacgaagcgcaggctacaaacaacacaagactgggagcacgatcctgccgccgcacaatgtaggcatcacgacgaccacgaaccaacccatgacagcagaccagcacacgcacgtcagagaagaccaacaaccccgaggcatcgcgacaggactctgccactatctaaaaacgccgccctccagtacaccagccacaacgcatcacacacagtcaaagacaaatcacgccagacgaccgcgcatgagagaagagaaacgacaaacgcaaacagatcacacgcaggagccatgaatcaaacacgacacgagcaaggaccacacgactacgacatgaccagtatgcacacacacgccgatcaccacacacatcacagccaacaagccacaagacccacaacaacgaagaaggcgcgagcgcgacatgacaacgccgagacacggaggagagcgacggaagaagacagagggatgaggagggacagaccgatcgcgagagagtacacgacacccacgacgacggagcagcgccaggacgcaacaggtcacaagcagggcgggagagctaacatgagatgggaggagagctgaggaatgaagagagcgggaggcagagaggaatggaagaaacgaaggaggagcggacgggagagaggagagaacagaacgaggcacgagcaacctatacaatgcaaccacccgaataagccctaaacaacaatgacactctacaaacgagaacgcacactatcaatgaatagagacactaatatccactaaacaaatcctgcatgattccagacatacaagctagtcaaataatatataacacaaagataaacactacatcgaaatcacaaaaagatctcaaagacaaccacactaatctaaaaaacaatacaatccatacttaacaaacaacaataacagagacacaacagaccaccgacacacaaccatacaacgagatatcacgactaatcgacactaacatcatcataacaaactacacccacgacgaagacagcacatgacggtaatcatgcgacaatagagagccacatccaagaatgacaaatataaagacatagtactagcacatcacaacacaagacgaaagacacttagaaaacacaacagaacgataagaacgagagacaatcaatacaactacatagactagactatcaacacaagccaacaaagacgacttctactacacaaaacgaatcgcaatactaaatgcagcgaaagtatcgacagatagagactgaaagccatagagagaaactaat

SEQ ID NO: 633984 - DNA, 656 bp, Homo sapiens
  misc_feature (656)..(656): n is a, c, g, or t
tagagttaccagtcccttctctaaactgcagggttaagggcatgagggctggactcccaaggccttgggcaggtctgcacctgtgtctttgcagttttcagtccccacagctgccctcatgggctttgctggtgcagagtgcctgtagtctttacccacagagggtacaaagctcttggtgggtccatgaatctggggtctgcatgatggtggcctccagtgtggaggctccaaccccatattttccttctgcactgccctagtagaggtttcccaggaggctctgcttttttggcagctttctgtctggacatccaggcattttcatacatcttccaaaatctatatgaaggctctgaagcctctgggctagtgctctatggactcgctggcttaagactatgtggaagccgtgaagccttatagcttgtaccctctgaagcagtgatgcaatctgtacctgtgcatctttcagccaaggtcggagcaggagctgcggctgctgggatgcaggcagcagtatcctgaggctgcacacagcagcagggccatggggctggcccccggaaaccattcttctctcctaaggcccagggtctgtgacaccaagggctgctgcaaccatctctgaaatgcctccaaggctttttccccan

SEQ ID NO: 633985 - DNA, 440 bp, Homo sapiens
  misc_feature (298)..(298): n is a, c, g, or t
  misc_feature (400)..(400): n is a, c, g, or t
tgccatatccaattacaaataccctttgtagaattaaaatgacctactgtaaggattaagtactgttgtgtatccagaggagttgatccccaatacatggccacaaagaaaatactggtgagtatggtttgtaagtaaaaaaaattcagggcccgggccgcaagttgtcacgccctgcaatccccagcacccttgggaggccgaggcgggcggatcacgaggtcaggagatcgagacccatcctgggcaacacggcgaaaccccatctctactaaaaatacaaaaaattagccggggngttgctgggcgcctgtagtcccagctactcaggaggctgaggcaggagaatggcatgaacacgggaggcggagcttgcagtgagccgacatagcgccaactncgtccggcctaggtaagagatcccagactctgtctccaca

SEQ ID NO: 633986 - DNA, 548 bp, Homo sapiens
taatataaattagaagaaacaatctgggctgtgacaggcaattcacttgcgacaagctgtccaggtctaatcgacaggattccgattcctgaagagtgtcattcgaatcagaatgtcagagctgagtctgctgtcctgacttaaggaacaacttgactcagtctcttgatggctggagaatgcacatcctagctgtcactggggctacaggcaggtcagtgagcacgctaaaattttccgttctcaattacacttcaaatagcaggcatattactcgtataagatgctatctgatgatactaacctttctgctggtaccctcccactgctcctaaagccacaccttaatatacattctggtgctgtgtactaatgtagttccactgtcaagtcttaacattcttcaaaccagtgtctggggtagatagactatttgtttgacatggcacaatgttttgaattgggtgggaatctcttcccccagttagaataacagatttaaattacttgtgctactgaaatccatttgacgggaaaatgagatgtgc

SEQ ID NO: 633987 - DNA, 553 bp, Homo sapiens
  misc_feature (35)..(35): n is a, c, g, or t
  misc_feature (363)..(363): n is a, c, g, or t
  misc_feature (404)..(404): n is a, c, g, or t
  misc_feature (471)..(471): n is a, c, g, or t
  misc_feature (479)..(479): n is a, c, g, or t
  misc_feature (549)..(549): n is a, c, g, or t
ccattgccaacaagactcctcccagcacctgtagnacctgtgtcaggttttgacactgaactgggcgattactcctcagctggccccctaccaaacaatgagcccggctgtgtgcgccttccttccccactcactgaccggctcagccagtgtaggcttccagagggagtcatcttcagccagccccaagacagcagagcagaaaagcctggatttatgaagaggcagatatgggagccccggtgacacctaagaacagtctctgaagggttgttgtgtggtgggtggtgagcaaccactcccctttccacttaaaattagagtaagaggaaatgaacgggaaggacagtgggtaggattganagtaagccctgcggataaagggaaacggtagaaggctcttnaggggtggtggtgtgtgagttctccatataactaaggaagattttcacggggcggggggtttgcctngcacacancaggaacccgacttacatctgataaaaaaaaaaaaaaaaaaaaaaaaaaaaaaaagggataaaattaaanaaaa

SEQ ID NO: 633988 - DNA, 892 bp, Homo sapiens
atgcctggtaattttgggattttagtagagaccgggtttcaccctgttggccaggctgtctcgaacccctgacctctagtgatcttcccgcctggcctcccaaagtgctgggatataggtgtgagccacagtgcccagcctgtgttttggttggtcgtttggacagtctgtcacctctgtcacccaggctggagtgcagtggtgcgatctcacctcacttcagcctctgcctcccaggttcaagtgatttctcctgtctcagcctcctgagtagctggggattgcaggcgtgcccacacgcccagctattttgtaatttcattaaaagacagggtttcccccatgttggtgaggctggtctcgaactcctggctcaggtgatccacctgtttcagctcccaaagtgcaggcataacagggcatgagccatttgtgcctggcctcaagctatcttgaatgctggagaattaaatcctttctgtctaagcggtggcagtcctaagggctgggcaaaaacagtggatttatagacatagagtcttgctcagtagctccttgaattctgcacctgatgatcaggttctggccaacagttaactcagatggcagcccaagaaggaagtctgcagtgcttcttacatggcatcagccttgatcactcaggtcggctagccgtagtaatgacgggggtatcagccactaacatgcatgctcttaagggtggccctgaatcccgatacggcagtccacggcgccctggagcgtggcaaaaattgccggcgcgttcagggaagcgattgagcctaaaggaggtgcccctatataaagaagggggggggggcacacacaccgagaggcggcacacgggcacaaaaacaggggcggaatcgga

SEQ ID NO: 633989 - DNA, 708 bp, Homo sapiens
caacgacgatggatgcctttctctaatgtgcgcacagccaggccgctcctctgaaggcgctgagccgcctctaatcacagcgccacactggccacaggtcgctgggtataggatgaacccagctgtgaataggatgcatttcctgggaggtttctgtgaagttactgaactgccaaaaggtaagcagttttaattgatttgtgagtcttcaattaagcacagcagaatgctaattaaatattctctgttctttaaatagagaatgctttaaataattcagcacaatctttgcataaatcacaccattcagctgaggtgcctgtcagcagtcaagtgattgagagcacaaactgtcccaaagacacagcccccttccccctggagacgcgcacagcctgcagaagagatgtcacctgatgcagcgttgtggtttaaaaactcattatgggaagcatgaggctggacccaggggaccctggaggtgatgcaggggctttggcagcctggaagctgttggaggaggggcccttggtggaagtggggacagtttgagcctccggcctccaattccctcccgctggcttctgggccgcacctccaggaatccagctagacccgcagggctctgactccagactttattaaatgtttcctctaacggttctggccattctgctgggccattaaaggctaccccagggcctcaga

SEQ ID NO: 633990 - DNA, 205 bp, Homo sapiens
gatcccccgtctttaccctcgaccagcagcaccgcctgctggccgccacccactcggtcggcgtgcgcttcatctgcgcctgcctcccgacccggccaggcttgtcggctcggacaatctatgcctacccagctggcctgttctggcgcgctgctgccacgaattaggtaccgcgcccgacgcattgcgtgcccagcccagccag

SEQ ID NO: 633991 - DNA, 1135 bp, Homo sapiens
  misc_feature (937)..(937): n is a, c, g, or t
  misc_feature (1115)..(1115): n is a, c, g, or t
  misc_feature (1120)..(1121): n is a, c, g, or t
caacgacgatggatgcctttctctaatgtgcgcacagccaggccgctcctctgaaggcgctgagccgcctctaatcacagcgccacactggccacaggtcgctgggtataggatgaacccagctgtgaataggatgcatttcctgggaggtttctgtgaagttactgaactgccaaaaggtaagcagttttaattgatttgtgagtcttcaattaagcacagcagaatgctaattaaatattctctgttctttaaatagagaatgctttaaataattcagcacaatctttgcataaatcacaccattcagctgaggtgcctgtcagcagtcaagtgattgagagcacaaactgtcccaaagacacagcccccttccccctggagacgcgcacagcctgcagaagagatgtcacctgatgcagcgttgtggtttaaaaactcattatgggaagcatgaggctggacccaggggaccctggaggtgatgcaggggctttggcagcctggaagctgttggaggaggggcccttggtggaagtggggacagtttgagcctccggcctccaattccctcccgctggcttctgggccgcacctccaggaatccagctagacccgcagggctctgactccagactttattaaatgtttcctctaacggttctggccattctgctgggccattaaaggctaccccagggcctcagatatgagcgtggtgtctgtatgtggtcctttcatggagggcaggaagcatcataattacttttttttttaacggttttcaatttgtgttgacaaagagccttagtgaatctgttggaagaagagtgacttcaaaatgaacctgactccctgtatgttaggagtccatattctctgatacagttaacgttttccttccaacctcttcactgttcaagcaaagtggtatttnagctattcactgtttgacactttaataggagttttgatgagcaatttcaggatgtggaattgctacactgcaccaggttcctgcaggagcagcagcctcagcctgtggatgggacgtgagatcttggtgtttctcctggaggaaacgctgtgctgctgtgttgatgacggggcgtgtntgggnntgatgagtgggtga

SEQ ID NO: 633992 - DNA, 297 bp, Homo sapiens
caaaaaatttaaaaatggggaattagggggggagggggtccttaacaattgtcccccgggctcggggtttatgaaaaagtagaataaaaattccctcccccctttgggccggggtttatttaaagaatgccccagccccgttcaatgggcaaatttcccaactgttttttttttttttttttcattactggggtccaatttttttttcataaacctttttcaacccgctttttccaagtgggttgggttaattagggtcctccccttggttaataaaaaaaaggggttgtgctttta

SEQ ID NO: 633993 - DNA, 103 bp, Homo sapiens
ctgactagaggatcccggtcggctatctgtgctttctcgtgtacatcgcgccatcattggtatatggttagtgtgttgagttagtaggcctagtatagagtga

SEQ ID NO: 633994 - DNA, 336 bp, Homo sapiens
  misc_feature (1)..(1): n is a, c, g, or t
ngagagagtctctgtcgcccaggctggagtgcagtggcacaatctcggctcactgcaacctccacctctgggttcaagcagttctcctccctcagcctcccaagtagctgggattacaggtgtgcaccacccacacctggctaatttttgtatttttggtagagacggggtttcaccatgttggccaggctggcctgagactcctgacctcaggcgatccggccatctcgacctcccaaagtgctgggattacaggcgtgagccaccacacccagcctcctcaccaacttttgatattactagttttttacttttcagcccttctgtcgtcttctc

SEQ ID NO: 633995 - DNA, 666 bp, Homo sapiens
gtgtgtgccttaaagacaagacagcatatgtgtgttacaaatgtaactgtggttaaaatcgcggtagataatgaaaaaaaacaaaaaaaaaaaccttggggatgattcttaacatgaccaaatttaaaagtcaagctctcagagcttaattaccggcatcagcaagaaactggagtattttttggcaataagaaaacaacaataataaggggaaagctggggtttcattggggttcttaataattccaataatggtatgaggcaactattggcggcatccaaccatgagtgggaagggttggggaaagactggggggacctttcacttagaaaggtggaaatggtatgtagaagtctcaagtaccccttctacagttttactgggagaaaactaagagccatattcatgacaactggcacagtttggaggttggagactttggatatggggtaagtggcatagaggaggatattatcatgcaaatcaggagcaattatcacataaacttttttagaatgtggccatgaacatggctataaaattcacatggagtggcacagggcttaaaataaagctaagtatgtgtattcccaattgccatggcaaaaatggatgatatccatcgaaatgggagggagatctcccagaaggtgtctaatgaaagg

SEQ ID NO: 633996 - DNA, 863 bp, Homo sapiens
ggaggattacttgagaccaggagtttgagactaccatggacaacatagcaagaccccatctttacaaaaaatttaaaaattagccagacacctatagtaccagctacttaggagtctaacagtgggagaatgggcttgaccctgggaggttgaagcagcagtgagcttgtgatcatgccactgcttccagcctggtaacaagagtgagactgtctcaaaaaacaaaacaaaacaaaaaaatgggttttgggtgtgttggtcttttacttaggacacctgctctagaggctagataacaaatagatggtaatggccgggtgcggtggctcacaatttgtaatcccagcactgtggaggctgaggtgggcggactccacttgaggtcaggagtacgagaccagtctgggcaacatgttgaaaccccatctctactaaaaatacaaaaaattagtgtggcgtgttgatgcgcacctgtagttctagctacttggagcctgaggcaggagaatcactgcaactccgctcctggttccagatgattttcctgcctcgcctcctggggtgactgggactgcaggtgcccgccaccacgcctgactaattgtgaatttccagtagagacggggttcaccatctggggcaggtgggtctccgaactcttgactcgtaatcacccggctggcctccaaagtgcggattacgtgttgcccgggccagccaatattattcgaagaagactttaatcttatattggttacccctcacccgaggttatgggcaccatggcaaggcaattactcccaaaagggaaaaacggccgcgggatagcaacaaacctcaaaaggggccacccgtttccacaa

SEQ ID NO: 633997 - DNA, 115 bp, Homo sapiens
agaaagcgttcaagctcaacacccactacctaaaaaatcccaaaccatataactgaactcctcacacccatttggaccaatctatcaccgtttagaggacctattgtaggattag

SEQ ID NO: 633998 - DNA, 712 bp, Homo sapiens
  misc_feature (23)..(23): n is a, c, g, or t
  misc_feature (25)..(25): n is a, c, g, or t
ccgcccacgcgtccgcggacgcntnggcgccaccgaggtcgcacgcgtgagacttctccgccgcacgccgcccgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaagaaagaagaagaaaagaagaaaaagacgacgagaacaaaaacaaaaccaccacgagggagcacaaaatatgaggcggggggggaaaaaaaagggaggatatatagcggagaacgacggaacaacgacgggtcacacggcgccacaggttagtggacacgagggggagaaacggggggacccccaaaggggagacgagaaaaaagcaagaagagccgaggaaaccgcgtagaag

SEQ ID NO: 633999 - DNA, 200 bp, Homo sapiens
  misc_feature (96)..(96): n is a, c, g, or t
ccatatccattagcagccatttcccattaactctccttggccccttcttttttttttttgcaaccactaatttgctttctatctctatggatttgnctattctggatgtttcagataaatggaatcatgtaacatgtggacttttgtaacttgcttttttcacttagtgtgtgtgtgtgtttctttttgagactgagtct

SEQ ID NO: 634000 - DNA, 474 bp, Homo sapiens
  misc_feature (282)..(282): n is a, c, g, or t
  misc_feature (397)..(397): n is a, c, g, or t
  misc_feature (436)..(436): n is a, c, g, or t
gtatggcaactgatcatctttgtggagtcgggaaatctatttttatcacctttattcagccagctcctgattgtgattctctcactgagctacagccgttttcttcatggtgctgaatagaccaaatgtctcaggagtctgaaacttctctcctgccactcccagagtggctgattcagcagtcccgggagaaggggtttgtcctgtgctgcgcgggtgggttccgcacaaggtgaaggtcaaataaaaccgagaggctgcaagtgtcagcagccagccttngactcaggaatcctgcctgagggtatgtgccactctgctctcctgctctctcttgtaaggtgacttagaagggtgacttgggcagcccataactcctccaatttgggaagacctncccaagggaagaagggggaaagattaagccaccctcctnacaggttgccaatacatctcctcaatcttaatcatcgg

SEQ ID NO: 634001 - DNA, 262 bp, Homo sapiens
gggggcgacaaccttaccagcggtggggatagctggttttccaaaataaattcttggttcactttttaattttgcccccagaacacctttaaaaccctttggaaaataaaacggtgggccccaaaggggaaacctttttttgtgacctttgggaaaaaaccttgttggggggggggggaaaattttttccccccttgtgggggcgttataaacgcccccccatttaaaaaaggggggtgtggttttcacccccccttttttt

SEQ ID NO: 634002 - DNA, 1630 bp, Homo sapiens
  misc_feature (708)..(708): n is a, c, g, or t
  misc_feature (1322)..(1322): n is a, c, g, or t
  misc_feature (1421)..(1421): n is a, c, g, or t
  misc_feature (1423)..(1424): n is a, c, g, or t
  misc_feature (1431)..(1431): n is a, c, g, or t
  misc_feature (1436)..(1436): n is a, c, g, or t
  misc_feature (1439)..(1439): n is a, c, g, or t
  misc_feature (1443)..(1443): n is a, c, g, or t
  misc_feature (1445)..(1445): n is a, c, g, or t
  misc_feature (1496)..(1496): n is a, c, g, or t
  misc_feature (1502)..(1502): n is a, c, g, or t
  misc_feature (1508)..(1508): n is a, c, g, or t
  misc_feature (1523)..(1523): n is a, c, g, or t
  misc_feature (1532)..(1532): n is a, c, g, or t
  misc_feature (1536)..(1537): n is a, c, g, or t
  misc_feature (1553)..(1553): n is a, c, g, or t
  misc_feature (1575)..(1575): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacaaaaaaaaaaaaaaaaaatctcgagactagtnctcggggggtggagaagccatgagcagcaaagtctctcgggaacctggtacgagggggggcggggaagtcctggcgggggaaccagcgcaagcggccgnanngtcccgnggganacngggngnagtggcagatcagtggaagaattatgatccccagaggacaaggcgcttccnggggcnccgccnggctaaagtccactnccccgcccnaagnnctctgggtgtggtcgngggggacccagcagcctgtgancgaggcaaggcggggaatccccaatggactcgagggcgaaaaccacaagaatccg

SEQ ID NO: 634003 - DNA, 387 bp, Homo sapiens
tgggggaccggggtttttttacccccggggggggggggcaaaaaaaaattcccaaaaaaagggggcaaatccccccccccattttttttaaaaggggccacaaaaaaaaaggttttttttaaaaaaattttgggggccccaaaaacaaaaaggggggggaaaaatttaaaaaaaaaacccccggggaaaaaaaaaattaaaacccccctgaacgggggggggtttttttaaggggggggaaattaaaagtttttttccggggccactgggggagaaaaatggttcctcacagggggccaaaggggggggaaaaaaaaaaaacccccttttccgggggggtatcacccccccgggagaccgggggctataaaagggggccccccccca

SEQ ID NO: 634004 - DNA, 134 bp, Homo sapiens
gctcataaggggatggacaatggctaggtttatagatagttgggtggttggtgcaaatgagtgaggcaggagtggaagtgaaatcacatggctaggccggaggtcattacgagggctgagagggcccctgttag

SEQ ID NO: 634005 - DNA, 1542 bp, Homo sapiens
  misc_feature (708)..(708): n is a, c, g, or t
  misc_feature (1294)..(1294): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcnacagatcatgaaaaacgcatagacacaacaagaagatatgactcgacgggatgaaaggccaataggaggtagacgagaaggccacaacgggagcaactacagctgacattgtagtgtagggacaagcagaataccaggagcatggtggaggacaatggtctagccaatgaaccacaaggagatgtagacaacgggggatcgagctccccaggggggggagaatagacccaaggagggagcctctgtgg

SEQ ID NO: 634006 - DNA, 185 bp, Homo sapiens
ggacttggacagaaataagatgaaagacatcccaaagaggccttctctcagtgtttatctacattatttctcctctgtttgcagagttgaaggagaagagccaggcgtgcggagggaacttggggtcattgaagagctgcgaggcactactagcgagagcgtgcctgcattcgacacatgtgcag

SEQ ID NO: 634007 - DNA, 900 bp, Homo sapiens
  misc_feature (19)..(19): n is a, c, g, or t
  misc_feature (85)..(86): n is a, c, g, or t
  misc_feature (94)..(94): n is a, c, g, or t
  misc_feature (103)..(103): n is a, c, g, or t
  misc_feature (106)..(106): n is a, c, g, or t
  misc_feature (114)..(114): n is a, c, g, or t
  misc_feature (119)..(119): n is a, c, g, or t
  misc_feature (123)..(123): n is a, c, g, or t
  misc_feature (125)..(126): n is a, c, g, or t
  misc_feature (145)..(146): n is a, c, g, or t
  misc_feature (150)..(150): n is a, c, g, or t
  misc_feature (179)..(179): n is a, c, g, or t
  misc_feature (185)..(185): n is a, c, g, or t
  misc_feature (211)..(211): n is a, c, g, or t
  misc_feature (283)..(283): n is a, c, g, or t
  misc_feature (289)..(289): n is a, c, g, or t
  misc_feature (299)..(299): n is a, c, g, or t
  misc_feature (308)..(308): n is a, c, g, or t
  misc_feature (311)..(311): n is a, c, g, or t
  misc_feature (316)..(317): n is a, c, g, or t
  misc_feature (339)..(339): n is a, c, g, or t
  misc_feature (345)..(345): n is a, c, g, or t
  misc_feature (348)..(348): n is a, c, g, or t
  misc_feature (354)..(354): n is a, c, g, or t
  misc_feature (356)..(357): n is a, c, g, or t
  misc_feature (369)..(369): n is a, c, g, or t
  misc_feature (374)..(374): n is a, c, g, or t
  misc_feature (377)..(377): n is a, c, g, or t
  misc_feature (421)..(421): n is a, c, g, or t
  misc_feature (427)..(427): n is a, c, g, or t
  misc_feature (434)..(434): n is a, c, g, or t
  misc_feature (459)..(459): n is a, c, g, or t
  misc_feature (464)..(464): n is a, c, g, or t
  misc_feature (548)..(548): n is a, c, g, or t
  misc_feature (584)..(584): n is a, c, g, or t
  misc_feature (601)..(601): n is a, c, g, or t
  misc_feature (631)..(631): n is a, c, g, or t
  misc_feature (649)..(649): n is a, c, g, or t
  misc_feature (761)..(761): n is a, c, g, or t
  misc_feature (811)..(811): n is a, c, g, or t
  misc_feature (818)..(818): n is a, c, g, or t
  misc_feature (830)..(830): n is a, c, g, or t
  misc_feature (896)..(896): n is a, c, g, or t
aactcctgtgacataaaangtggaaagtgaggcaatccatcttttcggcaataaatcttctcttcttataataatgccatcttcnnggaaagtncagataatnccnggccaggnacggnggcncnngtctgtgatcatagcactnngggnggctgaggtaggagaattgcttgaacctnggaggnggaggttgcagtaagctgagatagtnccactggattccagcctgggtgacagatttagattctgtctcaaaaaaaaaaaaaaaaaaaaaaaagtccanaaaatnccttgaaaanaaggttttnaanaaatnncaaatatgtaaaaggtttttanccaccnccnccccancnncccaatgcattnttgcntancaacagtttttttctgcttcttctttgtgggaagtctgagagtntgaaanctgcatnggcttggttgagcttgggaattttnctggnaccaggggggcaaatatccattgtagaagtcagtggcggtaagtgattccttgagcatcactgaccgaacaccaatccaaccanccttgcaataaaccaatagtatttgtgactgtttgngggaaattactgacccnggaataagagcctgtcccgttaattttggntcagcaaggactgaactnttaacttctaccaaatccagaagtttaatggtattcgccatccagagcgtctgcaacggaattatatttccaatggcacggtaaagtctgaatatttgttctgaagtttgtncctcccattttatacaactggtaccagcagaaatcttaggggcgtaagtngcccccnccattggctgcngccttccattgctcagactttcaggcaaatttttcaaaactgaaatgagcatgtgggcacccagtnttga

SEQ ID NO: 634008 - DNA, 2030 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaataaataacaacaaaaaaaaacaaagagagggcgcgcgccgcgcctctctaaaagatattatcctccgcgaggaggcgcccccactatcatttagacgcgcaatcaccgcgccgatttttctgttggactcacaaggaggtggcgccccctattatatgggaggaaggctcttattatataacagcgcagagaccgaccgcggggacgcgctcgttttttataacaccaagctcgctctgagagactgtgcggacacaaacagacttctcgacaaacggctggagcgaacactactttgcggagaaagaagacacaccacttctcgctctctgggggggggagggagcagagacaccaatatgtgtgcgtgagagaaacgcacctcccaaagagacagagagatttatatagcaggcggcctctacgggcgggagagacatctttctacaaacacgttctgatacaagctgcgtgtgtatatagacgggtgtgtgtgtacacacacaatcacgcgggggcgagaatctatgatcggcctggttggcgggctgttgatgacaagaaaccacctctgctcgtactcaacccgcgcgcgggtctaacctgagtgatgtctggccgggagacaacagttatggttatcacacacgccggaggtggcgaccgtccccattgtgcaatcgagacaagatggatggataat

SEQ ID NO: 634009 - DNA, 986 bp, Homo sapiens
aggccagaatgtagtggctcatgcctgtggtccgagcggctttgggaggccaaggcgggcggatcacgaggtcaggagatcgagaccatcctggctaacacggtgaaaccccgtctctactaaaaatacaaaaaattggccgggcatggtggcgggcgcctgtagttccagctgactgggcggctgaggcaggagaatggcgtgggcctgggaggtggagcttgcagtgagccgagatatcgccactgcactccagcctgggtgacagagcgagactccatctcaaaaaaaaaaaaaaaaaaagaatttttggccggaagaatagagaggaggcttgaaggaaccagcaatgaaaaggccggaaaagaaagagctgaaaatggagaaagcccaagagttgaccacgtgggatacgggaaaagaaccgggggctccacttacagacccagccccaggttcaatgtcctccgaaggaatgaagtctttccctggtgatggtccccgtgccctgtcttccagcatccactctccctttgtcctcgtgggggcatatctccagtcaggcaggggctcctgatgatggcagggggtgttgccatgtgatgggtcccctccaggttctaagggtgcatgtccctgtttgaacctgaggccggtgttggcatggcaggtcgccagatgaggagcggtgtcctgagaaacaaatttccgagagtttttagacccacccatgaaaaagggccgtcggtccttaccggatggtaccggtcgaaattcgcttgaaagcgttaccttggcgaggcacatcttaaggtttgtgcgcagatgcctgtgtagcccaatccttcttaaagaaaaggggctaaataccagggcgcacgtaccctttaaggcgaataagttataacggcggcacatcggagaggggttgcgccctgtgggaccacccaattattattcgcggcttagtaccaggtgaatactgc

SEQ ID NO: 634010 - DNA, 2026 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacaaaaaaaaaaaaaaaaaaaaaaaaaaaaaaaaaaaaaaaaaaaaaaaaaaaagagaggggcggcgggcgcgcgcgtcccacaaaatattcttctcccctcgggggggcgccccagtttttcgcgcgcgcgtcccccacggtttttttgtgtgtgacaaagagggggggcgctccccatatatgggagaggagccgcattatattatatacgggcacagaggcaggcgcgggccgcgcgctgcatttatacaacaaccgccgctctgcaggaagtccgggaacaacagggcgcgcccacacgcttggggagcaaactctcttgctggaagcgaagaggggcaccctccctacttactctgtgcggggggggcggcgggcgaacactatatgtggcggacacacaacacactcactcccctatacgcgagaaagtatatttttataaagcgcgccatcctactggaggaggggggacatcatctatataataacacattcttgtacagagcggcgcgtgcttagactggcgggggcgtgtcctatccaacccaagcagcgcgcgccgcatatatatgtgccgtgcgggccgcgctgctgtgatgaagaacaaatgtttgtgtgccgcctacctaacgcggcgagcgaactgtatgttgatctcttctgtggcgtacaacgaccactttttttttttatatcactcgcgcggaggcgcccgggtgtgcaaatcagcacc

SEQ ID NO: 634011 - DNA, 789 bp, Homo sapiens
atggcacatgcagcgcaagtaggtctacaagacgctacttcccctatcatagaagagcgttatcaccgtttcagtgaatcacgcccgtcataatcatttgccttatcgtggcgttccgtaggtccatggtatgcccgtttgtccgtaagcactcacaagcgaaaacgtaactaagtacgtaaacatcgtcagacgctcagggaaatagaaaccgtctgaactagtccgtgcccggccagtcatccatagatccgtcatcgacgccatcccaatcccctacggcagtccgtttagcataagcaggagcgaaggatccaacggaatcccgtccacgttacgcagtacaagaatcaagtagggacaaccaacatgggtcacatgaaaaccgtaacggagataccagccgcacctcacgcggcgggcacttaaatgccttcgaaacctccgtacgcatacgtgtccacgcccagttacttacctaggagaccccagggcggaaccctggcgaaacagacccatgtgcaacgattgaagcaaaactccgcacggaacagggctaccatcacccacggaaatatgggcaaagtcacccacgcaaatgtccccgcggagtctaaagtagaagtgtaaccagaatgccccacctaaacgcaaccgacgccactcgggcaaccgcccagactggcaagccctaggtgacaccgccaacgaacttgtagcagggccccatgacgacgccagacacaggggacggacgccacatgtacacccagcgaaccaagatccgca

SEQ ID NO: 634012 - DNA, 435 bp, Homo sapiens
taagtgatacttcaactccttactgatacttcacatcaacacgtgcttcaaacttaatctgcacaaagtaatcagctggcgttctatatttgactgcgggctctgatttggataggtcttgactgggacaagcctggtcgggatttctactaaactcttaggtgatgctcaagcacactgtccatgaatcatattttgagtagcaaagttatattttattttgttttatttatttattttttgagacagagtctcactctattgcccaggctgcagtgaagtggcctgatcttggctcactgcaactctgcctcctgggttcacgtgattctcctgcctcagcctcctgagtagctgggattacctgcatgtacaaccatgcctggctaattcttttgtctctctagtagcgatggggttttgccatttggccag

SEQ ID NO: 634013 - DNA, 1428 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaacgcaaacgccccacaacaccccggggcctttttttccgggggcgggacaaacggggttccaaggggcccatgtggccaggttcccggccccacttttttgttcccccgggggaaaccgcggggtcccc

SEQ ID NO: 634014 - DNA, 1622 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 634015 - DNA, 1944 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggattcggactttatgattaaactgctgctgccctggaggtagggctttgtccgcatcggaaaaaaccgtgtgctggtctacctgtcctcaccggcggacctgtgcggacgcttacctttgttgcggactgctcagtgatgccttcctggctgcctcggtgcgctacttttactaccccgatccatctactcctcaaattcccccgtttccctccctgtgcgccgtcttccatccgcccccccgactccctcgctttcgtttcccgcgcacgatgtgtttttcaccctctttcccccttccgcacccccgtgtcaatcgcatttcgcatgtttttgtagcccccgtaatcccattatccctccccctcccgtttcccccattctccccctcgtccctcattttttgtctgccttgattcgcccctcatacgccttccttccccatttgcccaacccaaaatccctttctccctccccattattcattggcgaccaccggcgcactattcatgcctcgtgcttcagcgctccccccttccaacaatatcatgtggtaaccgcttatcgaagtgggtaaatacgcatttcccctattcttcgtcgtccccccccccccgtcccaaatccccctccttcatatcttccaccgctcgtcataccccgcggtaagacatttttctaccaatactgtctttttactttcttacttt

SEQ ID NO: 634016 - DNA, 306 bp, Homo sapiens
taccccttgccccgatagtgagtgattttcttaagaatagctttactacaaataaacgctgtctaaatagaagtgcatttgtgaagcactatgggtggtatatgtttgccacagactcttgttaccttgcaggtaagataacacatgttaccaaattcggcattcattttcagttgctgctggtatcatgtgttttaagaaatgtgtactgtatgaaaaacttgaaaatactcatgaatgaaaaatgtcttaggaaaaaaatagctattttcatgcaattatgtacagtctcactgtggcggaggg

SEQ ID NO: 634017 - DNA, 294 bp, Homo sapiens
atgagccgcgtaccggcatgtgctgtaagcagcgaaatatagagatcagttgctaaggggccgaccatctatgagaacaaagaatgcaaaacctcgtgaaagagacatttccttttatccttcccttttcttccttactaaaattctgatgcagtgttcagagatacaacagccatcttctgaccatgaagacaaaaaccttaagctaggaagaaaggaggatactggttcctggatgaaatccttgagcagctgcatcagctttggattgtctccgctggcctacagcacatg

SEQ ID NO: 634018 - DNA, 1576 bp, Homo sapiens
  misc_feature (708)..(708): n is a, c, g, or t
  misc_feature (1276)..(1276): n is a, c, g, or t
  misc_feature (1311)..(1311): n is a, c, g, or t
  misc_feature (1313)..(1313): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatggtgggaatttgggcctttttcgattaaacttcccctgggctnccccccgtgcccaaaaacttacaaacgcccccttntntttaaacaacaagttaaaccacacaaaaacaaagaagacaacaaaacaacacagcacaagaacataacgaacagaacaacacaagccaccagtagtagtaagtcaggccggccgaccggcggccggcggcagaccgccgatcggccgagcggacagcaccgaccatccgatcggagacggacacaacggagcaagacaaggtcacatctcaccttgttcactcgtctcaaatgagggaaagtacaaggaccgcaccatcatac

SEQ ID NO: 634019 - DNA, 347 bp, Homo sapiens
  misc_feature (165)..(165): n is a, c, g, or t
ctggtgtgatgcgcgcttcgttcgtcaggtcacactgagtggtcctggggaaagaagccctggaccaggcaggcgatgaccatgtcccattggctgggtgtgcaaggtcagcggaaagaccttggggctggtcgggaataagctagactgggctgactaggctgngctgagctggacggagctgaccgtgggtgagcttacgtggcctgagctgagctggactgacctgggctaagctaagctgggctgacctgtgctgggctgggctggactaggctgggctgagctggactgagctgagctagactgagctgagctgggtaagcttaggtggcctgacctgtgca

SEQ ID NO: 634020 - DNA, 1309 bp, Homo sapiens
  misc_feature (529)..(529): n is a, c, g, or t
  misc_feature (532)..(532): n is a, c, g, or t
  misc_feature (537)..(537): n is a, c, g, or t
  misc_feature (539)..(539): n is a, c, g, or t
  misc_feature (565)..(565): n is a, c, g, or t
ctaggagactcacaagttcccaccccttttcctttgggccttcttccccccaggtattacacagccggatttcccataatccctccggggatttcttccagcgttctcgggccttaccttagcgggttttagcatttccatcgaagggtttttcgatggagagggattcttcttcatacatccaccgaccttccttcttctgttgtgttcctcggttttctttgtggggtcgttggtcatttccttcaaagggctcttcacttgcttctctttggtattccttcgtctctacttactctctcattttttgttatgctcatcctggggtaggtcctagtaactcgggcctgctagagcctgaagtgtggtgttggctcttagttcttctttaagattaggtatattggtctcgtttgcattcttttttgggtttagttgttctttttggttttttttttctgcttattgttttctttgttgtgctggttgttgtttgttttgtttttttgttgttttgttttttggttgnccnttggngntgggggaggagttgccccctaggcanccagcaggtaggaggcgacgtagcgcatcgcggcggcgtctgcggcggaggcggcggagaagtctcacgcgtgcgacctcggtggcgacagggaggaaaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 634021 - DNA, 710 bp, Homo sapiens
  misc_feature (710)..(710): n is a, c, g, or t
gggggggcccgggtccctggtggcccttggcattgggaaccgcggtggcttcctgcggaggtttcggcagtggcatccggggccgtggtcgcggccgtggacggggcctggggccgatggccgcggatgctcgctggaggcaaggccgaggataaggagtggattgccctgtcaccaagttgggcctgcttgtgtcaaggacatgaagatcaatgtccctggatggagatctatcgtcgttctccctgcccattaatggaatcaggagatcattgattctcttcctgtggggcctctctcaaggatgaggtttggaagattattgccatgtgcaggaatgcatacccgtgccggacagctgcagccaggttcaacggcattgtgttgctatcggggactacaatggccactgtcggtcgtgggtgtaacgtgctccaaggaggttggccaccgacatccgtggggccatcatcctggccaagctctccatcgtcccgtgcgcagaggctactgttgggaacaagatcggcaagccccacacttgtcccttgcaaggtgacaggccagtgggatctgtgctggtacgcctcatccctgcaccaggggcactgcatcgtctcagcacctgtgcctaagaagctgctcatgatgctgtatcgatgatgtacactcagccgggctgatatgcacctggcaattcgccaggcacn

SEQ ID NO: 634022 - DNA, 883 bp, Homo sapiens
ggccttttctgaaaggatatttaaaaatatatactatttaggctgggcccagtggctcatgcctgtaatcccagcactttggaggtgaaggtgggtggatcacctgaggtcaggagttcaagaccagcctgccaacatggtgaaaccccgtctctactaaaaatacagaaattagctgggccctgtggcaagagcctgttatcccagctactgggaggctgaggcaggaggatggtgtgaacctgggaggcagagttgtgcagtgagccgagatagcgccagtgactccagcctgggtgatagagcgagaatctgttcaaaaaaaaaaaccggaaaaaaaaattacaggcggcggggctttgggtgggttcaacacttggtattcccaggcatttggggaagggtcggacggggggggaccattttggagggccagaggatgtcgggaaacacagctgggcaaattttgtggaaccccccggtcttcttattaaaaattgggaaattaaggccggggcttcgtggcagggcttctggtgtgtccccaggcaaacttgggagaggctgagcggaagggaggattgggttcaaccccgtcgggagggccggagttttggagtagccgccgaattggtgcagttgcctcacaagccgtgggagacagatgggaacctccgtggttctccaaaaaaaaaaacacaacgaaaaaaaatttggcgcggggccggaccagagaaatgttaacactcttgtggggcggcgacccaaggaagagaaacgtggccaacggtgccagaggacccggcacgaccgtgtgggttcccaaaaagccggggcgcgggttgacaccggggtcggccacggtaagggcgcggaccccggt

SEQ ID NO: 634023 - DNA, 443 bp, Homo sapiens
ggcttcattactaacgttccagtgttctcatgggtacaaataccccagctgtcatgagaatatgcggtgtttggtttttttgtgtcttgcgatagtttactgagaaggatggtttccaatttcatccatgtccctacaaaggacatgaactcatcattttttatggctgcatagtattccatggtgtatatgtgccacattttcttaatccagtctatcattgttggacatttgggttggttccaagtcttggctattgtgaatagtgccgcaataaacataacgtgtgcatgtgtctttatagcagcatgatttatagtcctttgggtatatacccagtaatgggatagctgggtcaaatggtatttctagttctagatccctgaggaatcgccacactgacttccacaatggttgaactagtttacagtcccaccaacagt

SEQ ID NO: 634024 - DNA, 84 bp, Homo sapiens
ggagcaggtgaagggttccccctactttttcagctgacaccccgtgagccttgtcagggggtaaataaagctcttttgccccca

SEQ ID NO: 634025 - DNA, 1418 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaataagcagagaatacggttttggtgtcctgctacaaaaagacatcggtcagtaatgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttcatgcttctttcattttctgtttgttttatacaaatgtcttagttgtacaaataaagtcccaggttaaagataaaaaaaccggaattc

SEQ ID NO: 634026 - DNA, 200 bp, Homo sapiens
ggtttaaaaatttgccaatgccctgtcaaagtagggtgttttgaaaaacttcctgcatttgaagaacttgggtgagaatttccccagctgcttttgagaactcgagactagcagttcccctgctggccaagggcaaaaataatttaggggcttttcaaaacaactgctgaggtaataaatcctagcctttttcagggcca

SEQ ID NO: 634027 - DNA, 1442 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaataagcagagaatacggttttggtgtcctgctacaaaaagacatcggtcagtaatgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctccccatttctactcttaagtttctcagctcccatttctactctcccatggcttcatgcttctttcattttctgtttgttttatacaaatgtcttagttgtacaaataaagtcccaggttaaagataaaaaaaccggaattc

SEQ ID NO: 634028 - DNA, 130 bp, Homo sapiens
ggcccacttgcagttgtactccaccggcaggttgtactccaccggcagtgtactccaccggcaggttgtactccaccggcaggttgtactcaggctggtctcaaacttctgatctcaggtgatccacccg

SEQ ID NO: 634029 - DNA, 1110 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaactaagattacatccactggagaaatgttccagaatggactactgaatatacaggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggcaaaaac

SEQ ID NO: 634030 - DNA, 640 bp, Homo sapiens
ctctgcccggccgcccgtctgggatgtgaggagcgcctctgcccggcgccccgtctgggatgtgaggagcgcctctgcccagccgccaccccatctgggaagtggggagcgcctctgcccggccgccccatctgggatgtgaggagcgcctctgcctggcctccccgtctgggaggtggggagcgcctctgcccagccgccccgtctgggaggtgaggagcatctctacctggctgctcatcatctgggatgtgaggagcacctctgcccggccgcccatctgggaagtgaggagcgcctctgcccaggcacccttcgtctgggaggtgaggagcgtctctgcgctgggcgtccattgtctgggatgtgaggagcgcctctgtccggcgcgcccctctgggaagtgaggagtgcctctgtctggccgcccatctgggaggtgtacccaacagctccgaaggagacagcgaccattgagaacgggccatgattgacgatggtggtttcgttgaaccactccagggggcaatgtggggacaagaaagagaagatcacgattgttactgtgtctgtgtcgaaagaagtagacataggagactccattttgttcggtactaagaaaaattcttctgcttgggac

SEQ ID NO: 634031 - DNA, 475 bp, Homo sapiens
  misc_feature (29)..(29): n is a, c, g, or t
  misc_feature (56)..(56): n is a, c, g, or t
gcttggtctgcatatgtttcaaggctcanggaggctgtcatggatgttttcccccngagagctccagtggcggaggtctgcacattcaggcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggcaaaaac

SEQ ID NO: 634032 - DNA, 447 bp, Homo sapiens
ttgacacttgactcagtgtgactgcaggtcccacagctgtggctaggaaaatgtgtgatgtctctgttcttggcttttcctagttctccatggcaactcagtcctccagcagacccctgcatacataaaggtgcaaaccaacaagatggtgatgctgtcctgcgaggctaaaatctccctcagtaacatgcgcatctactggctgagacagcgccagttcccagaaggcatatcagtctctgagggcttcctttggggccgggaacttgcgggtttgaggataggagttcacttcatcttctcagctcccatttctactcttaagtttctcagctcccatttctactctcccatggcttcatgcttctttcattttctgtttgttttatacaaatgtcttagttgtacaaataaagtcccaggttaaagataaaaaaaccggaattc

SEQ ID NO: 634033 - DNA, 894 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaataagcagagaatacggttttggtgtcctgctacaaaaagacatcggtcagtaatgagcacgatgtggaaaaatgagagaagggacacattcaaccctggagagttcaatggctgctgaagctgcctgcttttcactgctgcaaggcctttctgtgtgtgatgtgcatgggagcaacttgtttgcagtccatcagacagggatactctagaacag

SEQ ID NO: 634034 - DNA, 249 bp, Homo sapiens
ggcataggggccaaaacttttgccttcaaaatttccttcctttatgggtccaaaatttgaagactgattgttggaattcccaaaatcattggaacttccaccaccttcaaaattgctttcattattaccaaatccattatagccatccccactggcaccatattcaccacccccccggctgcccccaaagccaccaccacccctgaagtttccttcacgaccgaagttggcattcccaccgaaaccacc

SEQ ID NO: 634035 - DNA, 329 bp, Homo sapiens
cccaccaagcaaccacactaacccattttaattagtgtaagagtatcgcccgggcccggtggctcacgccggtaatcccagcactttgggagcccaagccgggcggttcacgaggtcaggagttcgagaccatcgcggttaaaccggtgaaacccggtctctcctaaaaatccaaaaaattagctgggcgtagtgccgggcgcctgtagtcccagctacttggaagtctaagcgcaggagaatggcttgaacccggaaggcgaagcttgcagtgagccgagatcccgcctgtgcactccagtgtgggcgacagagcaagactgtgtctc

SEQ ID NO: 634036 - DNA, 488 bp, Homo sapiens
  misc_feature (25)..(25): n is a, c, g, or t
  misc_feature (69)..(69): n is a, c, g, or t
  misc_feature (97)..(97): n is a, c, g, or t
  misc_feature (413)..(413): n is a, c, g, or t
aaaatgctgggattaagggcttgancccatgtgcctgcaaaccccggcctaatttttgtaattttttantaaaagatggggttttcacccgtgttgncccaggctggtgtcgaaactcccgggccctcaggtggtcctgccccgcctcagccctccccaaagtgctgggattataggcgtgacaccacacctggcaaagaggaagtatttttaaatttagttttcacctcacacaattaagtactttggttttgggtgagtatgatttagctgaaaagagtagggtctctgcccactatatagttcttaattttccaaggctctgaaggtacctctggactactaatcaatccaacatatagagggagatatagtaacgtagagtactgcctcagcctctacaatgttgaagntttaactcatggcaatcaatggtaattgctacagacagcttaattgtatctaagctttttatattaaaaactgac

SEQ ID NO: 634037 - DNA, 655 bp, Homo sapiens
tggaggctgttctagaggatcccagctattcgaagctctagcaaccatcctctactctctatctccatgagttcaattgttttaatttttagctcccacaggtgagaacatgtgatgttgtctttctgtgacaggcttatttcatttaacataatggcctccagtttcatccgtgttgctgcaaatgacaggatcttgtcctttttatggctgaatactactctgtggtccatatgtacattttctttatcgattcatctgctgatggacacttcagttgtttccaaatcttggctattgtgaacagtgctgcaataagcacaggagttcctattcttttctttttggtatgtacctagcagtgggattactggatcatgtggtagctcaatgtttagtttttagagaaacctccaaactgttctccacactggttgtaccaattacattcccaccaacagtgtacaaggattccctttctccacatcctcgttagcattggttattacctgtttagaaaaaagccgttttacaataatatgttatggtaggtctaatttgtatttctccaatgatcagtgatattgagcatctttgcatatacctatttgctatctgtatgtattcttttgagaaatatctattcagatctttt

SEQ ID NO: 634038 - DNA, 270 bp, Homo sapiens
gctgttgcggtcgcactcacggctccccggcatcaggtcacagtttttcgcagcccccgtcggtcatctcagtttgatgcgcgtgcacggtacctcgtcggatgttctgggcgctaccgcccgaaaggtcggctggcatcagattcataaaaggccttcagcacaagcatcgagcgtctgagcatggcgtgaaccccggggggcagagcctgcagtaagccgagatcgcgccactgcactccagcctgggcgacagccagcctccgtctc

SEQ ID NO: 634039 - DNA, 1057 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggcaaaaac

SEQ ID NO: 634040 - DNA, 967 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacaagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaatttgcccaaaatcctaaagaccgggaaaagggaaccattgagcttggcaaaaac

SEQ ID NO: 634041 - DNA, 967 bp, Homo sapiens
gcgactgtctccgccgagcccccggggccaggtgtcccgggcgcgccacgatgcggccgcggctgtggctcctcctggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacaagcctcaaggggaaggtatatcaggaacctttgtcccccaatgcctgcatggatactacagcaatactacaacctcacagaagctgcttaacccatggatcctgaaaacataggcaagaagcacaggtcctgatgagtggatctttactacttttaccagattcctccctcgctcagagggatcctcccacacacccagcagagacttctctgccaccatcaaccccccaagtcatagggggctcaagttctgccctggtgagctgtggcccccatccttgtgaaccccaaagtgtcccccttgtggaaccaaatgtatccatcttgaataaaacccgattcggccgaagcatacgaatattcgacaatggcgcgacaaaaaaaaga

SEQ ID NO: 634042 - DNA, 1336 bp, Homo sapiens
tgtcttttttaaatggtaactcaggccttcaggacaccggtgcatgcgtagacgtgcttagccctcaagatggttgagtggctgcccatgcgaggcaggggtctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacaattttacaaataagcagagaatacggttttggtgtcctgctacaaaaagacatcggtcagtaatgagcacgatgtggaaaaatgagagaagggacacattcaaccctggagagttcaatggctgctgaagctgcctgcttttcactgctgcaaggcctttctgtgtgtgatgtgcatgggagcaacttgttcgtgggtcatcgggaatactagggagaaggtttcattgcccccagggcacttcacagagtgtgctggaggactgagtaagaaatgctgcccatgccaccgcttccggctcctgtgctttccctgaactgggacctttagtggtggccatttagccaccatctttgcaggttgctttgccctggtagggcagtaacattgggtcctgggtctttcatggggtgatgctgggctggctccctcttggtcttcccaggctggggctgaccttcctcgcagagaggccaggtgcaggttgggaatgaggcttgctgagaggggctgtccagttcccagaaggcatatcagtctctgagggcttcctttggggccgggaacttgcgggtttgaggataggagttcacttcatcttctcagctcccatttctactcttaagtttctcagctcccatttctactctcccatggcttcatgcttctttcattttctgtttgttttatacaaatgtcttagttgtacaaataaagtcccaggttaaagataaaaaaaccggaattc

SEQ ID NO: 634043 - DNA, 660 bp, Homo sapiens
ggcggggcgcgatgagcacgctacgggcctttacctgcgattgatctgtgccgctgtcaataactattaacttggatccacgttacatgaaacttatgggattcctttctaactacaagttacctcgcccactggtgcagagtatttcattgtggcagaggcacctggtggagaattaatgggttatattatgggtaaagcagaaggctcagtagctagggaagaatggcacgggcacgtcacagctctgtctgttgccccagaattatcgacgcctatggttaggtctgctaaacttatggacgttactagaggagattatcagaaagaaagggtggagtttgttcgtggatctctatgtaagagtatctaaccaagtggcagttaacatgtacaagcagttgggctacagctgtatataggacggtgcatacgagtactattcggtccagtcagacggggatgcctgactgcaggagcgctgtactgatatgaggacaagcatctttccagggagtacgtgacgaagagaatccactcatagccagttagcctcatcctgtgaggcctgtaagactcttgaataaccctgggcagtggttcttaggcatgatactctagatgctttatggacgatattagttcattggatgatggctg

SEQ ID NO: 634044 - DNA, 255 bp, Homo sapiens
tgacttggtacactgccatgacaaagtgtgactgtgtattcggtccggggcacccctgtcatcaatcccctgcatacacacttcccaggtgacacagctgtgcctgggttttctcactgaccctcagctggacaccgaccaactgacctcaggcatctttaacgtcggcagcaccttacctggggactggttcttggctgcccaccttccccagtgccacggccaaatctctgtcaagggtctccaggatgagtg

SEQ ID NO: 634045 - DNA, 214 bp, Homo sapiens
cagatgaaggggtcagtcagaaaataagcatacctcatacaagataggatcagctccttgagcctcgaggggcaggagtgcttcctggtgtgtgtaatagaatcccttcctgccgtgtttcatggcagtcgaaatgcctcttggtcctgtccaagtgtatctttcactgtatttctgcaatcatgttcatagttgcttgacccatgccacatgg

SEQ ID NO: 634046 - DNA, 189 bp, Homo sapiens
  misc_feature (43)..(43): n is a, c, g, or t
atgagctggtccggtaaagcactatcatctctcacttaacttnggcagtagcttcctaacggaagtatagacgcccccgcagtcgtactccacataacagaagttctaaaaaaaaaatgacattcttggtcaatacttctcagtggtttccggtctggtctcattcttataacacatttctacatggag

SEQ ID NO: 634047 - DNA, 986 bp, Homo sapiens
actctcttttggtaggtgggcggaatggatggcagcgagagtagagcagcaggagtggagcatttcatgttggctagtagtttagttagttgtttcgtggatgcttgcaccatgtcgcggtggttatgagttgtgttccctcactagtgtctctgtggtcgccatccttagagtgggtgcagagtgtcaagatgtgtgtccacaccaagggcaaccccttttcgccgttgtgggactcgcgtcccctccctccgtgggagcaaaactgtgtgtaccccgttgccttgcccccctgtggtgtgtccgcgcggcacttttttgggggacatatattcgcacctctttctattttgctcgaaacatctgggccggtggtgcccacgctgccatggggcccttcctctgtgtgattttcagggaacaacccggtggttaacccaattacgcagcacccgcgtgtttgttgacccccccctcttagacgcctctttgcggcaaatacattcttccaagctttcccctccctctccttctgcgaagatagaataattcatttccccttcctcacgagatgaacaagaccatcccgcgattccttttctccccttttgccatattcccgttgcggccccccatccacatcgttgcaccagtggtcattaaatcgagcccccctctagtttcacgtgtgagatcatatcttcggttcttcaaaatagataaagccgccatcttcaccactttctttccataagatctatcgtcgtctttctcagtgccgattgtccaacattgagtctttgcgcacaatgttgccattgtttcaacaaccaccgtgtaaacaattttagtccccaatgactccccgtctcttaattcccactgtgggtcccaccccaatccctttcttggtcgccggtggaatatgagacaacaacttgttaggaagggttatttgggaaaaaaataaaacaccccacaaaaca

SEQ ID NO: 634048 - DNA, 576 bp, Homo sapiens
gttcattggcacctgatctctaatggcccatggtgccatgggatgctccatgtggtgatgcttgcctgactttgtgcatgtgccatgctgatgtgctccccattgggatgtggacctgcctgaagatgatggcatgcagacgtgtggtgcctgggacatgtgaccgtcttcctcacaaccttggacgccattgtgtccatgtggttatgcattgcactcccccatcacacatgacaaactatccattggcccatatgctttgaacataccatgatacttgatactacacatgcaggcacaaaaaactgcaacatcgctaccatatcaacagacacaacatggagacatcctgggccagcatcacattgaacacatcggggcacccgccaccaggaaaaaccacaaagacacagcgagaacgaacgcgacccaatagcaacgagagaccacaccccagaaacacagacccacacacgcaccgacacagacacacgcacacgaacacccaccacgcacacaaccgcggatgaccaccggcagcacacacagacgagcgagcgacgcaacccaacacaa

SEQ ID NO: 634049 - DNA, 498 bp, Homo sapiens
cgctcactctgctgggattagaaggctttgagccctgaggtcacctggttcctggccaagtcactccttttatttgagcttcaagtctccatgtgtataatgtggggttgatgctgtggtgctccaaggtgttggggggttttaggcagagttcttatgcttaatataggatggaaaagtgttcgagcttcttcccttttctctttcttctcttcatctgacatgagcctggggttctacctcttccagataattcatcctggagctactaattctatctccccattgattttagtgtcctgtctgtttctaaatctactgggcagttggagacattgtcttttgttccctcatctatcttctgtatccacagttgataattgtctatgtttttagtgtgttttaaggaaaaaagtctcatggcagcaaatttttttgagatggagtttcactctcattgtccagcctgggcgacagagcaagactctgtctcaattt

SEQ ID NO: 634050 - DNA, 1400 bp, Homo sapiens
catcggagcgacagagcgagcgtgccctacggtccgtcggcggcccggcggtccgagatgttatctggtgaagaaggcggcagtcgacggcggtcggctggctgcagacggcagctaaccgggacggcgagcgctgtgcccctggcgtacaccatggcggctccgtagaacggagtcatgaggtggccgcagcagcccgctaggcctgtccggcgcccagccgagggctcggcgccggtggagccggctggcgggagctgcacaccccgcaaggacagagcctccgtcgggcacttcgcctcctcctggggcgcccttgtgcggacacccgcccgcgggtccgccatgggcccctcaccgccggccccttacgtgctcagtgcccttgcggcttctgccgcaccccgtcattggacaaccttgcgcaactacgccaggacgatccttcccgcgcacgcggagcccgctccgcggaacccaatggcccgcgcctgtcaaagtccgcggccgaccgggcttaagaaggataccacggacgccagactgcgattgaaacacgccttggtgtccagaccgttctccacgaaagcacgtggacgctaactgcgactctccaggcacacggcaacacggacggcagggacaaacttggcccaaagtagggccaatgaaggacaaggaggtaacacacaggaaaacgggctatttaccacacgacacaatgcgaaacgcgccccacttatccgtaaaggcctcaccgcataccccatttcacgggccaccacgcctaccgacccgtgtcgtcaaccatgattggcacagccccgccttggcacacagtcgaataccgctatctccgagcgctctggatttggcacacgtcgcggctcgcagccacaagcggacttttatatgccccatcagacaggtgcccgctgggatcccttactcccactctgtcccgtttgtgtcaaccccggggtggcatttagcaccctttattgcgttccacacaagtgcataaaaccgtgcacaagtcgcacgtcctttggacttgtactatgcccgctcgacgaagcactctttaagcctttcgtcaacttacaaacgctattggggaccaccgcctcaagccgtcaaatcgatatcgcaaacccccccatcaccagataaccgcgcattatcactcaccacatttctcttgagaagctttctacagcaaacgtaacccgccggtgcactcccacactcttctgcgaagaccgacatctgggtttcgcgatatcgtggcggcattcatccacttttcgcccatcgaacgtagactcttcccgacgactctgacagccaactttgctggacagaggcttataacgtcgagtatcccaagcctacagtag

SEQ ID NO: 634051 - DNA, 900 bp, Homo sapiens
gatgtgtaaaaaggctttatttgcaggggagcaggaatttaatcaaaaaggccaaatcccatgtcatcatcttactctctcagactccttcctcaatatgatctatcttcctccttctgctgcaacaaggtgcagaaccagcgagcatggcatgaagatgtgggcacgcatgagacggctacagccccaccagcaggtacactggcaagcttgccaataccctgggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 634052 - DNA, 642 bp, Homo sapiens
actagcggagcttcttcgacggtgtctggctgaaacccagtattcctttgaaaagcatattagaagcatcttgaacgtagtgttgcaatccagcatttttgaaagcttctgagaaggacatatgccctcctcctggagaatggcttcagcttcctcagcatgagcagccaggtgttcagagagcagtacattctcaaacaggacttggacaaggaggagatcagcggagggtcaaattattatgtgagccaaaaaagaaacaagtagaagatctcagttattgtcgagaagagaggacaagtctgcgggacatggctgagcgtatagcttgacacatatgaggaagctacagaaaaacaagaggatatcatgaacaggatgataaaactacttcacagttttcactctagagctcccagtactctctgatagtgagcgagaccatgaagaaagaattacagctgatacctgatcaacttcgaccatttggggccatgccatcaaacaggttactatgaacaaggattatcaacagcaaaagatggcgaaggtgtcgagtcttccaaaaaccaccattattctcagtgcctacagcgaaagtgaatcagccatctgaaaaaggggggacctataaggacaggg

SEQ ID NO: 634053 - DNA, 1208 bp, Homo sapiens
  misc_feature (18)..(18): n is a, c, g, or t
  misc_feature (24)..(25): n is a, c, g, or t
  misc_feature (33)..(33): n is a, c, g, or t
taagcttacggctaggtncgggcnnggtgttantcgccacgcgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaataaataacaacaaaaaaaaacaaagagagggcgcgcgccgcgcctctctaaaagatattatcctccgcgaggaggcgcccccactatcatttagacgcgcaatcaccgcgccgatttttctgttggactcacaaggaggtggcgccccctattatatgggaggaaggctcttattatataacagcgcagagaccgaccgcggggacgcgctcgttttttataacaccaagctcgctctgagagactgtgcggacacaaacagacttctcgacaaacggctggagcgaacactactttgcggagaaagaagacacaccacttctcgctctctgggggggggagggagcagagacaccaatatgtgtgcgtgagagaaacgcacctcccaaagagacagagagatttatatagcaggcggcctctacgggcgggagagacatctttctacaaacacgttctgatacaagctgcgtgtgtatatagacgggtgtgtgtgtacacacacaatcacgcgggggcgagaatctatgatcggcctggttggcgggctgttgatgacaagaaaccacctctgctcgtactcaacccgcgcgcgggtctaacctgagtgatgtctggccgggagacaacagttatggttatcacacacgccggaggtggcgaccgtccccattgtgcaatcgagacaagatggatggataat

SEQ ID NO: 634054 - DNA, 406 bp, Homo sapiens
ccccgtatatacagctctcattggcaggaccatttcgattcatgtgtgatttattgcattaagctatcatttcttaacctggggcaattatacatgtatcttaagcaactcctctcctatcctaattccatgcacaccaaacaaccaataggcttccaacagcgaggtctgtccacagactctatattatactagtctatgcgtaatggcttgtatgtgttctagcctatcacttcaatagttatttctcatgggtatagtaacatatcaataagttggtatcagtaacatcagtcaaatatgcttttctcatgtcttcacttgtaaggatagtccttttcttgattaatctacataatcagacttctaagccaacaaggctctgaatctacggtatattccgggt

SEQ ID NO: 634055 - DNA, 1291 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 634056 - DNA, 400 bp, Homo sapiens
tgggcggatcatgaggtcaggagatcgagaccatcctggccaacatgggaaaaccccgtctctactaaaaatacaaaaaattagctgggcatggtggtgcacacctgtaatccgagcgactcaggaggctgaggcaggaaaatcacttgaacccgggaggtggagcttaaagtgagccgagatcgcgccattgcactccagcctgggtgacacagcgagactccaaaaaaaaaaggaaaaaagaaaagaaagagggagaagggggtgaaagtggagggagggagagagagagaaagaaaagaaagaagggagggaggcacgcaggcaaggaaggaaggaaggaaggaaggaaggacggcaggccaagagaccagtgggcacggaacgagggtaccgagca

SEQ ID NO: 634057 - DNA, 823 bp, Homo sapiens
gtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctaaaaaaaaaaaaaaaaaaaaaaaaaaaaaaaaaaaaaaaaaaaaaaaaaaaaaagagaggggggggcgcgcgcccaagagagagttctccccgcggggggcgccccggatttagcagcggcatcaccccagatttggtgggaacacaaggaggcccccaaaaggggaggacagccctatatataaagaccagaggagaggggcgcgcagagtaaacacacagctcggagacggggaaacacacggggcacacgcaggaccaccctggggagagaagcgccccttcagcccgcgggggggcggccacatcaggggacaacatacccaga

SEQ ID NO: 634058 - DNA, 141 bp, Homo sapiens
  misc_feature (5)..(5): n is a, c, g, or t
atagngggagtggagtgcgtgtgtctggctgtgagccctcccggctcgatgcaccctggacagatgactgaacggggatgccgctcgcatggtgccggggctccagtcatccccctggatcttgttggtacacagtgctgg

SEQ ID NO: 634059 - DNA, 1255 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacaca

SEQ ID NO: 634060 - DNA, 423 bp, Homo sapiens
gggtggtcaggtcaggctgtagatgtatcctgtagactcaaggccgcttctcaggagtccagagacaatctcagtggcccctccagctgcatggctttaaatgccactgacatgctgatggttcagtagggggcgctgtggtgccctgccaagatcccttcacacagccagtgcccaggacccccacccccaacacactaccatgcatggtagctgccagatgcctacagcctcttttccagagacttgccctcaactgaagtcacttgccttcaaatgtacccacactcccagagaacttctcacagccaataaatgactgataaaggctttcacaggtaccttctgagagcctttatcagtcatttattggctgtaaaagttccctctgggcatttttcgggtttaaaacccagaggttct

SEQ ID NO: 634061 - DNA, 1885 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaataaataacaacaaaaaaaaacaaagagagggcgcgcgccgcgcctctctaaaagatattatcctccgcgaggaggcgcccccactatcatttagacgcgcaatcaccgcgccgatttttctgttggactcacaaggaggtggcgccccctattatatgggaggaaggctcttattatataacagcgcagagaccgaccgcggggacgcgctcgttttttataacaccaagctcgctctgagagactgtgcggacacaaacagacttctcgacaaacggctggagcgaacactactttgcggagaaagaagacacaccacttctcgctctctgggggggggagggagcagagacaccaatatgtgtgcgtgagagaaacgcacctcccaaagagacagagagatttatatagcaggcggcctctacgggcgggagagacatctttctacaaacacgttctgatacaagctgcgtgtgtatatagacgggtgtgtgtgtacacacacaatcacgcgggggcgagaatctatgatcggcctggttggcgggctgttgatgacaagaaaccacctctgctcgtactcaacccgcgcgcgggtctaacctgagtgatgtctggccgggagacaacagttatggttatcacacacgccggaggtggcgaccgtccccattgtgcaatcgagacaagatggatggataat

SEQ ID NO: 634062 - DNA, 1681 bp, Homo sapiens
  misc_feature (529)..(529): n is a, c, g, or t
  misc_feature (532)..(532): n is a, c, g, or t
  misc_feature (537)..(537): n is a, c, g, or t
  misc_feature (539)..(539): n is a, c, g, or t
  misc_feature (565)..(565): n is a, c, g, or t
ctaggagactcacaagttcccaccccttttcctttgggccttcttccccccaggtattacacagccggatttcccataatccctccggggatttcttccagcgttctcgggccttaccttagcgggttttagcatttccatcgaagggtttttcgatggagagggattcttcttcatacatccaccgaccttccttcttctgttgtgttcctcggttttctttgtggggtcgttggtcatttccttcaaagggctcttcacttgcttctctttggtattccttcgtctctacttactctctcattttttgttatgctcatcctggggtaggtcctagtaactcgggcctgctagagcctgaagtgtggtgttggctcttagttcttctttaagattaggtatattggtctcgtttgcattcttttttgggtttagttgttctttttggttttttttttctgcttattgttttctttgttgtgctggttgttgtttgttttgtttttttgttgttttgttttttggttgnccnttggngntgggggaggagttgccccctaggcanccagcaggtaggaggcgacgtagcgcatcgcggcggcgtctgcggcggaggcggcggagaagtctcacgcgtgcgacctcggtggcgacagggaggaaaagaagatcttggacagcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatcaaaaaaaaaaaaaaaaaaaaaaaaaaaaaaaaaataaataacaacaaaaaaaaacaaagagagggcgcgcgccgcgcctctctaaaagatattatcctccgcgaggaggcgcccccactatcatttagacgcgcaatcaccgcgccgatttttctgttggactcacaaggaggtggcgccccctattatatgggaggaaggctcttattatataacagcgcagagaccgaccgcggggacgcgctcgttttttataacaccaagctcgctctgagagactgtgcggacacaaacagacttctcgacaaacggctggagcgaacactactttgcggagaaagaagacacaccacttctcgctctctgggggggggagggagcagagacaccaatatgtgtgcgtgagagaaacgcacctcccaaagagacagagagatttatatagcaggcggcctctacgggcgggagagacatctttctacaaacacgttctgatacaagctgcgtgtgtatatagacgggtgtgtgtgtacacacacaatcacgcgggggcgagaatctatgatcggcctggttggcgggctgttgatgacaagaaaccacctctgctcgtactcaacccgcgcgcgggtctaacctgagtgatgtctggccgggagacaacagttatggttatcacacacgccggaggtggcgaccgtccccattgtgcaatcgagacaagatggatggataat

SEQ ID NO: 634063 - DNA, 502 bp, Homo sapiens
ctcaaaaggcgagtcgggtatcttcataatttcatgaagacatggcacagagggtccggctaccttctactttccgtgtttataaaagactgtggattcccttgcagttcttcctgtaagaggtgtatgacgctgacatcatcactctcctccacccgcctcctgcccttttctgaatcagtgaattataggaatctgagaatgagctcctgtttcctgcacatggttggggaacattaaaaaaaagaagacagatgagggatttataagcaagaggacagaagaataatagccaacacaatgaagtctagttcaaggcctgcgattcccaatggctgggctacacggcattaatagcagtgtctctcaccctttcagacccttctctcttatttcagacccttctgccttattcttgtggggatgggctgggactgagaaacagctagtataatcatggccaaaatgaaactcacatgtacatgggggcttccaggtctgg

SEQ ID NO: 634064 - DNA, 1815 bp, Homo sapiens
  misc_feature (708)..(708): n is a, c, g, or t
ccaacctgttccctcccaggacccgagaatgtagcggggtccctgaggtgctgatgtccacatggacaccgaggtcagttccgggccaaagcggccagcgcaggggctgaccactcagacctcactcctcgcaggggtgagcgggcgacgctgcctcacgtcattgtcctgccctccaaggcccgcgctcgtcctctgacaggatgccctgacaccgcagtgcgggggcggcctcccagatagggccgcagtcgctaagtccgaggcggctggctcacctcactgagcccggctggacgtgggaccaccggtcgccgcggccagggaaccaccaaggagtcaaggcgagcctaccgccagcagcttctgcccgggcccacgcgccgttccgggtaggcccgcggcgcaggccacttccggcagcggtgcaccatgggacttgcagttcgctggcaaaggttgagtcccgggcgtggcggccgcgctccatgttgggagctgtaggcgccgcgtggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgantccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatggacggagatcctcccccagcggcaaggacgtcaagaagatcttggacagggtgggatatcgagagcaggagacgacgaccggactcaacagaggtcatcagacgagctgagtggaaaaaacattgaaagacgtcattgaccaggggtattggcaagcttgcgcaggtgtacctgctggtggggctgtagccgtgctctgctgaccccaggatctggaagcccctgactgctggttctagcccctgattgcaagcagaggcaaacacagatgacacagacggacgagcctgaagaggtcagaggatgacaggggagaaggggccacactgaatacaattcctgcttcacgtgagatattaggcagattgaaaaatcaacaatcgatatacaacagcaaaagactatagataataagataaaaaaaaataggacaaaaaaattatataaaaaggaagccaagcatcacggatcaaatagaaaaggcaaaaaaaagaaaataaaaggggagacagcagaagcagtaaagcaataagagtagaaacatatggtagaaacggaacaggaaaccagagtaaaagtaa

SEQ ID NO: 634065 - DNA, 107 bp, Homo sapiens
tgctggtgcagtacaacctggaattcgaggctcgaattcgagctcgaattcaagcttctaacgttagaagcttgaattcgactcgaattcgagaaatattgagattt

SEQ ID NO: 634066 - DNA, 842 bp, Homo sapiens
caaaaacaataagaactgacagacgaagcaaaaacaaagaccataactgagtagaactgaatctgtcacttgtataatctgaattaaatttaaatgaagcagccatcactattttcacgatgtctcgtagttatgctcatctgatcattacatgttcattttcttttgccactcttcctccaaaatgactcaaaggtccctaaggaagctgtacatgccttatacattcctttggacgtagaatagattatctttcttcctctctttcctctctctctctctctctgttactttctctctatatattctgaatgtttataagcatttactgacagtctactcatttctttcttcttttctttagatgcaattaactgaatacttagaaaatacaaattactataataagttcttgtgaggaatttatgacaacgtttcatgatgggagtttaaggttgagtgttctgctactggcatgtaccaggttgagaggcacagagtttccatacttgagtactgcttatgtgaagtcacagcttgtatcaataacttaaaacttgatcattagagaaattcaacatcaaaaccacaatggagattatcatctcacaccagtcagaatgggcattattaatcgtgtcaacaaatgacatgcctgggaaggtgtggacgcaagaaagttttgctttatacactgttgataggagtgtgaattagtccaaccattggcgaaagcagtatgggactccccaaaaggggtaaaaggcggaggtatattcccccggagccctatttggcatttcccccggccagaagttttacacaaggcgggggggtccccg

SEQ ID NO: 634067 - DNA, 1076 bp, Homo sapiens
gtcctttccttttcctccctgtcgccaccgaggtcgcacgcgtgagacttctccgccgcctccgccgcagacgccgccgcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacaaaaaaaaaaaaaaaaaaaaaaaaaaaaaaaaaaaaaaaaaaaaaaaaaaaagagaggggcggcgggcgcgcgcgtcccacaaaatattcttctcccctcgggggggcgccccagtttttcgcgcgcgcgtcccccacggtttttttgtgtgtgacaaagagggggggcgctccccatatatgggagaggagccgcattatattatatacgggcacagaggcaggcgcgggccgcgcgctgcatttatacaacaaccgccgctctgcaggaagtccgggaacaacagggcgcgcccacacgcttggggagcaaactctcttgctggaagcgaagaggggcaccctccctacttactctgtgcggggggggcggcgggcgaacactatatgtggcggacacacaacacactcactcccctatacgcgagaaagtatatttttataaagcgcgccatcctactggaggaggggggacatcatctatataataacacattcttgtacagagcggcgcgtgcttagactggcgggggcgtgtcctatccaacccaagcagcgcgcgccgcatatatatgtgccgtgcgggccgcgctgctgtgatgaagaacaaatgtttgtgtgccgcctacctaacgcggcgagcgaactgtatgttgatctcttctgtggcgtacaacgaccactttttttttttatatcactcgcgcggaggcgcccgggtgtgcaaatcagcacc

SEQ ID NO: 634068 - DNA, 228 bp, Homo sapiens
  misc_feature (97)..(97): n is a, c, g, or t
ttccgcgcgcattctgattttattagagaacattttgcaaattaaattttacaatttaacattttacaattaaaaattttagctgcgattacataanctacaaacttttcaaaaacactacaaaaaatcttttatttctttaaatttttctgttccatgttaagctcctaagatatattttttctttcagcttcattttcatcttccttgaaaaatgaaaaatcacat

SEQ ID NO: 634069 - DNA, 407 bp, Homo sapiens
ttgaaattttaaccccaaggtgatggtattaggaggggagactttgggaggtaattaggtcatgaaggtggaacccaagggaatggaattagtacccttataaaaaatgagaccccagattgggcacggtggctcacacctgtaatcccagcactttgggaagctaaggcgggcggatcacctgaggtcaggagttcaagaccagcctaggaccaacatggagaaagcccatctctactaaaaatacaaaattagctgggcgtggtggtgcacacctgtaatcccagccagatactcgggaggctgaagcaggagaatcgcttgaacccgggaggcggaggttgcggtaagccaagatctcgccattgcactccagcctgggcaacaagagcgaaactctgtctcaa

SEQ ID NO: 634070 - DNA, 96 bp, Homo sapiens
ttttttctttaatctgcgtgattgctttattggtacaaaaagtttccagtaacagaaattggttttaaaaaaggacaaaaaagtcattttggaaga

SEQ ID NO: 634071 - DNA, 183 bp, Homo sapiens
aaaaaaaaaaaaaaaaaaaaaaatagcctggcagggtggggcatgcctgtagtcccaggggcatgcttggggggttgggttgaggcaggaggagccctggagtttggggggtcaaggctccagtgagttgtggtcccgctactgccctccagcccagggggccaaagtgagcccttgtcccca

SEQ ID NO: 634072 - DNA, 84 bp, Homo sapiens
gcaaggaacccttttcctccctcccccctcccccctcctcaatgtaggggccttggatatcctgtttgttaataaaggcaattc

SEQ ID NO: 634073 - DNA, 483 bp, Homo sapiens
ctaagacatctgttatagcatgccatgttgacttctgattagcctcctttgagacctttgaatggctcctgattactactttacttactgtccctagtggaagaacatgtcaacctggatgttgtcacacagactccaggctgtgatgcgtacggcatccatgttctggagggttgtctgcacacgtgccctttcttcatggtctgtaagccctgggtctgggaacagtggtgcagagatctgcttgttttgtggctgaccaagaccacacttctgtctgtaagttccctcagtaaatcacccaataccaacaaaatagatttgtctttctccttctttagtttctcagctccttcacatttggaaccgctttgcatatatgcctccttcacagaataggtactttcgtgtttgtttgtttgttgagattgcaccatcacactccagcctggggggaaagagcaagacttcatctctaaaaaa

SEQ ID NO: 634074 - DNA, 674 bp, Homo sapiens
ctcttattctgttactcacgctgcactgtgcagtgacgaaagtggctcactgcaatgtgcttctacggtggttaagctttaatgctgcctccgacgtgagagtatgatgtgtgacctgcaggcattagaacagccggatagttcactagtccgatagctataagtagtttgagctgagacggatttggctctgatgaacactctggcgtcagacatatgacatgaggagagcctcctttcagcctctgaaagcgctgtgatgacaggtatgagacgatggaacatgggttcatgtgagagatgagagagtaatcgtatacaggtgttatgaacgacatgtttacaggccatattgtattgagccttatctagttcactgatcatgttgccttgagagaaacatcattctggcttacatgcacgttcagtcatagaaccttacgttggactccattacgacatagaatctattgctcacatgttagcagtgacgtccgatgttcacactggccacccatgacctttgcgtagacctaatagatacagtagtcaattaatacccctttagctaagattttagatagcgatcagtccccaattggctctattgtcaaacctattaccatcaaacttgggtgaactttacaaatgtagtgactgtaatccctttcccc

SEQ ID NO: 634075 - DNA, 418 bp, Homo sapiens
ctctcttatttaggaacacgcttcatgaacggctgacgatctatggcccgcacgctcctgctcctgactaaccgatagacgctctcgccgaggaacaagtcggccaggacgcccgcgcgcaacagccatgggtgttaaggataccgcaaaaacacccgtggagccgcaggaggcaatgtaccgaattggaattaccctaacaagccgaaacgtgaaatccttgaaaaaggtgtgtgctgacttgataagaggcgcaatagagaagagtctcaaatggggaccagttacgaatgcgtaccaggactttgagaatcactacatgactcctagtggtgaaggttctaagacttgggatcgtttccagatgagaattcacatgcgactcattgacttgcacaggccttatgagattgttccc

SEQ ID NO: 634076 - DNA, 1146 bp, Homo sapiens
gccctactctttctggtgttagatcgagctaccctctaaaagcagtttagagtggtaaaaaatagaaaaaaacaaaccaaacgctcgcagccacaaaagggatgaaatttcttcgtggacatcctccgtggttctcccggttacgtgatcgtcgtgctccctagaagtccttcggtgaaagcttttaattcctaagaaggagaaaatcagtcaccggggaaaatcgggcgtgattacagggagcgtgggcagtggcaattggggagcacgtgcctgccatagtgaattggcgtaaacttctaaaacgcaagcggggactcctcggggactactaacttaagcatgtggcacgggaggaaaacagaatgccaaaaatgcacgagggcacggggcgtgcccaagggggtctcataccctatgggcggaagacacgtgccagcaaaccgagaaagaaatattacaagcctccgtgccacaacacaaggggggaagcgcaagcaacactggggcacactgctccagcgcacttccgcgacgcacattaacgcgggcggggtgactaagctcctagtacacactccaggcactcgggctcgggcctaaccaccaagaatcccctcgccaccttgccaacagacctcttcgggacacggctcacacgtcgttctgtgcaacacatcatcatgggggaccaaccaacaaacgggcccatcacacgccataggcaaacggacgcaaggcaaactcaccccatggccaatactgcgccacctggcgcacacacgcaacccggaaaccatcgtctacggcaccctaactaaaacgcgcaaacacgaggaccaagccaaacaaagcagacagcgggcgcccccacaaacctgtgcgcacggacccgggccgcccgacacacaaccggggacccaaccacagcccaccgccccaactagggccaacccgccatacaacacaccagccaccgtggggacccctgggaacccgacagcggtacaacgggaacacgcacccagacacaaacagacacacaaaagcaaaaacagacagacagagcgccggacagcaaaaggaacaacgggagaaacgccagctaaacacccacgccaccaccatgaacccacacgcacaaga

SEQ ID NO: 634077 - DNA, 679 bp, Homo sapiens
  misc_feature (1)..(1): n is a, c, g, or t
  misc_feature (82)..(82): n is a, c, g, or t
  misc_feature (92)..(93): n is a, c, g, or t
  misc_feature (105)..(105): n is a, c, g, or t
  misc_feature (109)..(109): n is a, c, g, or t
  misc_feature (119)..(119): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (140)..(140): n is a, c, g, or t
  misc_feature (147)..(148): n is a, c, g, or t
  misc_feature (163)..(163): n is a, c, g, or t
  misc_feature (166)..(166): n is a, c, g, or t
  misc_feature (171)..(171): n is a, c, g, or t
  misc_feature (181)..(181): n is a, c, g, or t
  misc_feature (192)..(192): n is a, c, g, or t
  misc_feature (209)..(209): n is a, c, g, or t
  misc_feature (245)..(245): n is a, c, g, or t
  misc_feature (281)..(281): n is a, c, g, or t
  misc_feature (291)..(291): n is a, c, g, or t
  misc_feature (306)..(306): n is a, c, g, or t
  misc_feature (322)..(322): n is a, c, g, or t
  misc_feature (335)..(335): n is a, c, g, or t
  misc_feature (348)..(348): n is a, c, g, or t
  misc_feature (361)..(361): n is a, c, g, or t
  misc_feature (386)..(387): n is a, c, g, or t
  misc_feature (410)..(410): n is a, c, g, or t
  misc_feature (412)..(412): n is a, c, g, or t
  misc_feature (442)..(442): n is a, c, g, or t
  misc_feature (444)..(445): n is a, c, g, or t
  misc_feature (456)..(456): n is a, c, g, or t
  misc_feature (550)..(550): n is a, c, g, or t
  misc_feature (609)..(609): n is a, c, g, or t
  misc_feature (675)..(675): n is a, c, g, or t
nttggcagcccctgggaagaggaggccttggggccagagctcttgccaggcctagatcgctaagaaggtgctgggtctgggncccgccttgnncgggccccccanaccnagctggaggncaganggnaaagagggnagcnagaaagnnggggtgctgggaggnacnccagnaggggggggnggcctttggtntctacgaggctaggaanctggttctggttagaggaaccccgtgggggcaaagnggagagctggtccctgttagaggaaacgctggagcnggatgggggngggggacttggggtntggtctcaataaggcntggaaatggtctncgcttaaaagaanacctctgtatttngggagtggggtggggaggaaatganngggctgtgggaggaatgcctgtnantcgtgggtgggaatcagtccagggggcttngnngggggtccganggaaaagctgcgggggtcgtctgcaaatgctgggagctcaggtcctggggaaggaggatgtgggcgggggtcctctccctcccacgagtgccancgctccccaccccatcctggctggctccaagttgccatggagaccactcacaccggggnaacgtaatttccagggaacgttccgaattttttgggtcctccgggagacacccacaaaccagccancgtc

SEQ ID NO: 634078 - DNA, 1475 bp, Homo sapiens
  misc_feature (70)..(70): n is a, c, g, or t
gtatttatagtagttagtgtcaaatatatgtggtgttggtaaagaggggaggtgatttattgttgttgtngcacacacaattggtttgtttgcacaacagaggggggtgtcgctacatatgagtgttgcggccgacataaaggttgtttctaaagggggggaggagtcccccccctaatatggggtgtaatataatcagccccactctgtttgggtggggagacaggatattgtgtgcctcgccccgtgttgtgtgggaaagaaccacaagtgtgttgattggtgtagtctacgctgtctaggtgcgacctaacctctgcggttgttctgaacaagcatattagttcgatcctcgaacaaggttgttatatccccctcaataggggggggtaagaagcaacccagaggggtttgaacaaaagaggggtgttgtggtggcggcgccaaaaatctatgtgcgtccgcctcgtgatgtgctcctgtttctcaaccgtggttaaagacacgttagattagtgttctcgcggatgatgtgcgtgttgtaacgaaagacggtgtgacgcctctcctcttgggggaccctgcgcgggaaagatgttccacattcagggtgtgtgtaggaagaaagagaaacacccccgctgtgtcgtgagcgggaatatatatagagccgagggtacccacgtgttgtgtcgtataagagatatatggtggctacacggggggaaaaatttcgtgagagagatatgttctgtgcgtgagaaagtgtgtaaaatctcacacgtgtttagtaagcgcctcccccccgtggtgtgaatttggagagagagagtgtgagccgcggaggtgcacacacccgcgcgtgtggtgtctctgtggtgactggagatgttcacaccctgagagaggtgtgtgttttgacaccacacacactctcacacctgcggcccgtctcaagagtgtggtgtgagagggggtgaggagacacctcgtggtgtctataacaccaccctctcgcgcagaaagagagtgtcttacacacagagaaacgctgtgtatataaaggtgttattgttctaaactgttctctcacaagtgtccctcttgttttgtgtgtttgtgttttcttggggagaggggtgttttttggggttgtttatttgtgttttttttgccagcagggatgagagatataaagctggagacaataagagagaaataaggggggagagagagagagagatgttattttgcacataagagatatgtcctcatcgggaaaaaccacaaggtttgttaagaaagtttgcctctatactcggtgtttcccaccggagagagaggagaaaaaaacacacttccacccctcttttttttaaagtgttgtttgctttttatgtttgtgtattttgtgagaaaaatattagagccattattttttaggtttaaaattataaaactaatttcaaaataga

SEQ ID NO: 634079 - DNA, 278 bp, Homo sapiens
acacagcgctctcatttttttttgatgcgcataagacatccttaaaaaaatccggttttttttttaagattttctacttatcttgggttttaagggataagtggttggaaagtgaccggcattcgtatagtttccttcacatttctggtgcttgaggttataggagattcttaaaacggggggttaatggttttcaccaatttggtattttttctactattatttcttcaatttacgggggcttttaaagctttggttctgttaattctccgcggggt

SEQ ID NO: 634080 - DNA, 119 bp, Homo sapiens
taccacagttcacacatcacactcacgtctcatgttcattcacaggtcacacagtctcacattcacacatgcattcacacaccacacgatcactctcacattcccacccgtctaggagc

SEQ ID NO: 634081 - DNA, 139 bp, Homo sapiens
atacgggataatcgcctatctagggcttcttatgagcaagaatctgtccctactcggttgtagaccttatctgagtagaaaagctattacctacaacaatttcacagcaccaaatctccacctccatcatcacctcata

SEQ ID NO: 634082 - DNA, 1053 bp, Homo sapiens
  misc_feature (174)..(174): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (227)..(227): n is a, c, g, or t
  misc_feature (230)..(230): n is a, c, g, or t
  misc_feature (235)..(235): n is a, c, g, or t
  misc_feature (243)..(244): n is a, c, g, or t
  misc_feature (251)..(253): n is a, c, g, or t
  misc_feature (256)..(256): n is a, c, g, or t
  misc_feature (258)..(259): n is a, c, g, or t
  misc_feature (265)..(265): n is a, c, g, or t
gtagggtgacttatcagtgcgtgctcgggtgagggggaggaagacctattctgaactgatctcttatttaccaccggtaccgataataagtcatgattgatcaagatgtgttcagctcctgagccgggacattcaaaaaggaaccacccaaagaaaaagagtttcaaagcccanggctcagaggggtgcgcacaacaaccttatttngngctgngaatccagagctnttnattanacctaacnnacctgtnnnggntnncggatnggtaactctttcactttgcgtggcatatagtggttatctacatgcaatacaagagaataaaaaggatctctatgaagctatgatagtgagggggcacagttattttgaagggggaaacattcaaaaggggataagtagggcgggtatagggcagagtggacctttattaaaggttcgtgaaatcttcaaagtgaagagaccttgtgagtgtacagtatcatgtgtctgggtctagaacatgctaatgaagagagaagatagcagtggcaagcagacaactgtcgtaaatttggtcctttcaacagttgcaggcattatctcattctttttccacagagtgagcgtcataatatggttgctttccttacctcttataaaagtgccatgagaatggaagtggtgagggtaaattattaaatgtctgtagtaactaaaaggtagccaatggctggttaaagaaaaagagacagagaagcaacgaacaaacacagcgaacacacgaaggccaggagccgatacggcccgccacgcgaaaaaggccgtcgcgcgacagaacactcagtgtggaggaacaggggcgacacacaaagaaagagaaccacgaccaaccgatgggggtaaccaaaacgcagcgagcacccaagagagaaacacacctggggcaacacagaacacaagggcgaagaggaactatgcaccaaatgaaacaacgcgcaggagggagacaccgcgaggacgcgcggagcaaacagagcccagagaggaggagtactacagagagaaccaag

SEQ ID NO: 634083 - DNA, 339 bp, Homo sapiens
  misc_feature (174)..(174): n is a, c, g, or t
  misc_feature (207)..(207): n is a, c, g, or t
  misc_feature (209)..(209): n is a, c, g, or t
  misc_feature (214)..(214): n is a, c, g, or t
  misc_feature (227)..(227): n is a, c, g, or t
  misc_feature (230)..(230): n is a, c, g, or t
  misc_feature (235)..(235): n is a, c, g, or t
  misc_feature (243)..(244): n is a, c, g, or t
  misc_feature (251)..(253): n is a, c, g, or t
  misc_feature (256)..(256): n is a, c, g, or t
  misc_feature (258)..(259): n is a, c, g, or t
  misc_feature (265)..(265): n is a, c, g, or t
gtagggtgacttatcagtgcgtgctcgggtgagggggaggaagacctattctgaactgatctcttatttaccaccggtaccgataataagtcatgattgatcaagatgtgttcagctcctgagccgggacattcaaaaaggaaccacccaaagaaaaagagtttcaaagcccanggctcagaggggtgcgcacaacaaccttatttngngctgngaatccagagctnttnattanacctaacnnacctgtnnnggntnncggatnggtaactctttcactggtgggggggatgcgtggcttctccctttcgctatcggccgagcaattcgcaggaccgt

SEQ ID NO: 634084 - DNA, 326 bp, Homo sapiens
  misc_feature (2)..(2): n is a, c, g, or t
  misc_feature (8)..(8): n is a, c, g, or t
  misc_feature (45)..(45): n is a, c, g, or t
  misc_feature (51)..(51): n is a, c, g, or t
  misc_feature (68)..(68): n is a, c, g, or t
  misc_feature (79)..(79): n is a, c, g, or t
  misc_feature (83)..(83): n is a, c, g, or t
  misc_feature (90)..(90): n is a, c, g, or t
  misc_feature (107)..(107): n is a, c, g, or t
  misc_feature (131)..(132): n is a, c, g, or t
  misc_feature (146)..(146): n is a, c, g, or t
  misc_feature (152)..(152): n is a, c, g, or t
  misc_feature (195)..(195): n is a, c, g, or t
  misc_feature (221)..(221): n is a, c, g, or t
  misc_feature (224)..(224): n is a, c, g, or t
  misc_feature (238)..(238): n is a, c, g, or t
  misc_feature (244)..(244): n is a, c, g, or t
  misc_feature (266)..(266): n is a, c, g, or t
  misc_feature (284)..(284): n is a, c, g, or t
  misc_feature (309)..(309): n is a, c, g, or t
  misc_feature (321)..(321): n is a, c, g, or t
gncacctncattttctgtaactcaatcaagactggtgggtccatngccctngtgttagttcatgcaantcagtgtgagncccnaaatganaagtttcatctcccganatgcagttccttagatgcccatcnngacgtgatgccgcngctccntgtaagcaggtgcaatcctagataacacagctagccagctagnagacacttttttctccaaaatgatgnctntcgggtggggagtngtaagnggaagagctcccaccctaaggngcacacactgagttgctnatgcacttccttgttcaaaataaangtaactgcttantctta

SEQ ID NO: 634085 - DNA, 242 bp, Homo sapiens
cggtcacgttgggtgctgcaatcccatgccactcggaggctgaggcaggagaatcgcttgaacctgggaggcggaggctgcaatgagcagagatcgcgccgctgcagtgagcagagatcgcaccactgcactccagcctggcgacagagcaagactccgtctcaaaaaaagaaaggaagaaagaaagaattgtgcacaaactgacaaacctagatgatgttttccccaacggtgaccggcga

SEQ ID NO: 634086 - DNA, 907 bp, Homo sapiens
ggtcgctgggccgaaaggtgcgcgagcgctgcccgcgcgggaccacaacccaagtcgcggccgccgagcatgcctgggtgtgggcgctgtgaagaatgcgtccctggcagggcgcccaagtacatagagcacttcagcaagttctcccgcgtccccgcgtgtccatgaagcagtttctggacttcggatccagcaatgctgttgaaaaaacctctttcaccttcctcaggcaaggagctgcctgtgagcgtggcaactatcatgaagagatcaagctgttcccggaccgagtgcctgagccacacccttctgtgcagctggttgcagagctggtatgtccaggaagcctccgtgaccctcatggagttccgttggaccgagggatcgcgaggaccaatcgcacccttgagccagtttcactgacgcccgtggttcaaccattcgggaaaccgggcacaaccgcgcgtgtgttgcccaaccattggcaacaaaggcgtgtttgaggtacaaggacacctacggcggaatgaccccgtttcaaaccagaaacatcaagtacttccgtgcacgcggttctacatcagccgatctccatccggagtgcttcaatcagacaagaacaccctcattttggtgggaggaccaaccagccaattccaaacatgaggcattgacaccaaatggacgctctgaggtggtcaagtgctacgcatggtaaggtcctgtgtgacagttactggctcactggcctggatctggagtcatgcgcactcaaagccggtaatggtagtcctgcctctacatgtttgtgtcaaaagagggagggaagcagagcagctccccacaggtggtggtgaatcaacagagagcgtcaagagacatataaaccggcgcggttgttcccaag

SEQ ID NO: 634087 - DNA, 1026 bp, Homo sapiens
  misc_feature (486)..(486): n is a, c, g, or t
ggtgcaattcaagatgattcataggaggcatcatgctgtacaacaatgaacacaatccccatggccactgaccgtgcccatagccaccttcgggccgaggttacctgagagtcgcaggtggatcgtccgcatgatacagcgactatctgttccttgcatattgagtgcacgctggagaagaacaccgtagggaggcttctggaagcataatctcatctgatctgcctagcagatcagtaatcactcctgtacagtagacagcaggactgagagacccgtcagtgagcttcacgtcttagaagagcagattccgacgccaaaagcgtagcatacgtacccttgttggccggaatggtttccgcagccaacaggcgtaacgcactgacgtgccacagcggtagtcgactcaggcagggcttaagatgcctgataccgcatcatagcatatggcaatatatgttgaatcgtcttgttgagctactttantagaatcatggctcccacgcaagagagctcttccaagctcatctcctcacaatatctcaataacgcttcttattcagagagaaaactaagagtgaaacccacgctgaacaaaccgaatgcatcctggcactcttgtgatattactatatgctatcctagtgcagagttgtgcttatcctgcgcatacgccgatacccatggatggtcctgaggagtcctactggggaggtcggttagcaattactactgggaatattgggatggatgccacagggagctgcagagacagcgattttcgtatcgtatcacatgggtctctggatgtctcgatgcggcgtgtgtcactgtgccgccttgtgtgctggcttggtcgacaaagggtccacttcagctggagggcccctcgcttgctgcctgtttcgccaagaccgaggtctgtctgggatggcgggcacgacttcaagccgcgttcaagtggcttcaggcttcatcgaaggtgtctcggggtcatgggggtgtttgcctccatttcgtcgaggg

SEQ ID NO: 634088 - DNA, 142 bp, Homo sapiens
tgtgcgggcacggtgataaggagagaggtcagagtggtcagtggaaaaggaggattcagaggactctgagcttggagcagagactgaaaggagcagatgggagagtctgaagggagtctggagagtctgaaggcagtctgga

SEQ ID NO: 634089 - DNA, 194 bp, Homo sapiens
agctcgtcgttgtactatgaggggacgcggaaacagttggtgtagtacaaagattaaagctacctagaccagtactcaccacaaggcacacctacacccctaatccccatactagtaattatcgaaaccatcagcctactcattcaaccaatagccctggccattcaacgcctccgggacattcaacgcctccg

SEQ ID NO: 634090 - DNA, 334 bp, Homo sapiens
actccttccctctcacacggaaggaggcccaggagaaactggtagcaggccgagatagaaggccactgattgctgaggctgacttggcctcccttatccgccgcattcatgcttgttcaggaggagctggaccgggccccggagcgcctggctactgccctgcataatctggaggaggccgataaggcggctgatgagagcgagagacgaatgacacggtcatctaaaaccgggccatgaaggatgaggagaagatggagctgccggatatgccgctgaaggaggccaagcacatcgctgaggattcagaccgcacatgtgacgaggtggcctg

SEQ ID NO: 634091 - DNA, 127 bp, Homo sapiens
gttacttttttgtccccaacctgagatgtatgaaggctttggtctccctggagagtgggtgtgatggcatgccagtgacttacctgtacactgacttgagaccagttgaataaaatgtgcacacctt

SEQ ID NO: 634092 - DNA, 876 bp, Homo sapiens
ggatggactgaggcttctggattcctgggtctgtgggaggagggactgcggctcctggattcctgggtctgtgggaagagaggagtgtctgagggaggaggggctgggacaaacttccaggtctctagccttcctggctaacgccccccgaggccggacttcccggatccagcctctattgaggatttgatgctgaggcctcacggggctttggaggtgaaagaggcccagagtagagagagaggagagatcgacgtacacggggatggctacggggaaccccctatgccggaaaggtgtgtggctttgaccccggggtgcgggcggcgactcaatcgagcactggtatcgtgcgcgccttcgatgaacagcgggccccgaggtggttatctgcgcacaaggatgatgtctgggggcccgtggcccttggagacatcgagtcgtcctggaagctgtctgtatcctctgtgatgtgactcatggaagatgatgttgaagaccctggttttctgagaccttccgtcgattttggcccgagtggaatcgtgttgtcaaaaaacggctggacacacctcacctcggcatagaggctggggaaaccctctgcccaagggattaccgccatggtgcttgtcagctgaacctactggggacgtacaccttgcacgagattcgctatccccatacctgaggaagacgtccgggaatcgtcatcgatcatctccagcctgtggagacaactgtggtcaatgcccaagacacttccctattgtgggcaccaagggcgccgataacagacatgacccaacgctttggccctggactgacagtcctcatggtgtccgagtcactgtttctccccaggaagctctggcc

SEQ ID NO: 634093 - DNA, 117 bp, Homo sapiens
taccgcacgtttcggagtttggctgggacaggggtagtggttgaaggggagcaggtagatgcatcagagataaaaggataatactgggtgtggctgaggggctgcaggctctctgtg

SEQ ID NO: 634094 - DNA, 1023 bp, Homo sapiens
  misc_feature (389)..(389): n is a, c, g, or t
gcccacactgtgtgctgttgcgcacacgttccagaccgttcacgatattgctgacaggcggggtataagggtgatgccagctaggctgcgtggagtcgggaccggagatgaagactgctcagcaaatctgtccccagtaagaatgggcgggcgggcggtgtggttggagcgctgtcggtctgggcgtggtccggaggtgctgcgttctctgacacctggtgcggccggggcgtacgtgcctttctgtctgcacgtgtgtattgtctctccgagtgccaccggtgcgggccgcgtacgaccttgctactcggactgtcatcttcggcctactatcctgtctgccctgttgtgccatgccgatgccatgtggctcgggccctgcgtccctnttggggcaatgcatgtaatcccgggggatttcatcaactatgtctacgtccatactgacgcccatcattcgttgatcaagtccatcttctcgtcgagaaggggagcatgccattggtcgacgtacccgagcttgctacgttctgggtcgcttccattcttcctgcgagcgggttctgttggctttgtgtcatggtcccaaaatatgtggcttcgcacgtagtgcgcctccaacgacgtatctagtcgtaggcatggcacgtcatcgatacccttaaacgtgcagatccgagagggtatggcacgtggtcgctgcatggtggcgagagtgtaccctggagccaattgtgttttgcgagcccattcaggttccgttactcgcagaaattccgaacctctgtcaatcgaaacactggaaagcatgagagttatggcctgagggcctgtaggtccatgggcgaacgatgcttgcccgaaaagattacgggtggtgcgatgaaccgctgtgtgcctaatctgggtggccctgggttgtgggatgtctgtcctcctcgggatcctgttcttccacaatgaacctgttgatgtttggcttcgccaacgggacccatgcctttgaggggaaaaggcgccttg

SEQ ID NO: 634095 - DNA, 256 bp, Homo sapiens
cttgaaaaaaaacagtagctcccaagggactcagcatggcttggtcttcgaagtggagttttgtttgtgtattcctagtccagcagtaaattctgctttaacataactgtcaggtttgctactcgaaatttgcacataactgaaagtgaacgatatcttttctcatatttttggccctacaaaccccctataccctgtgggaaacataccccgttaaaaatatttttaataaaccgccgggtatgctttcccaaaa

SEQ ID NO: 634096 - DNA, 457 bp, Homo sapiens
cttcctagaaggttttggtgaaagaaaggtggcctttacttacgtgtaaatttctagatgtagtaactgaggaattacgaagaacctggcttctgtgtggaatggaatattataggcattggattacagaatttgtttgggagggtgagggtggttgtgtgttctactccagagaaatcctcctctgtattttttcctctttattgttccttctttatcccatgtgacattccggtaacctatagatgagtatgagaacccctcttttttctcttgccctgtcctaaaaaccgggggccgagtaggggggataagagatcagctgggcgtggtggtgcggcctgtggttccagctactccggaagcataagacaggagaatagcttgaggcggaggttgcagtgagccaagatcacgccactgcactccagccagggcgactgagcgagactccgtc

SEQ ID NO: 634097 - DNA, 1031 bp, Homo sapiens
cttgtgcctttcgcggctattggaagtacacaaacctaactggcaccttcctgttccctagctgaagaacgcaaacttgttcacgccactggcactagcacaagcagctggcttcttacagctggcactgcttactcaagcccacattcacccaggcacttacgcactgggcctggccagtcagccagctgcactactgtcacgagctctgctgctacggccacccctctgcacaaaccaaacgtgcgcatacttccttgcactgcccgcagctgcaaaaaccaaaacacaggctacttctacacggaccttatccaacactggccagccccccactaaacaactgaactgtcacccctctcccttggcacacagcacaaggcatgactaactactggcggctgatgcacgctgacttaaacccggaaccaaattacctctcaacccctctctgcacacacacacaactgccacatgttaacccaaactaacaagaaccacgcacaaggctgctacaataccctgcctgactgcaaccctacaaccccttctcacacgcaacggacggtcgactctaagccaagctactcacctggctgcacagcccttagcacatcctgtatccaaccctcgcgacaacacttgcacgaacacaaggccctcagggacattcccctctcatagctagttgccaggacccgaaggggcacctaaggtaccctatcgctgcctacgctcagctagcgtggacgcacgacccccttgactacacgcaacaccggtggccacttaccacggcacgcgacaaccccccccttccaacctcctctacccaaccctggatcaaacaccaacggcgcccgggcacgcccccactcacactcaccctacacaacgtcaccacacccatctcactccccccccagcgacacccaccccccggccccgcaccccacaacacccctctcacccgccccccacaaccccccagccccccacccccacagccccccacacagcccacccggcag

SEQ ID NO: 634098 - DNA, 1027 bp, Homo sapiens
ccttaaaacaattctgtgacatacatattatctcattgtacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaattttaaaagggggtgcaggggctcaggccctgtaatcccagccagcactttggggaggcgtgagaaggggaagcatacgtgagcccagaaataaagaagaataaccctatggaaaacaattagcaagaacaccgtggtcttctacggcgggaaacaaacacaacaagaaacttggacccttataaagaagaagtcaaaataaaataagcagtaaactcccgggaggcaaaaaatcctcccaagtccgggtcatgggccctatttggaaagggcgcccagaaaaaccgtggagtgtatagttaacacgcccttgttttaagggggcccgtgatctgctgtggtttggccccgtgaccatctatgtgctttaacccaaaaaaggcaaattccgtcaattgccgtagatatttctcatcccaagaaaggggcgggggggcggcacgcccaaagggacaaactaccggcgaccttcttgtgtatacgcatatatacaatatgttccggaaaaagaacttaccctataccgggaaactcacaaaggatcccaaaaccactttaaaagcctcccatcaagcaggaaaacgcccgggtaggcacaaaaaagacctgcttgctgacacccttggccctggtgggaactaggggaacgctgtgcgtcaccaacgctcggcggtcaacggtcggaaaaaggccagtttccaacaaaaaaagggggcaaacccggggaatccgtacacgtgtcaggcccagaggaaacacggcgcacaaggaagcggctgagcacctgtacggaccaacgaagagccggcgcaactacacgccaacccg

SEQ ID NO: 634099 - DNA, 175 bp, Homo sapiens
cattataaaattagagtgagacatcaagatggcttcatttatatggttgtatattagtaggttgacccagagtcgggaacggcagatgtctcacttttctatgtagtgtcatcaggaaataaatccaagcactaaacaggaatcccaagacagattactaaggttgcatgatgga

SEQ ID NO: 634100 - DNA, 497 bp, Homo sapiens
gagtcacgggtaaaaactctacaaggttatttctgtcaatgcgtagatatgaaagacaggttggtattactcaggaaatgtattctgcaagcttttccttatctcataacagcctgccatgcctacaccaaattgggcatttaattcatctttaaactggttgtcctgttagacgcaaacttagtaagtgcttatcttatagaaccccttctgactgagcaatatgcctccttgtattataaaatctttctgataatgcattagaaggttttatagtcgattagtaacagtgctttccatgttactttattcagagctaataagtgctttccttagttttctagtaactaggtgtaaaaatcatgtgttgcagctttatagttattaaaatattttagataattcttaaactatgaaccttcttaacatcactgtcttgccagattaccgacactgtcacttgaccaatactgaccctctttacctcgcccacgcgg

SEQ ID NO: 634101 - DNA, 400 bp, Homo sapiens
ttctatgctttgggacggcggacattggggttgcttgcatggagtcacgcactgagcagcgtgcttgtcccatagtttggatcttgtggtttcttacgcattgggccaaaataaacccaggtgaatggcctatgggagggagagagggcagggagcttgctagagccgcggtagagatgcagtctttgagaaagcacgcggcgtatgcgattgtgtaacgcggctagccatagtggacatactggtggatgtacctctatactttaccatacctattctcttactctataccaaggtaacaagatgctcaactataagtgctccccagtagcagggggtatgcctgctggacagaaaaggcagtggacaccccatactgagtggagggtaccctcggacg

SEQ ID NO: 634102 - DNA, 479 bp, Homo sapiens
ctcgacgacattgaggagtttgagagcattcgcaaggacctggaggcccgtaagaagcagaaggaagatgtggaaggtgtaggaaccagcgatggagaaggagctgctgggctcagcagtgaccccaaaagccgggaacaaatgattaatgatcgaattggttataaaccccaactcaagagcaacaaccgcacatctcagtttggaaactttgaattttagagatggattctcttgtatgccagacccctgggacagaatacaatgatgacaggagtaccaaccagatttagagaattaagtgtgtgcaaccaagcagaaggttttctgtctcctgcagggagaggtgacttctgtgtgaaattactgctgtccaacctttctgcattgctggaagccaaattctggcttcttcctggaaagttggaccgcagaaggcttaactgatttttgtttttaaaaataaatttatttttgga

SEQ ID NO: 634103 - DNA, 154 bp, Homo sapiens
cccgactagcccgacaggcaaaaacggcaaacgcagccctcccatgctcaagggaggtctcatcgctctgccatagtcctcacaaatctccaaatacaaccaagatgtgtctccctcacagccctcgtccaagccactgtcgggctagtcgggg

SEQ ID NO: 634104 - DNA, 1134 bp, Homo sapiens
cttgaccccggaggtccctccaacgctcctcaatcagtttgagaacacaggccccccaccggcagataaagagaaaatccaggccctccccgagctgtccgccgtccactgaggagcacgtaggctccgggctcgagtgccgctgtgtgcagggacgaatacgcgctgggtgagcgtgtgcggcagctgcactgaataccacctgttcgcacgacggcttgcatcgtgccctggctggagcagcactgacatgctgccaccgtctgccgaacaaagccatcacgggacagaacagcggccaggaaccccccatggacctcacatgggcgtgagcattctcctcctcgatcgtcatcgatcctccgtccagctcgcccagacaacgagaacgccacaagcaactcgtgagcccacgtcggccgtcgggaacagcacggggccatttccacacgccagcactcagacagcgccaaacaggcaacccacagactgggtgccccggaggcgccaaacgcataggatggtcagagcatgcaggtaccgcctgatccagggacagggacacccgaggccacagacaacccggacaccaagggctgacgaaggcgcaaggaacacacagtgggaccccacagagcacagaccccaagactacaaccggcactcgtgacaaaactcaaacagacaaaacgacacgccaagtggaaacaaattttaataaagtgtacagatgtattaaagtactgcaagatgaggaggacaaatgaagataaagaatggtgggcagaagcgctgtgataggtgaagaaaaagagggcacaaataaaataccaaaagataaaaaagggagtaaggaggaaaccaaagataaatgtgaccagaacagacgcaaggaaccacagaccacgagcggaaacaaacaacgaaagaggaatgcaacatagagaaaaacaactcaaacacagggacagaggacaacaactacccaggacgagaaaagatatagacagaaaagacgacaaaatccaggggaacacagcacaaaacataaagaacagcacaaaaacacgcgtagtatacacagaacaacaaaacggtcagtcagacctctattattagagtctttttatgtgt

SEQ ID NO: 634105 - DNA, 304 bp, Homo sapiens
ctttaaagcactggggatcagtctctaggggccttgggctgaagctgggtgaggcagagagtcatgaggccacagagctggtgcaacctgagcctgcctctctggccccctcccccactactgcccaaagctgtttacagcaccttcgccacctcccctctaaaccctgtccatccactctgcacttcccagtgcaggtgggtgggcaaggcctcgagccatactcctgagctgcgagtgacggagagccaaggccacagtcccagcccattgcttcatcagtcctccactcgagcttcagagt

SEQ ID NO: 634106 - DNA, 188 bp, Homo sapiens
caacagggaatctagtagctccggataccgaagcccacgggcacatgctggaagccccccagaaccagcccgtccagctggatagagcgcacacaggcctccagctggggccaggtccggtctcatcatcccaaggtcttgcacatccagcaggatggacggactgggccaccagttgcaggcttctg

SEQ ID NO: 634107 - DNA, 102 bp, Homo sapiens
tcaacaggaggcagaggaggaggaaagagaggaggaggaggaggcacagatcattcagcggcgcctagcccaagccctgcaagaggatgattttggtgtcgc

SEQ ID NO: 634108 - DNA, 533 bp, Homo sapiens
acgaggcgcgcggcgacatgttcgagcgcggcgtcctgcaatgcttccgccgactttcttgggactacaagaccaatcagccattcaagttcggcaagcgggtcatcgtgacgggcctgatgacaggcggctatgcaggcagccgcgcgacgaacgaactggacgatctgatgcgcgtcttccacgtgctcgacggccagcccgaagcggaccacaggaacggcatgcacgcgctgatttccggcgcgcggcacgaaaggcgcagagaagccgaaaacgcctatctgcatttgcgctggttcaagaacgggaacgggcatgccacgttcaagcggcccgatctggtggacaagctcaacctcatcttggccaagcactacccggccgcgctcgcggccgagcggaggcggtgatgggctttgcgctcgatttcgtatgtccctttgaaacgcgaccgcccgaggtgccgccgtaggatcaggccgtcgtcatgcctggatcgcgcagccgcccagctgagacgccggcggccg

SEQ ID NO: 634109 - DNA, 663 bp, Homo sapiens
tggtgctgtaggacggttgctccgagcgtcggttgcccgacatagttatgttgccattccttgcgggcatttcttgccacttgcaggccctcagtgccattgcttgcatgttggaaagaacacgaagcatttgaccacacatattaattatgtagttcatagtgtctccaatgtcaaagcaaacaattacttcatgcaaccaagttccctcaatgccattgcaaccttgctggtacaaccagacaattgacaccctaattttaatgtggtacagcccgttatgtacaattgggaagcagttgcaaagaacctaaacgccctatgacttggactttctaaaagcgggggaaaacatttaaatcgtatggggatggccataatgatactataccttaatacacatttttgtggaggaaccatttattatcacaacccgccgttatattgtggattagactttggagtacccattcacccaaaacgcaaaacaacttattgactagtggccgttattactgaacaggagatgaggaactcaaaataaaggccaataacaacaagaaaaaatcttctcacaccaggaacttggttgcaaacgtggcattgacaacgcgcatttggtctgcccagcgatctatctacgacttgcgacgtatctccaag

SEQ ID NO: 634110 - DNA, 221 bp, Homo sapiens
gtagctagtggagatcttcgctcagctcttcttccctagatcaaagacaatatcatctgatgtataagggatgggtctggatcgccagacattagtcagctcccaatgggagcccacggaactaagtagggtcccaagaaaaaaacgggagctatattaacagagctaagcttactaccaaatttcattcctccaacctttagtgagggtaaattagtacg

SEQ ID NO: 634111 - DNA, 623 bp, Homo sapiens
tcactgtcttaacgtctggctgtgctgtaactttttggaggtgttttagaacgtttcgccttctttgtcttctttcttttagtctcttgtatttgctgtgctccttgaccttctagctctttctctggaatgagatcttctccgccttgggcttttggatcgtcgccgactcctagacttagaatgagaccgccgtctcgatctgcttcttgaccgcctgtgtccagaagatgaggttttcctcctcctcctagaacgtgatcttgatcttgaatgccttcttttttcttctttcttatctggttctatagcagcagaaattagggactgtgcttctcgtactcttttcatagcttcctctatttctttactagaggtatccgatttcagactaggtgaaacgagaccagcagctacatgattcaacttgggatcaacagtactcataagcttcagcgactgatctgcagcaagagactgagagttcaagtttgctccaggaagcccaagtgcagccagggcaggatcaagagtaggagcccccaaagcagccagtggaacagcgccaatctggggaagcgggtaaggagtaggccggagccacccccaggcagaagacctgc

SEQ ID NO: 634112 - DNA, 206 bp, Homo sapiens
  misc_feature (94)..(94): n is a, c, g, or t
  misc_feature (151)..(151): n is a, c, g, or t
  misc_feature (187)..(187): n is a, c, g, or t
  misc_feature (203)..(203): n is a, c, g, or t
cctgttagatctgttaaccaaccgtgttcccccaggcgtcgatgaagccgcctatgtcaaagcaggttcctggctgctatcgcgaaaggcgaanaatatcccctctgctgactccggaaaaagccatcgaactgctgggcaccatgcaggntggttacaacattcatccgctgatcgacgcgctggntgatgccaaactaggnacc

SEQ ID NO: 634113 - DNA, 147 bp, Homo sapiens
ctgctcgaattcaagcttctaacgatgtacggggacatgttggccaggctggtcttgaactcctgacctcaagtaatctgcccgcctcagcctcccaaagtgttgggattacagatgtgagcccagctgacctcactcttaaaaaaa

SEQ ID NO: 634114 - DNA, 484 bp, Homo sapiens
gcccgaggacccagcagctatccaatgctgtctggttttcagcatagtgttgtatgtccattgctagctgtcctgctgttaacacagtgttgtatatttctaaatgtacataatcatgaaagaaataaaatagtgagctatgtgatcttctgtgtaagcagtggttcactggaaaaatggtgtgctagcatttccctttgagtcatgatgacagatggtgtgaaaccatctaagtttgcttttgaccatcacctcccagtagccaattttgcttttcataatccatttagcaatccaggcctctgttgaaaagatcatatgagggagaagggaacacatttccttcttgaacttacttccctaaatcactttccttatttatcatctaatacaatgatgggttgagttgaaaatacagaagggggtgtttgagtattcagatttcataaaacacttccttgtggatagctgcgtgaattggggt

SEQ ID NO: 634115 - DNA, 623 bp, Homo sapiens
ggagccaagtgctaactatgccttggcttcaaaagggatggggaagtcagccgttaaggatggtcaagtgccaggtggaaccacgcttgcttgaggctcatggactgcgatctctaccacctaatctcgtctcagagcctgacagaggcccttgcgccctgcctctccaggatgtctacaaatacttgggtggtattagtgtacttgttcctgttggccgagttgcgaggacttggtgttcgtaccagtaccgcgtgtgactggttgggttcacccttgtggctccaagttcaagcgggttaacacatccggataggttaataactcatgtctgaaaatggcgaacccgatggaaagccttcgacgtggaaatgctcctttgccctgggggagaccaattggctggggagctgtcacattgggtgcccacaccgcaaaatggtgtgctactaaggtcagaaggcggactggggttccccgttccggataggtccaaagaccgttatcgccgttgggttggacctagccaccacataatttgaaccccccaacccaaattggggcaacgccaggctgggagcttttcacctggacttcgaggttcgatttgatcccggaaatcc

SEQ ID NO: 634116 - DNA, 113 bp, Homo sapiens
actgatagttccctataatctgtgccccgatatggtgttcccgcataaacacacataagcttctgactcttactacctctctactactcctgctcgcatctgctatagtggag

SEQ ID NO: 634117 - DNA, 676 bp, Homo sapiens
gtatggcggatggggacccctgttagcacgtgatcctgagacacactggaattgcgccacttcaaggttctcatgcgctggtcatatacagaggcgggtcagtgtcccgctgttgatttcatccgttactctacctcgatctttgcacgatatttggtgctacatactgaaaacgaaaccctctgacatttgtctccgccataatatccgtgtccggtctagggttcccgaagctagtgctgaggggtgatgataggataccggtgtgcttagagaggcaatggcatatagacattatctattgtggaggcaaagtagtgagtggtcgcgcgcaagatatactcccatagggcaggcagtcccgacgggggctgcaagtagtggttgaggctgaagctggattcccggtattataggggtagcccgaaccagtgacctgcgtagtactgctcaacttgggcttgtcattgctgtgacaacaaaaacaaggtcgtgtgagcatggctgtgcgagaatcgtggggctgaatttcatgggcgtcgtgcggaatgcttacttgtaacgacaagtacctcatgcgtggtgggctgaccgaactgacgattgcgatgacgatcacgggggtctgacccggctcgtggctctataaggaggttcgagaacctcttgccgacag

SEQ ID NO: 634118 - DNA, 1717 bp, Homo sapiens
  misc_feature (472)..(472): n is a, c, g, or t
  misc_feature (817)..(817): n is a, c, g, or t
  misc_feature (1305)..(1305): n is a, c, g, or t
ccatcgcgtctgaaatggcggatgacgccggtgcaggggggggggcctgggggtcctgagttggccacatgcggatggggtatccgcggtggctttccggcggatggtttcggcgaggtggcagtctcggggccggtggtctgcgggcctgatggacctggtggcctggggccgatggccggctggacgctcgcggatggtaatggcctgtgggttcccggatgtgcgaattgctccggtcacgcaaagttcggagccgagcattgagtcgaatcggacgattcgaatgaatcagaagatctcctttgtcatcggatcaatctattctccattcttccgcgatgctcacaattaatcggatattccatggacgatttcaacttggaagtttgtccctttctcattggagagtgtggcctttgcattcgttcaatagtgagagtagatgaggtatgtccaagagattcgaatntgaatttgccaagagttcgcaagtgaagaccgcgagcgaaactcgcttggttagccctagtgcgctatcgacagcgagccaaggggtgttcagactgggctactttgttggacctgactaaattcttgggggcgaacttatcagaagttgtgcgcgaagctagttctagaagtgcttggtgtcgctagattgaagatgtgtgcgtgccaacgtgatggagtttgcgcgctaagccgggccaagttccctggtctggggtgcccaatacattccctttggaggtcagatgcatcttctcgacatccagggtcaccgcgcctgtattgcttgcgaatggagaaggcntaacgatatgtgggtgggaaaacgaaacggaaatcgagggatgaatggcgcctctagaccaacatgtggttcgcactatttggcccaaaggtggtttgggaccgatggtggcccaggcggttgtcgggggtcatccgttcgtggcatttgggcttatcggccctccaattcgcccttagggcatacgcgccaaggtgggggtccatcacttggggaaacttctggtttcgttccgcatggcaaagacaccgtttggtttggcgcttacatgtgaaaattggcgtctggacgtccaaattgaagattgtggcgcgtctggggtaattaccaacagcttgtgacactttgctataagggaggcgattcgaaagtcctctgtgggaatgggcctttgtggaggtttggaccaataccccatttgtgagacgagcaccatatacctgctcaaggaagaggtgccccaacaccatttttttgaaaatgactcnccaattatgtcatcaaaaggaaatcgttatacaacgtcgttaaaacactttggtaatggcccacggaagacaaccctgtgtgaatatggaccaaacgagtgtttgttccccaccaacagggagagtcccgaagatagagggaggaactacctgggagagcaataccctcgagccagaaagaaacaccccgacgagacgagagtgtcctcctcaggtgacgcgaaccctcagagaggttccacacgaggagtgggggcttcaccaaaaagaggaggaggaaatacagcggaccaacaaccagcagaacggcaagctggagagctaagaatcactaacgaacgaaggagcaagaatgaggaggtagcccacatgatgaccaccgagagaggcgcaacaacggatcacaatcgtc

SEQ ID NO: 634119 - DNA, 433 bp, Homo sapiens
  misc_feature (306)..(306): n is a, c, g, or t
  misc_feature (433)..(433): n is a, c, g, or t
tttttttaaatggacttgtatttttaatttttttaaagattctctctctatatatattaataaaaagtgcaaagaatagaccttcatgtttaaattatattctaaaataaaatatatatatatatttatatttccattaactgcaggagacaactgtaaagggcctgagagtccagtcccctctcggtcactagaataaacatacattttaaggaagcacctatgagaaatggtagagttcacaacaacagttggggacacagagcttctgggcattcttgaaagcagattgtttgcattttagtnttacatgaaatgaaaggaaaaagtgaaattcataaacagaaattatcgtacatacaaactacagagcattctggagtcacgccctacttgcccagggccctaagctacagtgcggagggagagccan

SEQ ID NO: 634120 - DNA, 555 bp, Homo sapiens
tcgtgtcgtaatcagctcaatattccctacagtattgatcaatttgctgggttatttattatcctacccatcaaatgaagctatcttaatttgaactatgcaacatcttgctgtagccaaaatacctatcttagatctctagaatatgctctcagcttggtgtaaatgctcacatctgaaaccgataccagactcattctcctgttcaactcagagtaagtaatggcgccgtgttgcccattacttatttgtactctctttcccaggtccagagttgttgcatccacctaaattagtttccagtccttgtcaggctgatgcatctgttgcaactatcacttagtaaggagatgtcgatgaccatggcgtgattaacctgactacactctctgttaagcagttaagagttctactggtatgtttggtgcagcatggtacttagatttgccttagaagagtctttaaaaaaaaaggcctttagaccaggctgaagtgcagtggtgcaatcatgtcgaacttctgggctcaagcaatcctcccagctcaggctcttga

SEQ ID NO: 634121 - DNA, 266 bp, Homo sapiens
ctgacccagctgaggaaatactcttaattctaaggaaacctggagcacaatggggagatgacagtgagtggttgacactgccagtggatcagaaatgtgaacacaggctgtggaaagcaaggttaagtgggtatgaggaggccctcaggatcttccagaacataaaggatgacaggagcccacagtggtccacatttttaggattgatcaaaaatttggtcactgattccactgcagtggttcacttgaagggattagagctcact

SEQ ID NO: 634122 - DNA, 866 bp, Homo sapiens
ccttgcctgtcagcgcaccgaattgctactcggttgccctcgctgttctcatagccattgtgggctagttcatcccatgggccgtatctgtatatggttgtacgcagttccgtcttccccacaccatgagccgattcctctccaagacccgtcgattactggcgtgtcatctatgcactggtggcatcactcagaagacatgttgaatggaatgccatctggatcgctacaatccgtccaatgctggcaggtacggaataccctttgtcttacgtcgatgttaccagtagaggcgtctgcaaggttactacagtgttatcgcccctagcttacatgtatgtagtccataggtacctttccagatgtgctttgtcggttcgggacgcaccctggacctctcagcatgcacgtgagaacggctctctgacaatgaagcagctctgatggaatcttcccagctattgagggctcacgcgtggctccgcttagaccctccccttggggccccatgacgataatgatctacaaagagacagtaccctctccagcctgctgacccgaacccaaccacacaatggtttgtctcaatctgacaccagacggctggaccactccgtaaattgtgtgacgctcttcccccttcccgaggtcccgtcagggagcactagcgcctggctgtgatgtgcggccgctcctccatggccttaggaccagtgccaacgctcaggacctgcatccactgtttaacactatacctaaggtcatgagcagttcgtgctaagataactagactccagctcctggtaccacccggcatgtcagtcagcactctggccttcatcacgagaatccgcacccgtggctag

SEQ ID NO: 634123 - DNA, 294 bp, Homo sapiens
  misc_feature (137)..(137): n is a, c, g, or t
acaagctacttatctatggagataattgcattaaaaataattcacagcatgagataacttcaatagatgtactttgtgtcatgctcatggattactttagaacaagcagagtcattgagtggttacctctgcatgtntggagtggactcacagatgaacccttaatgaataatgtgtccggggtttttagagagagggagcactcttaagttaccactttgagacagctcttaacatcttagtgaccatttgtagttttctttttatgaggaacccatgcttctatacttaagc

SEQ ID NO: 634124 - DNA, 1323 bp, Homo sapiens
ggggggcatgctttcgttcattcgtcggtctttggttgattgtatgatccacacccacccaccaatcatgcgttgttgtgattgaattcaataagatgaaatcttaaacctccaaactatattgattgatgtatgccgtcgaaccaccagctagactgcaagcagtcgtgctggtgtggcttaattaatcagacggcctactgtcaataattaatttgatggtagtcgagcatcatcctgacagagcggctgtcatgttgtgtccctcccacctgtgcgtactatagagcagtatgagaataatgtatacagtagggtcgcgctgtgtggattatataaatcaaccgccgtcatgtcgtgcgtctgtgtgtggttgttgtttttatgtgggggccccacagcagaagatacgcagcttaataatatctagttctgattttatagtagtaaaagaattattgttctctcccagcgtagtagtatatgaagaagaggcgagcaccagcctacagtgcagtaaatgtagacacagctgcacatctacgatctcttatacgcacactgccgcgggggtggtattaattaattgttataagtctcgtcgctgctgagtaacatcaccttcggggtgccacaactagtttcgtgacgggggttggggttgataagtaggatacacaactacataaccgtctctttatttatgtctatcttctggtgggttttaaaaataatttattatctgtcggcgagataaaaccacccgtacggcgcggcgtgtttttatcttgggggggtgtccacacataataaccactcctctcctctctgctgtcgtgcttctagtggtggcaataatgtatatctctgcgtcgttagacacatctcgtcgggcgctctgttgtttgtgggtgcgaccagcaaatgatcccaccgctctctctctgtgtcgctctgtgcgggtatagatatgttgtttgtagatataaacctctcgtcgagcgcttatttctcgtggagagaaataaatagacaccactgctatcactcgtccctgactcgttcaaacacgccacctctcgtcggagagcacagaaaacctcgcgccctcggagaacacaccctctcgcgcctcgagacacacaccctctctaaaagagaagagaggcgcctttccctgaaagtatgagggtggcgtgacccacctgcccacttacctccctctgattccctcccctaatgggggggggtgtgagggggcccccggcccccttttttatatataactttttttttttttaaaaaaaacaaaaggttccttca

SEQ ID NO: 634125 - DNA, 80 bp, Homo sapiens
taattcccggattctgaccatgagatctgaactcagggcacgactagaagccctcaaaacccctgggacctggaaccaca

SEQ ID NO: 634126 - DNA, 1146 bp, Homo sapiens
cggcacagcagcccctggcgctccccagcgctagcccgcgcaggcgctcactggcccgcgtcggctgacagctactgacagtgagcggctgtaccatggcccgcatagatgcggacctcaagctcgacttcgaggatgtcctgctccgacctaaagcggagacagcctcaagagccgagccgaggtggatcttgaacgcaccttcacgttgcgaaattcaaagcagacctactcagggattcccagtcgatcgtggccaacatggacactgtgggcacgtttgagatggcagccgtgatgtcacagcactccatgtttacagcaattcaataagcattactcccttggattgactggaagctcttttgccacaaatcacccagaatgcctgcagaatgtagcccgtgagttcaggcagtgggcagaatgatctggaacaagatgaccagcaatcctggaagctgtgccacaggttaagtctatttgcctggatgttggccaatgggtattcaagaacaattcgtggaatacgtgaaacttgtccgtgcaaattccctgaacacaccattatggcaggggaacgtggtgacaggagaactggtaagaagagcttaatactttccggaagcacgatatcatcaacagtgggacggttgggaccaggttctgtgtgcaccagcctggaacaaagacgggagttgaggatacccccagactgaggatgccgtacatgaagtgtgccgaacatctgcccaagggcactgaagggacacatcatctcatgatggaggactgtaacatgtccagaggattgtcgacccaacgaacttaggaaagctgcgacagcacactccggccacaggctgggagagaagccaacgggtccaacagaatgcacaccgacaacagagtgatcggaccaagccaccacaccgggaaagcccccaagcaacgagccaagcggaaaacaaccaggaaccacacgaaacagaacagaacgcgcacagagacatagcggaaaacagagcccaaccgcgcacaagacgggcaggaacacagaacaacacaccaggaaaaacccacggaccagaaccgaggaacgcagacacacgacacaagagagccgacaacaaagcgccgccgcaa

SEQ ID NO: 634127 - DNA, 583 bp, Homo sapiens
ccctttctttgcgtttaataccatggcggctgggaccctgtacacgtatcctgctggagggccttcaaggctctcatcgctgctcagtacagcggggctcaggtccgcgtgctctccgaaccaccccacttccattttggccaaaccaaccgcacccctgaatttctccgcaaatttcctgacgtcaaggtcccagcatttgagggtgatgatggattctgagtgtatgagagcatcgccattgcctactatgtgagcaatgaggagctgcggcgaagtactccagaggcagtagcccaggtggcgcagtgattgagctttgctgattccgagataagtggcccagccagcactctgcgtggtcccaccatagtcatcatgcaccacatcacacagcccactgtgaatgcaccgctggaagcgcggcgtacaccgctactcgtgggctaccttgagacgagggccttttctgctgagctgacccagatacggccgcctgtcaccacacgttgcccgcccctctgtgggcgaatcgtatgggagtgcgcctgagactttcccttccgttctgcgccttttacct

SEQ ID NO: 634128 - DNA, 433 bp, Homo sapiens
attgacctaggagtcactatttacctgtaaaaagtctatactcggtaaaatctatctggacgaccaaccagaataagagagcagaacagactgcagaaacctatattcaattaaatcaaaagcagaaagggggagatgttggaggctgaaagaatgagggtcatggccaactcagtataccactggaggctatgtgagcaaacagcaaacagttctcatgaatacaggatattggaaagctgacagctgcatcagacaccagaaggaatgctgaggacagtcatgcatcaggcacagtgtaccttgtagtaatctataggaacatactggaccctgtagtatacagaacgcaattatatgagcctgtgataaatcaagcagatgactaaaaactgtaacctcttcctaccctgtagattctacctaatacatg

SEQ ID NO: 634129 - DNA, 805 bp, Homo sapiens
gagcggccataataacatgcggccgggactcggacgaccagtcctgtgcgtgaatggtggtaatctctgcttctttgttagaagatacatgagatacttagagcttaggtgcgtttggtatgccttgtaaactagtcagaaaattgtggggaggggcagaggttgaggtggtgtactcgaaccttgaagtgtcaggagtaggttggtgattaggacgagtctatgtgaccaggtaattgttgatagaacagcgtggttctctatactgaagaatatgagtaatcaatttttgacgacggccagtggctggagggggtgcatttaatcccagctattcggggaggctaaggcaggagaaatccgcctgacaccttgcgcgaggtgcgtgacggtttgcatgctgacgccaagattgtgttgccacttgcactccaggccttggacaaacaagagtggagactctagtctcgaataaaaaaaaaaaagagagaaacagagaactttatttttagggctttggtgtggtggtcaaacctgttgtttttccccagataaatcacttggggaagggcgttggtagtgtaggcattgtacgtgggctacaagggtttgtggcgtatgcggaactctgggtgccctgggtgtttgacctggtggtgagaatgactcctggtgctctttaagataccataattgggatttgcgaatgggtggaacaaggtttacagaaaatttcttccaggtttggggtcccctcatgaaagggttaagttacgggggagaagtcaaggtggttacaaggact

SEQ ID NO: 634130 - DNA, 143 bp, Homo sapiens
atcaaccacatgatcagggcagtcttcttgtggcgaagggctgacacagatgagaactgactctggaactactcatgaccatgatacatgtacgtgcatccaagaagaatcttctccatgatctccatagtggaatggaggag

SEQ ID NO: 634131 - DNA, 886 bp, Homo sapiens
cgtggggggagacgagcagacccgaagcacggcgaggaagaaaaaggcaaggttcccggggtcgtggttctcgcaaaatatggtgggacgccattttatgtgtccccccgctaaggacactccgcaattccttcttgggaacccgcccccgtgatgttccgcggcaagacccaggctcttttgggaggacacttagtgatctggggatcccacagcgcccggccagggagttactggtcgggcttacaataagggttcaaacccgcacttttgccttttccgcgccgtttattgtatatcagctcccccccgtattttcgcccaccaacatgttccaagaacttcttgtagtaggcaccccccttaaggagggttcacacccccgaaatccctgggacaggaaaggcgccaaaaaaatatgcgcgcgccccctgattacacaataagacctgcttttgggagtaaaataaaaagtcccgccgtttcgagacatgttaattcagggacccccacctccgatcaagggtgagacgcccaccggaaccccccctcttaagaatctgcttaagactccttcagggattagcccctacgccttcacgcaccaaggcggggggagtcccctttgtcgaacatctttagagaggatggcgtggtaaaaagatacacagtcataaaaacccgggtgatatgcataaagatttagaataccagggggagagtctcgcccccctttttggcgccccgccccaagttggccccacggtcatgaggtcaatgcgttccttgtcgccttctcaaacagcacgcggtaggagaattacacaaaggtagccaatggcacaacgttcgcccccctagcccccgataatccccgggcgtccca

SEQ ID NO: 634132 - DNA, 839 bp, Homo sapiens
cctcgggtgataagcccccagggggagagcccaagaaccttgggggaaccccaggccggggcccaaacccaaggagagggccaagaaccctctccaaagagccttgcaagcctaaggcagaaaagcgtgaaaatcctccagcacgagtccttaagcacgcagccctcccagagaaggccccagaagacaaggcccccccaggggaaataaggcagggagcaaaggaacatccgggacagcccaagagaactcagagagagtccccgagctcaaggattcagagtaacaccatttgttcacttggtctgtctttaatgtaagaagaaactgcttagattgacggggcctccttcttcaaacccggaatttctgttagccaatatgttagcacacgagagggcactcccacggcccctgcccccaatgccctccccacggcgatggaccaattatgatagcgttatgtgagctgagaatgtgagtacactgccggagatgccaccacgtataacaccttgagctatgtaaaactgcccccctcctttccacaataagtgcactttattgcctctatgtgcaactgacacgatgaccgcccatatatgagatgagcacgttatgaaatacacttatgcttgagatgtcttaacctattccccaatgccttctcgttttccacaaggagtggtcaagacccttgcccagagctctctatttctggaagagcggtcccggtggggccgggccctggcccctgaattaagccacgggcgcactttccactggagttcactttcaaattgcttctgtgccaataacacccagtgcttataaaatga

SEQ ID NO: 634133 - DNA, 438 bp, Homo sapiens
cagttaaatacagaccaggttgtgattgatgcaggagcactcgccggtctttcccagcctggtcaccaaccccaaaactaacattcagaaggaagctagtgaacgatgtcaaatatcacagccggccgtgaggactagatacagcaagttgtgaatcatggattagtcccattcctatgcagtttgctctctaaggcagattttaagacacaaaaggaagctgtgtggcccgtgcccaactataccagtggtgaaacagttgaacagattgtgtaccttgtccactgtggcataataaaaccgttgatgaacctcttaactgcaaaagataccaagattatactggttatcctggatgccatttcaaatatcttacaggctgctgagaaactaggtgaaattgacaaacttagtataatgattgaagactgtggtggc

SEQ ID NO: 634134 - DNA, 167 bp, Homo sapiens
ggagggatgtaccggaatagaattttcacagtgtcgatggaacttagattaagaagtactttctgtggacccctcacactggtcgtccacactcacttgcagccggcaaactttgggaatttctatcctccagcaagcatcgtcgcaagcctccggaagtatgtagt

SEQ ID NO: 634135 - DNA, 443 bp, Homo sapiens
  misc_feature (2)..(2): n is a, c, g, or t
  misc_feature (71)..(72): n is a, c, g, or t
  misc_feature (97)..(97): n is a, c, g, or t
  misc_feature (199)..(199): n is a, c, g, or t
  misc_feature (241)..(241): n is a, c, g, or t
  misc_feature (342)..(342): n is a, c, g, or t
  misc_feature (376)..(376): n is a, c, g, or t
anattatcaataataacattgaatgtaaatgactaatttccaatcaaaagtattgactgctgaatgaatgnnaaaacaagatccatttatctgagcnactaactatattccaataaattggaaaatctagaagaaatggacaaatttctagacatatacaacctaccaagattgaaccaggaagaaatccaaaacctgnacagaccaataacaagtatgagatcaaagacataataaaaantctttcagtaaagaaaggtctgtgaacctgatggcttcactgccgaattctaccaaacatttaaagaagagtggataccagttctactcaaattattttgnaaaaatagaggaggaaagaatacttccaaactcnattttacaagtccagtattaccctgataccaaaaccaaagacacatcaggaagaaaaaagaagaaag

SEQ ID NO: 634136 - DNA, 202 bp, Homo sapiens
  misc_feature (44)..(44): n is a, c, g, or t
  misc_feature (60)..(60): n is a, c, g, or t
ccccccctttttttttggggggggttttttttcccaaaaaaaanggtttttcaccttttnggggggggggaaaaaaaaggtttttccccttttttaaaaaacccaaaaaaggaaaaacctgggtttacccccggttggggggttttttattttcttggggggttaaggggggggccaaaaaaaaaattttttttccccccca

SEQ ID NO: 634137 - DNA, 1271 bp, Homo sapiens
agcggctctagcaccctcggccgggcgtggggtgactgtgcaccgacgtcggcgcgggctagcaacgccgcgtccgcccgcccaccagcctggccaccaccgccacctgcacccgtttcaccgacgactaccagctcttcgaggagcttggcaagtgtgtgaagaaaacctccacgcagcgactacgcagccagaaatcatcaataccaagaaattgtctgcccgggcatcaccagcaaactacgaacgctgaggctcggactatgtcgaccttctgcacaacatccaacacactcgctgccgccctcccctgcaccagctaactgactcctgcaagcaacgggcttctcacgtaagccatcgctggcttcccgaacccttgcttaacccggggccgcgcgcgcaagccctgcctcctcgcacacgccaaccacttcggctgcggcaccccacccaacgcaacgctaaccttaccagcctgcaaacgcccaccaagatggccccgacgccccagccctgtgcctcacttacccgaatcgcaacgcaccgttctacccatggggcaagtaaaggctggagtcacaacgcccctaccgaagtttcccaaacccccaagggacccacgcacgcaagcccccgcgtcccgggccaccccccagccaccacgccgggcccacccccccctcgcacacacaggaccccccccccgcacgcgccacaaccccccagtggcccccgacggcccagtgggccgcccccgcccaacggcctctcaccaccatcttgcaccccaactacgcacgccgcgctcgcccccccccgacctccccgccgcatccccacaatccatccccccacgcgaggcccccactacgcacccgatactctccccccaggtgccccctcccccatccaccgcgccgcccgcacattcccggctaggcacagcggttaaccaacacgcgacgcgcgcacaccgaaacggcccccacacgaccacacgcggggcccgtggaaggccggcccccgccacaccgcgagccaccaccacctgacgagggcccacccgcgcgccccccacaaccccccccacccccacaccgcaggcgccccaccaacacgccaaccagggcacatcccaccacccccccatgccaaaccgccgcgcacacccccaccgccaaccacacccccgacaacacaacaccccaacgtcccccccccacccaaaaacccctgaggccccacacacgaataacaccaaccaagga

SEQ ID NO: 634138 - DNA, 177 bp, Homo sapiens
gggggttggggcccggggtttccccccccgcaggattgggggcttccttgtttaacgggtgaatttgggggggcccaggccggggctttttttggggattgggccctttttggggccgggggccttgggctggggcccccccccggttttattaaaaattggtttttgggggcccca

SEQ ID NO: 634139 - DNA, 182 bp, Homo sapiens
cctcccgggttcaagtgattctcctgcctcagcctcccaagtagctgggactacaggtgcctgccaccatgtccggctaatttttttatttttagtagagatggggtttcaccatgttggccaagctggttttgagagcgaccactcctcataattgcttacacttaatttctgtttgctga

SEQ ID NO: 634140 - DNA, 1586 bp, Homo sapiens
  misc_feature (186)..(186): n is a, c, g, or t
  misc_feature (405)..(405): n is a, c, g, or t
  misc_feature (426)..(426): n is a, c, g, or t
gctgacaacaggctggttgctcggcgtggcatatcctaaagctgtgcctggctttgtagactggaagtgatgagtcccagactccatagggctggcgcgtgactatttccagattagtagaagcgaggaactggattacacaagaggggcatatatgaaccaacggattgctggatagacacccangaccactagtgattgcagcgtcctatgcagagttaaacgattgccgcaagagcgttcgtcatggcttagtagtaatagctcctcaaaccactcgcaagaagccatccacatggtaacgttacctcgatctactgacaccgattctgtctctagaacgaagggctcatggccatgatagacggagcaggggatgccctcgtgcaaggaggacaattcaanctggaggtagcatagacctgntaggctcatcagcagggttggaacgatcgcgtctaacccgagagaggcattgttacatagtagacatagtcgcaagtgtagtcgcaccgcaattgcaatgaatcgcataggactgcaatgtccattcctaggatatacggcgggagtatctctgggattgccctcgcaatcgtagtgggcattttgcattggaggcttttaggggcaattgcggaaagcttaacccctacgtcgcgtaacaccgagcgtggctttgagttgggacccctcggtgtgtcgaggaaagcatcaccttgggaggcgccaattattgtggtcacccaagcgtcaagaaccgtcggtcgtgggtagactatttagacgttggaaagcctacatttaacccaagctaaggcacctactatggtccatggattagccaccctggcgcgtctacggtctcgttgtggaagcaacaactagaggatctctggcaacccatcgtagtcgttgactcgtccctacaggtctgctcgtcgcatttttgttattcaccctagtgggcttagctgctggggggtagtcaagtggggggacattgtgcggcatcgtgcgtctcttgacgcgcaggaggtgtccctccaaccagggtaccgcgtgtcgcacactgtgcgtcgaaacaacagggctccatttggacgcaatagccctcttggttgacccgtaaattgtcgcgtttcacttcggaggcatcggcagaccccgtctccttaaacaaatacgccagggttcgaaagaacgcacatacacagggtcggactgcatcccaacatccgttggggatttgaacacaagaacagcaaattttcttacaagtgccacggccaatctaataggactctaatgacacgaagccatttacttgaatgcacgctcacaaaaacaggcctttagaaaggaattgcgaccgaaataacaggagattcccgacaagaaggtcctagttggatcacacgcgtggcgaattcggaagaaggacatccatcctgtgagagttaacacccggctgttcctaatagccccccgtgtctgaactgtgttgcatcttatccacccaaggccaaatggtcccgaagcaatgtaggcaccaccgacatgccacggaaactgtgtccccccga

SEQ ID NO: 634141 - DNA, 803 bp, Homo sapiens
cgagggtagggctaggttagcgaggccgggtgttaatgcgtgctcgattggagcggagcctgtgagccctagaggtgggccgcgcagccgtcaggtaactggcctgccggcctagcgatgtgatttcacgttgcactccagtaatgctcctcatactaggcctactatgccagcacacgaaccatataccaatgatggacgcgagggtaacacgagagagagcgacataccaaggccaccacacaccacctggtccaaaaaggccttcgcatacgggataatccgtagtttattaccgtcagacagctttcttggtcttcgacaggagtttttctgagcctcttgtaccgactcgcagaccgtagaccccagtaccccacacaagctagcgcaggagacaacatggccacacccaaccagggcactcacacaccgactacaaaatcacccatagaaagatacccaacatcacgtacaacgcacccaataccgacaaacacatagcgtacgggcacgtcaacgggaagctcactccacacctcacccccatggaagacgtacacgccacacaccgctccgcacaccaccgacacaacaacgacaagccggacaaaccacaacacacttacactttcctcacggacaaccgtgcccatttaattatcacccaactcaccactaaacttcgggggactcctccttaacatcaattaacccccccatcccctcagccacaagccccctccacgtacgattaccttaccggacgactcgtccccccctttacaagcccaaatcacaac

SEQ ID NO: 634142 - DNA, 1239 bp, Homo sapiens
tttggtgaagcggcgaaggaggtggtaggctgcgtatgggctaccgggaagccgtatcgggctaggggctagtcggccgcggggcggaggcactacgacagacgaggggatggcccactagcgatgacctatggtatacagctgtccatattacctgtgcaccatactcattgacaaggaacatcggctaccaagtactagacccacatctgacgatacctattatacatggatagtagggagaggggcagctagggctgagacttggcctggactagaacagggtagccgggaactgctacaagaccctagagttctccagagactactaacagctatgagtaccgactatatgagacagtccagaagctaacgctatatggaatctatgacatagacaacaagaacgccagagactgagggatgatgacttcctagaggaggtgctagagtgtaccactaggaccagattgtgtccagccaggtacttgactctccccttgatgctgaaaacctggaaaaccttgactgggacggggagaccatcacggtctcagctcaggaattaacaggacaatcgtgtagtaaccatggaggtagaaggccagaaacctaaatcagaaaggacttcctgggaacactcagataccatatacctggaaggtacttaccgacaagggatgattgggaaagtggaagctgggttgtaccagaatcatgaggtcaaacaagaaagcacactgaaccctacaatggacacggttactcaagagtacccacggatatcagcaatttcttagaaggatgggaaacgacaagaataagagatatcaaggatagaaatgcaccagataaaattacaggtgaaggagtaaacatgagcacatcatgaacagtttaatacaccagtatagtccagacgataacggcagcccgatgtgtttatttgctaatactctcttataaaattgcaacgacataacaccataacaaacgctggccccatcctcctcaacaatctaactagaatacacgataactccttacgaattaaaatagagaagcgtccacatacaacatctgtacacaatcatactaaggaagcatataaacaccacatagtatactgaccaacacctttacatagactccgactatgaaactacactatgaacgaagcacacagtagatacaacaactactttctcatgcctcctcacctgtcctactagacctata

SEQ ID NO: 634143 - DNA, 153 bp, Homo sapiens
tcgagctcggtaccggattcgatgtgcgcacaacactataaggagttgatccaattcacaagtcaggccgttcacacgcttagttaaggtggccattatggggccaggtggctggcaatgcagtgaagctgcctccctgcctaatgtctcttt

SEQ ID NO: 634144 - DNA, 259 bp, Homo sapiens
ccccctttgggggccccggggggggggtcccctttacccccggggtttttgccccccctggggaaaaaaccaaacccccgttttttccaaaaacaaaacccaaaaaaaatttttggtaaaaaaaaggggtttttggggtttttttccctccccgggccccccaaagtttttccccccccttaaaaacctttccctttattaaaacccaagaaaaaggggttaaaagtggtttttttttacccccccttttaatggggga

SEQ ID NO: 634145 - DNA, 115 bp, Homo sapiens
aggatctcaggaaccgtggttcggaatatcttccatattgtaattactactccggaaaaaaatgaagcatttgggctacactaggtatggtcttgagctatgatatcaattggtt

SEQ ID NO: 634146 - DNA, 608 bp, Homo sapiens
ctgttcaatcttaacacattgttactttaatatatgtataaagaagtattactgtttgtaaagctgctgtttgcttaaaaaaaaaaaaaacaccctgtcatgttatttttctgtatgtggggccaacaggtttagaacattcaactcattttaaacaatttttatcttttttggatttaaaaaaaaatttctgctgaaataactttatttacagacattcttcctcctccctcatccctttccaacctttacattacattcacagaattcaaccaaactgtttgcctaatctgaaatctgaatcctaattgagaaaaattttaacttttggtgggcacattcacaccttgaaagtattggtacttattttataatttaatttctaaattataccacataagtttataactttaatgtcttaatggtaatgctctaaataaaaaaactagcaaaattagtgtgagtttataacattgaagggatttccatctttggctgtatgaaggactaatgttatatcaccattgggggggtaataacagctttttggcactatgtaaatactagtggggattcttctgtactaataaacatgatttcttgacacg

SEQ ID NO: 634147 - DNA, 137 bp, Homo sapiens
gtaaatcagcgatgacaggttaagcagacctggagatgatgcttctcctgaaccctggttcagctgcattcagaacaagcccctgtattttgctgatcggctgtatgactccatggaagggcaagtgggacagcgag

SEQ ID NO: 634148 - DNA, 122 bp, Homo sapiens
caatgtattatctggagacacactatataccctggtatagcagatcgtatgcagaaggcaaatcactgctctgagtcctagcaccatagaagattaagactaatagactccccctagagcgt

SEQ ID NO: 634149 - DNA, 214 bp, Homo sapiens
gcaggtcgctctgaggatcccgttcgtggcatcggcgcgctggtggtgttccctctacagatgatctttctggtggtgaaacgcggcgtcggactggtgctgtccgccaagctgcgggtacctgtcgcgggagaacgttcgtcatcaccgtcggtggtataggcttcagcgcgtcagtctcgccctgctagttctcgtatcctgcagtgcgcct

SEQ ID NO: 634150 - DNA, 159 bp, Homo sapiens
tttcactgtggccctgcagctgggaatccctcactcctttgcactgatcagtctatcaggtcacaaatttcctacagatgactgatcagactcctgtgaaaggatccttcacagcaggcttctttggtacggtagtgtgactacggtgcgttgggccta

SEQ ID NO: 634151 - DNA, 474 bp, Homo sapiens
tgttaggcaggaattgtgaacacagagtcctacaagagaacagcagttaactgaaggcagtgaagcagctgcatgaaacacacaccctctttctcttccataaagaaatatgctctctccctttttttctcaaaagacacaaccctactcagtccattttttcatgttcctacttttaaaagagtcatagaaaaatgtggtatttcactttcttcttaaggatgcaaatgctctttaaaaaattgcaacatcctccgtgctggggacaagagagttgcagaaatgcaataaacaaactgagggtacatttgaacggccagcgggcacttgctgcagcccattgttactgtgcaacatgtcaggccctgcattaataaatcttccaagttttcatgagaagaaaggaattggaatttttatttaaaatctcatggtgtttttttaaaaaaatattagccactaagtcaaattttg

SEQ ID NO: 634152 - DNA, 886 bp, Homo sapiens
ttgacaagtatagttaattttatatggctttaaaagcaagcaatattcatatctacagacgtactcttcacttactggtggacttatgatcgccgccaccatatataaatatatatatatatagcaaacagccttgcggaaatcatcggccagaaaagctgcgagggcgtatgctaatggtcgttataccgtaccatgttatgccaccatgtgggtgagggtgagcagggatgattgaacgtgcatagcgatatttcaaacttctgttatacactggcagtgtgtccctaatgagaagctgaccagattatgcattctacctgttctcatagcacgaagtactcgaccaaaaagccaaatttcccctgttggagtatggtgacttagtgtagtctgtggctgacctacgaaatgacacagagttatcaagagtttcccttcctagaagatgaatgtaaccttttgtgttaggacggtagagaagataacaaatagcttgtgcttgccctagaaatgtgctaattactcttaacaagcgcaatgacattcaagagcctgtcctggagaactggaaatgtcaggatcactggttcaggttgtttatacctttagtgaattccctcaggtacaggtggtgacgtagggaggttcacctggaattgaaactttaagggaggtgaaacctttcggatgttgcctgcacttttcttatctgtgccgtttagttttcctgctgcaaatagccggaggcgcctccagaatctcgggtgggggacaggacgacggggcacaaagggggaaacgtttgaaaaataggtcaccctggcagaattgaaggcacaacagaggggtgcccagggacccacattgcccgaggttgttttca

SEQ ID NO: 634153 - DNA, 947 bp, Homo sapiens
  misc_feature (487)..(487): n is a, c, g, or t
gggaggagccgcagctgccgatgccggtcccagtcactcatgcaccgtaaccatgagcagcgaggccgagacccagcagccgaccagctggctaactcgcgtacggatctgacatgatcaggagagagacccagctcctgggactattccgtgtccgcggcctagtcaagtgcatacggttctcgtccagtctggcgccggtcccgtctccacttagggcgagtcgcttttcacagtaagcaggacgcagggatcggatcgaattgccatcccaatatgactctattggagagaatgcagttaggaacggccgcacatgtgtacctgaaccgtacgtatgtgatctccgtacatacagggcagattggcagtgaaaaccttcattttgtggcaaaagaagcgtaccgtcggtttaaacctttaggctttagtacccgcgtcgcaatgtaagttcccttaggagaaccaagagtagacgcgctagggnaaattccccgtctggaacggtatggatgcaaagtcgaagcttagataaccgtacccgaagtgtggaaatgcgccccgcagtgtcggtatggataaatatagcagttcgacgaaagagcgtctaagactgcttcaactgagtcctgttggcccgcatgatttcaagggctatcaaaaggaaccggaatgctaatgtcacgccagtggacggtcttaaacccagctaaaatacaactgtgtattcgctaccaggagagcggtcgcgtactacgtaacaggttccacaattgcattcgttgttaaactcttgtgtgaggtcgaaaacctagcgaagttagacagtgcccgcagtcgggtccgataagaaagttgaaatttcacgcacgtaacaagatcctttgagaaatacggggcccggtaatattaaccctgataaggaaacccactctaaaccacccatg

SEQ ID NO: 634154 - DNA, 844 bp, Homo sapiens
gtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgttcagagtagttgactcctgttcctcagccattactaagacttgttaaagataatcaagtgtcccgtgattttggtataaagaaacagaattttagaaattattttttacatattctttttcttcaggcaagatgacacaaattatttttggaaaaatggtttcaaggggcatttgttattactgtttttccattttatttatttatttaatagactttgtattttagagcagtcttaggttcagaacaaaattgagcagaaagtacagagtgcccccactattgacatcctacgccacagtggtgtatttgttacaatcgatgaacctacatcaatgtctcattatcacccaaagtccacagtttacactctcagtgttgtacattctgtggattttaacaaatgtgtaatgacatgtatctattagtggcatttttaaaagaaaataattatacctggaaagtgaaatattgccactatttgaaaatttaaatgcaacaaaaaaaaataaaatctcaaaggggaaaactttaatgaactgtgcaccatgtgctaaacacttacttgctatagtccaacataacactctgacattgcatacaacctttcactccaaatgtcacatggtgacccctgcttccagcagtagcataggaaca

SEQ ID NO: 634155 - DNA, 151 bp, Homo sapiens
tgaacttagtccatatgaagacaacacggcgtcggcgtaggcatagacccgatccgccaaggtaaatcccagtttctattcatcagccggatgtacgcgatgtcagccgtagacgcactcagatcatccagattcttcatgagacttgggc

SEQ ID NO: 634156 - DNA, 166 bp, Homo sapiens
gtatatgtagtgtatgctgaagtgataaagattgaagtataatgtaagagaacgttctcttaatgtgtctgtgaatatgtatgtactctctctctctcaaataattgtgtatattgagattgtgtcatatatacagttttgttttgttttttttgagatggagtct

SEQ ID NO: 634157 - DNA, 403 bp, Homo sapiens
atttttatataaaagaagtttttcccctttgaattgctaaaagtggcatttttcctatgcgcagtcactcctctcatttctaaaatagggacgtggccaggcccggtggctcatgcctgtaatcccagcactttgggaggccgaggcaggcggctcacgaggtcaggagatcgagactatcctggctaacccggtaaacccctgtctctactaaaagtacaaaaaattagctgggcgtggtggtgggcccctgtagtcccagctactcgggaggctgaggcaggagaaaggcatgaatccaggaggcagagcttccagtgagctgagatcaccccattgcactccagcctgggcaccagtgttaagactctgtctcaaatataaataaataaataaataaata

SEQ ID NO: 634158 - DNA, 153 bp, Homo sapiens
tagttgttaggtaagaatattcggtaagccagtaattcagaataactattgtagaaaataataataatctattaatgtaatgaatcacctataaagtactaattaacttgttttacaacataaataacttgttatcaatagagcatttttgta

SEQ ID NO: 634159 - DNA, 115 bp, Homo sapiens
tctcaggatagacgtcttttctggtatcccagtctgcagtgggcaaatctatgtctttatttctcatttaagggcagactggagggatgacatattttttacgttttcaaggagg

SEQ ID NO: 634160 - DNA, 439 bp, Homo sapiens
  misc_feature (1)..(1): n is a, c, g, or t
ntctgtagagcaggttggcgatggcagtggcgtgataatagagttgaatgaaactactagcctcccgggatcacgcgatactcttgtcctcagcctctgggagtagctaggattacagacatgcgccaaaatgcccagactaataaatagtagttttagtagagatggggtttagccaagtaggccagccttcctcaagcgattctcttgcctcagactcccaagtagctgggaccacaggcgcccagacaatatgcccggctcatttaatagtatttcaagtacaggtaggtatacaccgtgtaagcaaggatggtcatcgatctcttaaactcgtgatgagcccacactcggactcccaaaagtgctgggattaatcggagtagagccaccacgccctgcccgcaaaattcgattgggtaactcctaaattatacca

SEQ ID NO: 634161 - DNA, 451 bp, Homo sapiens
aattggaagttattcctggagttctttaaagaaaacggagggtataccgggtgtcctttccctgccaaactggacttgcaacagggacagaatttactgccaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctaaccctgacccagaccccgctaattgcccccccgggaacagatggtccgggcggggtttttccttcccgccctttcctccccctccctgctggggagaatgacacatcaagctgctaacaattgggggaaggggaaggaagaaaactctgaaaacaaaatcttgttctatgcaaa

SEQ ID NO: 634162 - DNA, 101 bp, Homo sapiens
tgttaggaagatctggggattacagcagttctacgactgctctccggttctctggaggtcatccacaagtgggcggagaagatccctgtgctttgctgagt

SEQ ID NO: 634163 - DNA, 631 bp, Homo sapiens
gtactgtctttctttctttgactgtcatgtgcctatttcctacgggtgtacctaggatcacatttgtcatgatctcggatggctaactatccaacgatactgacaatcgatgtcctgctacgaagactgtatgaaccatggactgcctttaaagcgtcaagtactatccacatcacaagaggttaacggattgagtacagaactgttatcatgcgctattaaagatcacctgatgcatgtgatatacactgggcttttagttcgtgcccttacctagcaatggggaaagtgcggataatccacgagcaataatgccagcaagggtcatcttagttattagctacatcgatatgacaattagtgcacctagatctgaaatagcgagactgtattgatacggcgcgagtactttcacttgcatgagtaattgaagcgctttgtagccttacgatgaatggatgtagagatgcctgatctagtataggcgtcacttgacgcagtaggtatattgactgacgcttgactgtacactgcgtcagcttacgcgctgaagatgcatgatgtcatcgactagcgccacatgtcacactgaccgctgacagctatatacttctttgatatagcagtgttg

SEQ ID NO: 634164 - DNA, 346 bp, Homo sapiens
ctcgctaccgctctccgtgagatgcctgtcggtttcagagctcctgcgcagatccgcgctaaacagaaagatcatgacccgcactgacatcaaattgatgaatgagctgctacgcctgggtggcttgcagaagcacttgcacaaccagatgaaggacggaatgacgactgagctaagtaagcagttctcagaggtattggttgccctgaagaaggctgtaattcagcttgatctacaagctgtgccagtcggggagtgacgaccaggtgaatgtgattatcccgccaaaacgacgtgacggagccaccagcttcatgaagctggtggcttacataagtgtgcggga

SEQ ID NO: 634165 - DNA, 1245 bp, Homo sapiens
  misc_feature (440)..(440): n is a, c, g, or t
ggcatctctcgcgctaacctcccgaccgaccgcgtgtcctccgatcagttctcatcgttcatgctccacggatcgttggggtcattcagcataacgcggccttcgtcaccgagatattgtgattcgcagtaggcgagcgtagcgccgcgccagcagtaatgaggcatggcacgtacgtgattacggtatgcacatgaagcgaatggcatgccagtccgtgaaccacaactgagtgcattgtatgggtgcatgcgagccatgatgagtacaagggcacatgcatatggctcgatagatcattcaagacaagggacgccaagatatcgcctaagaaggtagatatagttgaccacgacaagattgctctatagacggaaccttgagtagttggagcgaggagtagtgcagagaggtaggacatggaggcaggcaaaggtaangaagataggcgtctctggttgggggaccaagtagcctggggtggcgattgtgaaagggatttaatgcactcagacccatggatgtgtggccccatcggtcgcatactcgccgagaatttaccggagtggcttgaatacggttgctcgataggtaaatattctcggatctggaacaagtccctcatgaagtgacgatcgtagggacaaaaagcaatcgcgccaagcaatgaaaatggttgtggacctgccccagaaaaagtttcgaagggctagttttgcgtagttctcgcataggggttggcacgcaatttcgattaccgcctgggatattagagggaaaactatgggaaaacggaattgcgtctgcttgcgaataatgtgtatagaagaactaccaacgataagcggcgtgggtaaggctttaggcctcaaagctaattgaaatgaaacggtggaaggccgcgcgctggaaaacttcggttgaacaggaaataagggcatgagggagctaccatggagcgaaattagctaggggaagtatgagggctgggcgactattgtgttgaggggttgtcacccaatttcgggggaaggaattggttctcgaaaggtgggagaaaataaaaatcgccgacaggatggtaattggcggcaagatgttggaacgcagaggaaggagggtttaatatgtaggggcaacaagagataggggaacgttataactgaaatgaaagtgcgtgtgaccattcacttgacgacatagggacgataaaagcacacgggttggggggaaaaaagggaaaat

SEQ ID NO: 634166 - DNA, 125 bp, Homo sapiens
  misc_feature (64)..(64): n is a, c, g, or t
ctgaacaagatgctctcccctcctcggaggatgatgatgatgatgatgactcctcttcagaggngaaagaaacagataacaccaaaccaaaccgtatgcccgtagctccatattggacatcccca

SEQ ID NO: 634167 - DNA, 532 bp, Homo sapiens
gggatgaccaggctgctcggagtgccgagcagttacaatgaccaggccgacaaggcatctacccgcctgaagcagctcaagcgggagcttggagtgaggcctgaagaggaggtctcaggcgggccatatcgcctctctcgccggaatacttgcgagcgcgatgctcggtatggacgccacttgttagatcggccgatgccgatgaaccgcgaagtcgaatgctcccttattatatgaacaagctcacgcgcgggtgaccttggccgtggtgtacgtgtccccgaccgaattgggcccgcgagaaggtcgccggcggaattggctccgcaccgcaaagcagcgctcacgattgggccaatagacggagatgcggggctgaggggccaaaacactgtctcggagataagtccttctttcttcctgacgagcctgaggcagtgggattgtgacacgattatgtatgagctcaagcaaggccgtctcccatatcccgcaaggaccccccgggcgagtacaactagaccctcatacc

SEQ ID NO: 634168 - DNA, 975 bp, Homo sapiens
cctgggctactacgatgagcagatgagtttcagagtggccgtggcagtatcggcgttcccacccttctttacagttacgaaccggaatgtggacacgtcgggagaagcagctggccggcctggtgctcgctggtcctgtccttctgccgtcctgcacaaacagtccagcagtgactggtgatggaagtcgtcacggagagcccggctcttcaacaacgtcgaagctacagcgaatagcttacctgtggatgtcgatccagattgtattatgaggaactgagggaagaaagggaacctcgagtggttggagtaagagcaagtccagcttcctggatcatgtggcggaggccaggaagaactgggggaaactcagtctatcaggtgggtttccaggagtgggcagaaccaactccgatctttaccctgtatgaacggactaggggggaatgacacagaggatgacggagttccacgggctggatgaagccagtctactgcgggctctgactggccctacagatgagcacaaggcgagatcatcactgtcacgcgatggtcgaggcgtcaagtctggctatgccgggagcctggtatcccgttggacttgtgtgaccttcaccaccttttccggggggttcgcacacggggaccgacctgtggtccccagagaacggtccgggagtctccgatgcaaggctccgggccgaaggggggaccgggggtggtttcccccaggttgcccgttagggggcgcaggcgagcgtgtatattgcgccccctcacgacaacgacaatacgagggcacgcatcagcaacatgtgtacacggcagctacaagaacgcgggaaagtttcaccccgagagtcgtagcaacacgagagacactgcactcgtcggctcgtcacacagctgctccccctccccacgcaccgcgagagcaaataacagccacagcacagcaccaaagcgcaacag

SEQ ID NO: 634169 - DNA, 1072 bp, Homo sapiens
ggaaatttgcggagcacagcgtgcggtaatgcggggccacattgacttcagtctaactggccctgctgcaaaatgcgggaagtatgtgtgtcgagcgggacctggcgtgtgtacaagcgagctgctcaacatcttccccaaggaggtcttccgggcctcgataagatcatccaggcgcgatctatcgcaccactaccctcggcagccaggagtgtgggactcgctgtcctggacgcacgatggagaaccaccggatgtgactgcccaagcaaggagaccggacgttcctcgctgattcagtatcttcggagcgcaaaagctaccccatgctacaacgttgggtcgcgccatgaagactgtaggtatccctcgcattcctatgaactgtcgaaccccttcccagtagccccgggacctgccccaggagcctgtggcagctgtgccattgttctgggcctgctgggcatgagagcctgaccttaggtgccagggtcaccatctaccagagtccttttgcccaaagactcaacaggtgccagacagaatccgccgccagctgcacatcggtaggtaacgtccgagagcatgggggacagccaagtctctaagcttacccaggccctgccagggttctcgcctggggctaggctgggactccctgggcctctgggccagagtccctgtgcaggggaccaagggaatgtatagtttccacaacacgggaatccagaagcccgatccacatggctgcctgggcctgcacaacatccagccggactagccaatgcagcaggacccttttcctgttgtgtcgcccaacaacgtgggctgctttaacaacattcatcagaaagcgtaatatgaatagcccccgcggaagaacagcgcccaccggcgacaccaaccccgacaaggacgaaggatcacacttaccaccacagtcgatgtaacgtggccaacgcagacgagggtaggaccacaaaacaatgggacacaaaggcaaggggcaaacgaccgaggccacaaaccacaagaggagacaaacacaggcacaacaagcgagaccgcagaa

SEQ ID NO: 634170 - DNA, 1079 bp, Homo sapiens
gatcattcctgtgatcgaggatgctcgacacgcagacaaataccgcatgctcatcgcaactggtggagtgtgatcttgggctgatgtggtgccagccagatcgcagacccggattgtcggctcctgaagtgccgcagcgaccttcctgcgtaatggaggacgacgtacgtgatttgccattaaggccaactggcattagactccacagtgctcaggcgaggccgtgtttgcctccggagagtgaaaaaggatgggaacaggagaacatgaagccgcaggagcaggttgacccttggagtccatatgaatagagaccagtgccgtgggtcgatgggagtgtacaggaccagccgccccaaggtgaagaagcgtgaagttcagcgctggtcaggattgcgagagatgtgtgtcgatactgttgtcacggtgtgtgttttactattgaaagagactcatctcgttgcagagaagaaaagaaagatgaaagaaagaaaaatggtgtggagggtttgttgtgtggggggtggggggaaaagaggaggcaagagaagggggcaggtggtgaaacaggggagttcgctcctggggacaccgaagtttcacttgcgtgtgccaaaccgggtggtaaaacaactgcgcgcggtgcattgccgccttgaataaggcgaagtggagtccaatgaagctacttcccatgaaaagcccccggggtgtcaagcaccggggatttctcgagcaggacccccagggggggaaaacaacggcacccccacaagcacgggacggcatggccctgggacagaggccccaagagcggcacgacaaaccgtcacccctgtgccggaagcccccgaaactgggcacatgcttggggggacaccaaccgcggaacacccggtatggaggacccgggaacagacaagaggaaacacaggagggcaggaggacaatccaggaacgagcaaccaggcccccggggcgggacacgcagcacagggggaacgccaagccccgaaaggaccgccatccccaggagggcacataggccccggcgacggccatgggcaaggggccccgta

SEQ ID NO: 634171 - DNA, 210 bp, Homo sapiens
aaaagttgtacagagtttagaacaaacagctcgagagattttaactctactgcaaggggtccatcagggtcctgggtttcaggacattccaaagaggttttttaaagctccgagaacaattttgggacaataaaaacacatcttacatcttttaaggcccaatttccctcttgaccagtttaccagttttcatggagctctgggaggttt

SEQ ID NO: 634172 - DNA, 112 bp, Homo sapiens
ctaaatacctcttaggtcagaaaacaaaagtcaatagctagatcatagagatattaagacatgccctaaattccttaatctgacaaaaattcatatgaggtttaaatatttt

SEQ ID NO: 634173 - DNA, 1123 bp, Homo sapiens
gcaggagggtgctcgggaggccacaggaaggggctcctggactggcctgaggctggccggaggggaaggggctagcagtgtgtgtcaacagagggttccatcaggctgggtgcagggtgtggcgcttccgcacacttgaggaagcctcccctctccctcggtgacatcttgcccgcccctcagacaccctgcttgtctccaggaggtccgacagctctgtgggacctcttggtgggcaacggtggggtcgaggccgggggagtaagggcagggtcccggcgggtctgcagccccaagagcaggaagagatgccaagggtcatgcccatcggcaccagggttgcttggggccccaaggaagacacaacggagtctagagtgatgccaatagaccagacaccaacatgaggggccatagaggcattgcaggcaaggggactcgagactctcgcggaagggtttacccttccggagcgacccgagatatgtaggccacccaaaggcttcaagacacccaacttggaagaggcaagcacaggagcagtaaggcgattaaagacgggcatgcagtgctatcctaggcagtccatgggtgaacggggggcatagagccaatgacccacgcggagtaccaggacaatagccgagtaccagaccatacaagggaccagaaagacagggtcacctccgggaacaagccgccactagatggagtggggccatccagagaacactaggcgacagaagggccacaagagccaaatcaggacagcaaaatgggggaaccgcacaagtttgggcatgaaaatcacaacaatcgaatacggaaggacaacgccaagaataaactgaccacattcggtgagtgacaccgagagccaaccaagtgctgataaatcctggcatcgacggacgtgggatgttcccgaggggagagttgcgaacacaaaccccatgcgacagcaggggtcgaagatcttcccaggcacataacaactctagccagaaaaggagcagaggacaccgagcagaggggcacccacatagacgaccgcaaagcacacaagatcaagaggggagcccagagggcacatgagaaggaagaccagccagacatagaatgg

SEQ ID NO: 634174 - DNA, 545 bp, Homo sapiens
atgacttaactttacatgaaactattgtagtctgaagagacacaaattttaccagcaggttaaagaagcatggtttaaagattaaaagaagaaagatagctaataagggcttaagaaaggaaggaaccaagttatggagggtaaggcctagcagttgtccaacaccacattagcaagagaattgagggaggtttttagcctttccagggcctgcctcacctggtccactatatgcctagggctattgtgactccaggtaccctgcacccagactaaaaggaagaggttacagtgagatagaaggtacagtggctgggcgcggaggctcacgcctgtaatcctagcactttgggaggccgaggtgtgtgaatcacctgaggtcaggagtttgagaccagcctggccaacgtggcacaaccctggctctactcaaatacaaaaattatccaggcatggtggcaggtgcctgtaaataccagctatgtgggaggctgaggcaggagaatcccttgagcccagcgcgcaagaggttggcaatgagctga

SEQ ID NO: 634175 - DNA, 295 bp, Homo sapiens
ccctttttaaaaaaaaaaaaaaaccccccccaggggggggggggggtgggggtttttttacccccaacccttttttattgttacccccccgggggtaaaaatttttgggggggggccccccccgcctaaaagtgttggggggccccaaaaaccccccccggggccggggggtccccgggggccctttttccccgggggggggaaattccccaaattcccccggggttttccctcccccaggggggggggtttttaaggggccccaaaacccccttttttttttttttttttttta

SEQ ID NO: 634176 - DNA, 795 bp, Homo sapiens
  misc_feature (1)..(1): n is a, c, g, or t
ngacactcacctttttttttgtgggtgcgcacctgttggagagggccacacattttgtggcggcgtctgtctccaccttgtggtgtttttgttgtaaaaaataaggagagagagagacgagagattttttctcctggtggctgtgcgctgagatgatctactcacacggttggtcgctctctcgccccctgtgggcgccccccccccacagtagagtgtagtctcgcgcgagagatgctctcgccgcccacatctttctacacactctctctctctctatatagaaaagagtgaatattatattgccccccccccccctctctctgttttgtgatatagagaaacccccctctctctattataaaaaagagagagtgtaaaaacacctctgtgggcgctcacacaccgccaccccccacaattttcatcatgctgtctctcttgttgaacatcacacacacgaggatgttctcgtccgagaccgaccacaacgcggcgcgggcgtgtatcggtctttctgtaacaaaaccagcggctggtccccacgcataacatataataaaaagaagaggctcccccgaattatgatgtataatttatttgtgcccgcagcaggacatattaatagaaggcgttatataggaagaggccccgcgggcaccacatattgcgccagaagagacgccccgaatatctgttcttctcactttgcggggttttttttttttttttggaacccccccggaaaaaaattttttgtggggacccaaaaaaaaaggaggcggagttttggta

SEQ ID NO: 634177 - DNA, 993 bp, Homo sapiens
ttcacgtggttgtgagtcccttctgcaggtgtgtcccgtggatgtccgagcctggcagggaggctcgccggctgtggggagagaccagagttgttttcgtatagctgcgcccgtggtcgccgctatggtttgaacagcgccgatatcggtcttttgtgcgcttccacttgaccgtccttttgagggggcccttctacgatgggctccgcttggcgaggggcccccttgttgcctgtgggggcccgggggggtttttctatcccgcactggggtgctgttcgacggtgcactacgagcccccgggacggttggttcgtcatgaccaccatcgttcgttttttgggacggcccgtggtggttaaccacggtgcgtctcctatattacggtggtttttgtcgcccctctctcgccctagagaagatttgggggtttattcaaccaggtcagccccatttttgtgttttgccgtctggagcccgtgctttgtcccacgtgtctttggagagggtgccttgttttgtttcaggcgcctccgttctcctgttgttattaccagaggggtggcccccggttctgctgtcgcttggtgtttttttcaggaagtgtgacactggtggcccccccccgcgaattgtgtcccaaccttttgggtggttacccgcaccgcgggtggttcccctcccccttttgaataatttgtgtgagagccactggtgcctctccgcgtcgtgcgccaggcggttgtgcacccccaccgcactgtctcggcgtctccgctccacgcggagtgtttcctctccttctcggaagatggagcacattttggggctgtcccctgagggaggccttccccagggtgggaacaccccccgatgcccgttttttccccggtttccgcgggccttttttttttttaataccctttttttgtttttttttatacccctaacgtcccttttttttttttttccaaaaacactgtttaaaaggga

SEQ ID NO: 634178 - DNA, 361 bp, Homo sapiens
gctggtcttcatctcgccttctgcctcttagcttcatacagggcgcgaggtgcgggctcgcttgaagaagccgacttccacagcaggaggatgatcagccccagcagcagcagccctgtaaccacgggcaccagcatcagccacagatcgatttcggccggcagatcctccagcagctccgagtcaatgtccacagagaaccacgtgctcttgttctccagtgttgatggtggggatgctggtacggaggaatagggtagcccagccatttacccggactcggtcgaagtctctgtaatcctcgatgaaggtgctgtgccacactcgtgccttcacagtcacgttggtgacagacgtgggg

SEQ ID NO: 634179 - DNA, 198 bp, Homo sapiens
ctgctgcggtcgctctcgcggctacccggccaccttgtgtggcctctggtggcgcggcatccatcccctccacttcccacggcccctggctccatttgtccccccatcctcaccacagcaccatcaccccccggtgggtttttttttttttttttttttttttttttttttttttttttttttttttacacaccccct

SEQ ID NO: 634180 - DNA, 255 bp, Homo sapiens
aagttttgacccccgttcccctcccccccccgtatccccctcacggctcacgcttttctatagagaaactcccccttttctcttgaaaattctcgccactctttgaaattgaaactcttgtgaattttatttttttgtttccacaaaaagtttataaagaaaatgggaaatgggccaccacgctgaggtgaagacacacatatattttaggccctggatagaatatttttaaaatttaactgtttcgaaatatga

SEQ ID NO: 634181 - DNA, 551 bp, Homo sapiens
ggcgcagtgtgtgaatatcggtaatgttgacaggtaggtgaggatagcagaatgtgcgatgaggcgtgcacctacgattacccaataagggctagacaggctgtgggctactatggctcatactaggagcgcaggtaagtatgtaggctctggcggtattcagatacagacaccacacgactggagaagctctcgatgtttatcaagtcaatggcagatatatccatgcacatggaggaacgtgaggcatccagaatagccttagtccttggccccatccattgtcagctcctccagctaactccagctagtcctcatttcagttcccttcggtttccaataaactagggcagacggcagtatagtggcattgtcgttgatgatcttcaccagcttccggaaagtgataccgcaacaatccctgaacacgcatagagcaggtattgatgtccttatccagctaggtcaaggaggctaatggactggataatcatattgtccatccggtatcacattaactaaacttaggcacgggaatagctgtgtccaga

SEQ ID NO: 634182 - DNA, 158 bp, Homo sapiens
gtagctggagaatcgcacgatctttgaatatcagactgtcagggttagtctctgctatcattatgagttcataatacagaactaacactcatgacataagtagccttccatacaaaaaagtgttctaaaatcaagtagacacttgatgagctcaaaca

SEQ ID NO: 634183 - DNA, 117 bp, Homo sapiens
cctctgtgtcatactactactgtgtggtactgacacatttgacagctcctgtagtctccaaaagggtcttggtgaccactatatcaaggatttagtttgctgaggtaaagaccgtcg

SEQ ID NO: 634184 - DNA, 300 bp, Homo sapiens
ctgactcagaaatgttgatgatgaaggcacatctgatgaaaaggggcacactgtaataccaaattgtccctacttccaagaaagaaagcacatcttggcgagattcagactatgtttctactatgtcgcatgaagaacgatctgatagttgttttccaactctgttgatagctgtattctctgtataaccggtctctgagaatttgtctcctaatactacttcctcattggaagaccagggtgaggagggggtatctgagccccagggaacattttctggtctttcctcagagttccttg

SEQ ID NO: 634185 - DNA, 692 bp, Homo sapiens
ggggagacagcctgttgcgtgtacagataatgcggcgcgggaagtggacacaggttgggctggagctcagatctaactggactctcgctcctgctggctggacactgcggaggattcggaggaagatgtaggtttattgtggatgatgaccttgcggactttggggtggctgtcaccatctgacagccgtgacgaggaagacggataacagtgttggtgagtccatgtagtaaaccacttcgtactggggcctcgtcccagctgaagatgatcctcaaatgcagtggtcaccgtgacccccccatgggttgtgagcgcatcaaggcgcttagagctccccgctcaagatgccccaagaagtaacggctggatgcgatatcctcgaatgatgtccggaccgggctgtggccgctcagctggagtcagatgtgccctgcgagtgatcgtgcgatgaggcgcaggcgatgcgcctggggactcgtccggagttgaagtctcagtcctcgggcgagtggagacctttgttgctgacagtgatagtcctgtccgagaccttgctgcccactgttgaactctttgacgcggagacacccccttccccaatggcagcctgacgcctcgactccggagtaatgataggaaggggtcagtcagggctctccggggctacaatctggtaaagaggccctcca

SEQ ID NO: 634186 - DNA, 461 bp, Homo sapiens
taactgcggcctccacctcccagattcaagcgattgtcctgcctcagcctcccaagtagctgggagtacaggtgcgtgccaccatgcccagctaatttttctatttttagtagagatgggggttttgccatgtgggccaggctgatctcaaactcctgacctcaagcgatccgcctgcctcggcctcccaaagtgttgggattacagtcgtgagccaccgcacccggcccatccttttatatttaataaatcctactatctttgctactccattttgattatataaatcagactgcattacacaaatgcttataaaacaggttgaagaaatgcccttctgttcctagtttgttgagtgtttttatcacgaaggaacgttgtatcatgtcaaatgcgtttttgatacctactgagatgatggtgtaggttttttcccttcattttattaaaatggtatattt

SEQ ID NO: 634187 - DNA, 667 bp, Homo sapiens
cctcgacggctacagagacgccaagagcaaacccacgcacctaccctgattcccttttgtccagcagattttagttcatgaaacgactgcactgcaagaacggcatagtatggcaactctgctggccagattgtgagcttgggatcggataaggcatcccaactgtaggctatcataggattccggcatacgctaaactacataaccgtgaatgtgcaccactggtatgaacaaaacataaaacaaatgtatcaactggcccacataaaatgcagctaagacatcataaagacaagtgtaggcccaggaagcaccactctggaaaatgatgagactctaattattagcgaccggatccttgagactgtcatatgtccctacctgaaggagcctctacatacatctgatgataacattagcaatgggaataccgcctataacctgtgcacaaccgtgactctttatgctattgagaaacataaagagctcgaaaatgagccactatccctcgtgaagagcagagtgttcaggaacaccgtggcatcaaagcgcaaccagcagatggctccatcacagtcatatgccaactcggagtgagaaagctatgaaggtaagcttcctcaccatgaaggtggatctttgccgacctggaaattattgatctacg

SEQ ID NO: 634188 - DNA, 415 bp, Homo sapiens
ccaagatcaccatcggacagatcaatgcagaaaaccaacaaagacacataggacttaatccgcactacagaccacatggacctaatagatatttatagaaaatgtcatccaatggctgtagattaaacattcttctcctcagcaaatgaatgattctcaaggacagaccatatgttaggccacaaaacaagtcttaaaacattccaaaaaactgaaaccatatcaaatatcttttctgaccacaatgggatcaaaccagaaatcaataacaagaggaattttggaaactatgtaatacacgaaaattaaccaatacactcctgaatgaccagtgggtcactggaaagatgaactaaaataggaagtataagcaaacaggagatattaacagaataaaaaagaatttttaaggtac

SEQ ID NO: 634189 - DNA, 1006 bp, Homo sapiens
gcagaactctggctgacagccactatttgttccatctcctggtgcccttctgagaagtgccagctattttatgaggcaatgctgagaggagaggaacttacattctgatctctgccattctgacacctggcataaaatgatgaaaaccagcgccatctctcctcttttctgcctacgggccagttccaggcaaattacaaagacagcttaagatcacacccaagccattcctagttctctggtgagggttgtggcaggggtcatggaagggcatttgaagcaccaggtcctgtcctagtgagctttggctccacttgggtacccaggaaacctcgcaaggtagtttggcaggaatgacgtaagctgtaaggtggacttgacagatgacaagcgacacatctatacagaatgcatgcccggatctctgggcaaagccttgcagagaaactcagaagatcccaagactgagtggatctcaactgtgcacagtctttttacgttggtcttcccttgaactcaattaactgtagcctgaaaacgaagagcctttggtctctccttactgtaaagctcaccgttagcctccaactctcatcaacaaccagaaccagaagaacctgaatgtctggaaacaaaagagcagaaggcaagagcccagcttattgtgcttttcaaatacattcaacgctgcgcgttaccctgaatgtgtccacgggtgccaagaccactgtgtctggctggtgtcgtgtgtggtgcgtgtgcgtcaggcaaggacagagcgagaccacatagacgggaagaaaaaacccacgacacggatattaaacaggacaccatcgaggaattacacttccaaagcagaagggcccccctcataactggtaaggagaaaccccgcaacaaggacaccagcacaggggacaagaaaaaaaaaaagcggggagaaaagagcccaatgaaaaacacgggttaaccactacttagaacatagggtgtcacgtactcg

SEQ ID NO: 634190 - DNA, 184 bp, Homo sapiens
tcctcccagaccacacaccacataacatacacatcatctatacacaccacacaccacatcactatcacacacaacacaccatacactacaccacacacgccagacaccacatacacaacacacaccacgccatacacaccacacacacaacaccacacatcccgtgcatgccacatacaccgca

SEQ ID NO: 634191 - DNA, 765 bp, Homo sapiens
taaactagaagaggctgagtgttaatcaggcagaggctgcctgagtggttggctcctcaaactgggagcccctacctgtgcgtgtctggccgcctggagccgcatgactccccggtactggaggtgtactgtggccatctgcaggaacctcatcctcaagctggccatcctgtgggacactgtgctaccactggctgggccgcagtggtgggctgtcctgcatgtggccagtgctgggatgtgattttgttgtggccatgtgagcttgtacctgtgttcctgcgtgactggacttctgtcctcattgttgcttggacactgcgttttttggtgtgcaactgtgttgtggatgtgattagtctcctgatgaatgaacgcttgaatgatgtgatgtgctgtgaatgcctgtgatggttatggacatattgccctgtgaatttgtccttggatgcttgagtttattggtgcaggactcttgaccttggcttggggtgtgctctatctcgcccctacctcccctgcctgttgcagggtcatcagatgctgcttgctctgtcttctattgtcactgaaggaccagcccttctgggccagacttgcctggtgctgctgctgcctggcccttggcttggccttcatcacattaagcacctgtcttccctccacgcttgtcttgcttccccggccttcctggtgtgccgttgtcttcctctgctacgcccgtcctggcagtgtacgccctcgaggcagctgctgcccttccgg

SEQ ID NO: 634192 - DNA, 830 bp, Homo sapiens
ggagagactctgggggatggaatcaaggagttctcaggacgcgaaacctgggggctctagtaccccctggacatcttccttgccagtgagatggcctgtagctggaaagcgagtgagaagccgcgtgaatcggaagacgaacgctgagacgcgttaggaagagcaagaacctgccaaagagctgaggttgtcggatttccacttggggagcattgccaggtgtcgagactgacgtgattttccttggatggcatgtgggtgattaattgacctcgccgaatggatgacgggacttttgttgggcgattctctggaccgcgtgaagactcgttccatacgtccaattgttggcgccttaacggcttgccgaacgttgtttgtgctaccacaaagtgggcccaggagcctgcattcctagtccaggtgggtggccaccacaaaaggaatcgagctctgggttggccagcgagttttggccgaggagaacacgcaacttgggtcagcgacacagtgggggggccaagaacattgggtcctaattgaaggagccacaccgggagggcgttggccccttccaggaagttccatgtgctgggttcccggtacacaatcgcttgggccttccaaaccgaagtttggtacgtcacgcaaagggaaaagacccctccctggggcgccgtcgacgatggaacccctgtgttcccccgtttacctgttggacaggacacgcgggacagtacttggggtgaccagcccacactggacgttcccgcgaccgctgagctgccccgaacactgatgtgtcttggggacgggcttcccctttccca

SEQ ID NO: 634193 - DNA, 273 bp, Homo sapiens
agctgggattacaggttcatgccaccaggcccggctaatttttatattgttagtttagatggggtttccccacattggccaggatggtcttgagctcttgacctcatgatccgcctgcctcagcctcccgaagagcatgagcccccgcgcccgggcagtttttttttgtttttttttttaaagctctatggccagcttaattaaaactgatattcaagctatatgtgtacgtgtgtgtgtgtttaaggcctttctgctattgcacttggggcg

SEQ ID NO: 634194 - DNA, 736 bp, Homo sapiens
tgtggatggctcatgccggtgagcccagcacgttgggaggacaaggcaggtgggtcactgaggttgaagagatcaacgagcattcctggtcatatggtgaataccccgtctctactaataaaatacaaaaattagctgggtggtggtggtgggtgcctggtagtcgccagactagctctgggcacggttgaggcacggaggagggtgccttgagccctgggaggcggagagttgcaggtgaggcctgagatcagcaccagtgcactccacgcctggcaaagcaggagcgtagactccggtctgtaaagaaacatagaaagaatgacaaaaaaaagaggggaaccatagtggaggcaggacggggtcatacacaggagggtacatccgggggacgccaaaggcaaagtggagtcgtgaggagactagccggcatgccggagggaagaaggctgagagagacgacagggcacggagaccgaggaaagggcggagggtgacggtagaaccagggccgactgcgtgggtgtcaagcggactcccgtaagaaggaaagcagagagtcgggcgcagtcccgctggcacacacaagcagatctttgggggacgaagctaaaaaggccgaccaacagaagcaaccccttgcgtgggcccaaaagtagcgcgcgcaatgcaattggaaacaggagggatccacaaagcagaacttactgccagagcaaatcagagagcgcacacg

SEQ ID NO: 634195 - DNA, 89 bp, Homo sapiens
gggcggttatggacacctcttaaagctggtcaaatcatattttggggtggaatggcctgataagttaataaatttttttaaactgccca

SEQ ID NO: 634196 - DNA, 118 bp, Homo sapiens
ctgtttcttatttttttcatgaggaaatgtcttaaacttgggaagagtcataattctgggatgtttccaatgttgtcagctttaaacttctatagacacagggccttttctctgtgaa

SEQ ID NO: 634197 - DNA, 345 bp, Homo sapiens
  misc_feature (8)..(8): n is a, c, g, or t
  misc_feature (101)..(102): n is a, c, g, or t
gaaagctnagcacaaaagcgcgcaggctcagacactttcattttgctgactttgatgcctattaaataactttcatgcagtcacactggggtgattttggnnagtgaaatcatgccggggcaacgggtgtcacgcctgtaatcctagcactttgggaggccgaggtgggtggatcgcttgaggacaggagttcgtgatgagcctggccagcatggcgaaaccctgtctctactagaggtgcaaaggtgggcttggcgtggtggctcatgcctgtagtcccagctgcttgcgaagctggggcaggagagtcacttgagccagggaggcggaggttgcagtgggccg

SEQ ID NO: 634198 - DNA, 1123 bp, Homo sapiens
ggtcctcctgggagtctcggatgggaccggctgtgcagacgccatggtgttggtgctggtcttcctctgccatgattcgtgctggtgtcccccatgtgtccttggccagatgcagcttgaaaaggcgaaggtccctggacccatttttcattatgattaccataccctgaggatcgagcgactggtgtacagctgtgcggtccgtcttctcggatggcgtgaatcctcccttatccctaagatccgcaagggtgctaatgtgtcagttgcattactcaagtaagctctcgcaggggcccgcgaagggagatgaggctgccgccagtgtggaaggaacctcatcaatctcgtacaagtgccaataatgagcccctagaagatgctagaggaacttgaatgtgcgagaccaatcgaagttggcacaggacgtctggagagcgtgtaatgcggcgtgtttgaacgcttttggcagtgcctaaaatgtccgatatgctttatcgagaaatccgaggacaccgtgtcagtcaatccaaggcccttgtctctccccatagtccgtaacatctcaaagatacctttgctgttgtccgcacaaaggcataatggcccgcatcataaacgagtccatattcttttacaacccgtgagtgattgcaccttataaaattttggtcttactcctaaatggtagacttggtatttcctggccacaccatcccgggaatggtggtgtggtggtgatggaggggaggtagtcccggagtggtgctgtgtaagacttacggcgtgttacaggcgagaggttcgattgctcgttcgttaacgacgtacccatgggccagcgttctactcctcattgtagccatttcttagtcgccatggggttccttagtgctttaccgaacgaagaagtctaggctatattaaagtacgcaaaggccaggttttggcctacgggctacttccacctttggtaggcataggtacttaccgggggccttataccgccatttcatgctttttgcggccgcatattacgcgcttaatattacccacccaggcccctgcccgcgggggttttaagcgagcacgagtgccccgggcaacaccctgtttggcaaaa

SEQ ID NO: 634199 - DNA, 283 bp, Homo sapiens
gattataggagagtctcattttctaattttgcacttacgtattactttttaaacaaaatgtgtgcttttttttcaaaatcacagaacatattttaaaataaactagtgatgatggaatcacaacagtgaaaatttaagagatgaatttaaagttcaaatcaaaactgattttatgatcttaaattctttaaacacaaaactagaaagagtaaaccttctcagcatattccatataattgataccactttagaactaattttaagacaaggaaactgaacattg

SEQ ID NO: 634200 - DNA, 573 bp, Homo sapiens
  misc_feature (271)..(271): n is a, c, g, or t
  misc_feature (277)..(277): n is a, c, g, or t
  misc_feature (462)..(462): n is a, c, g, or t
catgttgaaagtcactggaaggtgtgccctatgctgcagcgatgcagttccctcctgaccatgaccaggcaggtgtttgacctggctctgtgcagatccattttgatcagaatgttctaaattttgactatgttactttttattatgagttaatatagtttagcagtaaaaaaaaagaaccacacctaaaatagaccgctgaggagaccatagagcggatgctttcatgcaccctttactgcactttctgaccaggagctactttgagttnggtgtnactaggatcagggtcagtctttggcttatcaataaattttaatctctgttaatcttacctgctttaaaaaaaagttcttgggtgttggtatcttaattatttccctaggtttgcaaaaactgttctgaaataagagggataccaagggattattttcaaatgttaactggcacttgaaaaaacgntgtatgtattagtgtgctagattatttagcagaatattcacaagtttctgttgaccttgttgattgagcatgactactaaatattatgtaataaaaagcctttgtcataac

SEQ ID NO: 634201 - DNA, 316 bp, Homo sapiens
ggtacctggagagagacatgcttgtcctctggattggaaagatattactctcgggaatcttctctgtcagcccgtagcctctgaaggcatgtaatctatcatattaggtcaattcacatttttgtcagtcctctgcttgtatctctgctaatactggtcgcatgactgagcagtggtgctctgtcgtgtactgggtatcactctaaagtctgcctgagtggttacagcgatgagctcaggtcacagtttctccaagtcatcaacctggaagttccctgagggttttctcataaatgagggctgcacattgcctgtt

SEQ ID NO: 634202 - DNA, 645 bp, Homo sapiens
  misc_feature (566)..(566): n is a, c, g, or t
gcatgttagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcagccttactaactgctgcctggaacttgatgacgaaggaaaggttatcaaagaaataactgctaaaatccaaaagttagctcacatcccagttcagacttggaaaggatagtctccagattcccttttcagaggttggttcttatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagaaatgaagatagtgatgctttctcttaaactttactttataaaagcatcaaaggggggaatgaagcangaaatataaagggaaaacaagtaaaggtattatctgcaagccaagcaggggcttcgcaagagtgggcttcaggagcagg

SEQ ID NO: 634203 - DNA, 718 bp, Homo sapiens
gccgagcacaggtggcggagcctggctatgtgcctcggcctggccctgggcgcgctgccgccgaactgatcaccagcctacatcccaggactgaagctacatacatggcatgaccaggaccctgtcggtgcatcagtcaccccatccatgctaaatggtgtgctctcagagcgacctgggtggctgtgggtgtacctctcatcttcatgacgagctccctgcgactgtggtgaagggttctgcctgcgagctctccgctggccctcctagtggccatgtcgatgctgatgccttcctccagacgtgatggaagcctctcgctataccatcattggacagtgcctcctggtattgcatagtggtgtcctggagcctctgtacctgtgttccaaatggtgcccgcgtgtgcgcacctggctttcaagaccctacctcgctatcatcgtggccaaccatgcgatgccgttctgatgtagagatcggatgcaggctacgagggtcacctaggagaccctctgtgcagcggcctccccgacacgcctaggtgaatgaactgatgccagactagccgcacaatctacattcatctgtcgcataactgacgcagaacgttgaaaggtcgctctcctgttgtggtctgacgccctggatctctgacctctacgcgcccatggtggctggacgcgctggcccgcctgggcaccgttgactgtgatca

SEQ ID NO: 634204 - DNA, 1260 bp, Homo sapiens
gggcagccaaggtgtgttggtcgcgaagctggagtgtcctctggtggagcctgcatcttgtctcgtctgcctctgctattacatatggttgtactttcgggcgtggtggcagtaaccctgacaccgtgattgcagcttgtccagccagcagctgcacacagcagcacacagtcagcacaggcatgtgccattgtaatcgttggtaagcatcatccttgcatgtcatcatgtgtaattcaacaattcgaacacagcagcatgggtttgtccacatactgtcccactgcagcacacattatcaaactcagggcacacagggtggaggcaacaagtaccttgcacacatcacagattatattgcaaagcacagttgtgtctcgagcgcctgttgccgtatgtacccaaggcaagccccgcagacagaccatctggacaccttgcaggcctttctactccagtaccatgcacagtaaaccagggatcaatactagttacaatcacgacgtgtggcatacaggaattgttatatatcaatacagaccaagaccacaggggacggttaaaaccacacttggtatgggagtacttgatgcgagaccttgatactagcggtacataccttggagcgattagaacataaggtagccaaggaagagacatgtcgtgcatgatgttcatcaaggtaacgaaaagtactcacaaggcaagcagccgaagggacacagatatcgtgtggacaatagcagccaattcactcgtattggcgactccgttggatggactccgacagtgaaacaaaccgtgccaggcacctagagcacgctacaagtagcgaacccctaccttcatacacgcacaccgccgattcgacaacagacccatacaatttccgttatcagagcctaccacaccaagagcgccaagccatggggaggcaaccagcgcactagggtagagcgaggacaccacaaggaacgccaccaagagcacaccgcaaacgacaagcagcgcacatcggaggaccatgcgaggacaacagggacggacacaggcgtggacaaaacaggagagcaccagagcgacgacactcccccactccacgctggcactaccaagcgtagcagagccacaaaagacaaacacgagcacgccacatggggagccaaaacgacaagaaagagacccaggacagcgagaccgaccaactccaagtacagactaggagcaaaacgaaacaccacaacggaaccaggcagcaat

SEQ ID NO: 634205 - DNA, 509 bp, Homo sapiens
gggattacaggcgtgagccactgcacccggccttttttcctctgtcttaaccaaatgtaatatccgtaggatctgatctaaagcataagttaattaggtgggtttttctgtagaccagacattgtaataaaaccaaaatcagttttgttttggtttaatgggtcctggttggaaaaaaactgaatatttcacatgcctggtttttcaacgtcttttcttggctacattccatctttggcaaaatgttggaaaaccatggaagtgaaataattagccatatggcaaatattggttttgttgaaccaagtcagacctttggtcagtttattctagtttatgcaaacagtgtggccaactaccaaggacgttcatgggctgtgcatgaacatgtccaactgtacacacagagtatttgtctgcttaggtcctacccacgttatctcaggtctctttgactacctatatctaagggtactgtttcaaacacttaaattaaattgtaatttttg

SEQ ID NO: 634206 - DNA, 514 bp, Homo sapiens
  misc_feature (3)..(3): n is a, c, g, or t
  misc_feature (5)..(6): n is a, c, g, or t
  misc_feature (33)..(35): n is a, c, g, or t
  misc_feature (37)..(37): n is a, c, g, or t
  misc_feature (45)..(45): n is a, c, g, or t
  misc_feature (53)..(53): n is a, c, g, or t
  misc_feature (61)..(61): n is a, c, g, or t
  misc_feature (66)..(66): n is a, c, g, or t
  misc_feature (72)..(72): n is a, c, g, or t
  misc_feature (116)..(116): n is a, c, g, or t
  misc_feature (124)..(124): n is a, c, g, or t
  misc_feature (132)..(132): n is a, c, g, or t
  misc_feature (143)..(144): n is a, c, g, or t
  misc_feature (146)..(146): n is a, c, g, or t
  misc_feature (148)..(149): n is a, c, g, or t
  misc_feature (154)..(155): n is a, c, g, or t
  misc_feature (157)..(157): n is a, c, g, or t
  misc_feature (167)..(169): n is a, c, g, or t
  misc_feature (178)..(179): n is a, c, g, or t
  misc_feature (182)..(183): n is a, c, g, or t
  misc_feature (186)..(188): n is a, c, g, or t
  misc_feature (191)..(192): n is a, c, g, or t
  misc_feature (197)..(197): n is a, c, g, or t
  misc_feature (200)..(202): n is a, c, g, or t
  misc_feature (208)..(208): n is a, c, g, or t
  misc_feature (221)..(223): n is a, c, g, or t
  misc_feature (252)..(252): n is a, c, g, or t
  misc_feature (281)..(281): n is a, c, g, or t
  misc_feature (307)..(311): n is a, c, g, or t
  misc_feature (314)..(314): n is a, c, g, or t
  misc_feature (340)..(341): n is a, c, g, or t
  misc_feature (355)..(356): n is a, c, g, or t
  misc_feature (358)..(358): n is a, c, g, or t
  misc_feature (368)..(370): n is a, c, g, or t
  misc_feature (389)..(389): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (400)..(400): n is a, c, g, or t
  misc_feature (402)..(402): n is a, c, g, or t
  misc_feature (404)..(405): n is a, c, g, or t
  misc_feature (410)..(412): n is a, c, g, or t
  misc_feature (419)..(421): n is a, c, g, or t
  misc_feature (437)..(437): n is a, c, g, or t
  misc_feature (440)..(440): n is a, c, g, or t
  misc_feature (447)..(447): n is a, c, g, or t
  misc_feature (464)..(464): n is a, c, g, or t
tcntnnccccccccccccccccccccccccccnnncncccccccncccccccnggcccccnccccnggcacngggaacccccggcccccccccccccccccccgggggaccaaaancccccaancccccccngggggggggcnnancnnggggnncngggggccccnnngcccccccnnccnnaannnacnnaaaanaannnccttanggcccaaaccaannnccccccccccccccccccccccccccccnccccgccccccccccccccgggggggccngggggagggccgggcccccccccccnnnnngangggggggggctcttctctcggggggnnaggggcttcccccnncncccccccccnnntctctccctctccccccancantntntntntncnncaaannncaacccnnnccccccgcccccccgngancctctcngggggcccccccccccncccccccccgcccccccccccccccccctcttcccccccccaacccaccc

SEQ ID NO: 634207 - DNA, 321 bp, Homo sapiens
gcttaaatctaaccccaaatagcaacaattcaaactcctctctttctgagatcttctattataacaaacctccagggctcattcaaattcctgtataaagtaggattttgtttcatcaaatcttttggaaaacatgggcttgggtgccagtagctcatgtctgttaattcccagcacttttgggtaggccgatggagagcagatcaccttattcaacactgttgaataggagttggtcagagagggcatcctgtcttgttcccgttttcaacgggcatgcttccagtttttgcccattcagtattgatactggctgtggtt

SEQ ID NO: 634208 - DNA, 168 bp, Homo sapiens
  misc_feature (156)..(156): n is a, c, g, or t
atagcctcgtccactgccttatgctttggactgtccacagccttgacaggaactccaccgccgtcttctcaggcatctggattttcgcttgcagcaccaggttcctcaagagagtgtgcgcaaggatctcttggcacttgtgaaagggaccatttntctccatgccgg

SEQ ID NO: 634209 - DNA, 106 bp, Homo sapiens
  misc_feature (24)..(24): n is a, c, g, or t
  misc_feature (29)..(30): n is a, c, g, or t
  misc_feature (40)..(42): n is a, c, g, or t
  misc_feature (44)..(44): n is a, c, g, or t
  misc_feature (47)..(48): n is a, c, g, or t
  misc_feature (50)..(50): n is a, c, g, or t
  misc_feature (52)..(52): n is a, c, g, or t
  misc_feature (54)..(54): n is a, c, g, or t
  misc_feature (56)..(57): n is a, c, g, or t
  misc_feature (60)..(61): n is a, c, g, or t
ccgcttgtgggagaagtggtggtngctcnngcggcccgcnnngncgnngngncncnncannctcgcccggcgctccagtagcaggacccggtctcgggaccagccg

SEQ ID NO: 634210 - DNA, 661 bp, Homo sapiens
agacattgaatgtgttgtatgtaatggaacacaagtggaaagagggaaatcctcatccttcccagtgggaagttagtaagaatataaaacagaaaaattaagaagtagcaatataaacatattactaagataaataaaggcaaatatcaaaagaatcaactaaaagagctaaaagtggtttccttcggagagcaggcaataggagtaaaggtgaggaactggagaactagctgagtgcagaagcgtatgcctgtaatccagcactgaggctgaggcaggaggatctcttgagcctagaagtttgagaccagcatgggcaacatggcagaaacccttctctactaaacacacaaaaattagttgggcatggtggcgtgcacctgtaatcccagctactcgggaggctgagacaggagaatcacttgaacctcggaggtggaagttgcagtgagcctagatcgcgccactgcagtcccgcctgggcaacagagtgggactctgtctcaaaaaaaaagaaaaaaaaataaaattctgtgtatgcaagttgaagtagagactgtgctttttttaccaactagtggtgtgtatatacaataaggcggtggatgaatcttattccaagatagaaggccagaaaatcgacttaaaagctttacaacag

SEQ ID NO: 634211 - DNA, 111 bp, Homo sapiens
  misc_feature (2)..(2): n is a, c, g, or t
anaaatttaaaaattaactgggcatggtggctgaggtggaagaatggaagaatcacttgagcccaggagtttgaggctgcagtgagctatgattgcaccactgtactcctg

SEQ ID NO: 634212 - DNA, 931 bp, Homo sapiens
aacactacagggaggaattcacatgctttagtatgtactacttttgctgatgcttttgaaaatgtttatgccacagaatttgctaatatattgtaatcacattccttaggaggactgtggtaattggttttatgtattgatggtttttttttctctgtggggacaaattgtctgacacgcgggagctacagggagctcgtattctcttgtgttcgtgttgccctcgtgcccatcaagtagagtcggcccctcccaggacaagcacgaggtctcaggtcgcccctgtggggggtagagaggaaggacttccccagacgaggggcttcctctagagtctcactggtggggaggagaggactggctcctgatggaagttaccccggtgctacgtcacccagagcacaggagctgcctatgtacagatgaggaaatctgcctaatgtacataacccagtcgaacagcgccgcacagatacagggtagactgtgctaaagtcacgaagaccactagggtagatgaaaactacgctagtagaccacacctcacggctctgtacactacactactactagcccgcataccgccaagaatagccccaaggtcaccccgggaaacggagctgagcgtaggaagaaggccaatctaccatagagtacgccccacaacggagcagcaatgattccacgtgacaattcgctgagaaacattcccatacgcccacgtgacacgcccgtacggcggttcatactgggcaatatgaggaccgtcaccaaaggcaggcagacaccgatactgacgaatcggagacatggcgctacagacacaaatacgggcatagacagatcataatagcgctgcgagcccaatgaagaaggtcaccctaaggccaaccaggggacaaggcaagagcgagcaagaaaatagatgtga

SEQ ID NO: 634213 - DNA, 418 bp, Homo sapiens
gttacacatacgtgaacattatatcgaacagatctttgcccattactgctagaatagggcacagctctaatgccctgtcagtaataatgcacattggagccctaagaaatgaacagatactcctgcgaggctcgactcatgagtttctatactggtaaaccctgtacgagctgctagctgtacctatataagaatgacctctattttcaaggagaggtagcggaatctagatcggttgtatgagcctcaccacattaacgtacatgagtgtcatacaggcactataataaagatgcactgcactgcgaatatatgaatgcgagacaagacgcctcggcacaccaggagtgagagagccaccatgcagtggagagctgtatgcatctcataccataagtactgtgtgtgctcttctctg

SEQ ID NO: 634214 - DNA, 578 bp, Homo sapiens
  misc_feature (578)..(578): n is a, c, g, or t
aaaaaaaaaagttttaaaattttttttttgggggggcaaaaaaaaaatttctaaaatttttgcaaatcaacaaggggatttttccccctccccttaaaggactggaaccccttttgggaaaccaacttaaaaaaatttgttgcaccctttttaaaaaaaaaaggggggttttaaatcccttgggggaaaaaaaaattttttgggtgtttttgggaatttccccccaaaatggcccccttaatttaacaaaaggcccaaaaagctttggacggaaagggcccccttttcaaaaaaaatgcccaccctccctccggggggattttcccaataaaaaaaaaaggggtaaaagcccctttgtgggtcccttaatattaaaaaaggcgtttttggcacacaccctctagaagagtttctctacttttaaaaaaaacccacaggcggggtttaaaaattaaaagaacccgccgcccctcttgtgttataaaaacctttaaaattctttgcgcccccgggtcaaaaaaaagaaagagtgtattttccccccgcccatatagcgcatatccgggacccaacaaacn

SEQ ID NO: 634215 - DNA, 192 bp, Homo sapiens
  misc_feature (40)..(40): n is a, c, g, or t
  misc_feature (66)..(66): n is a, c, g, or t
  misc_feature (92)..(92): n is a, c, g, or t
  misc_feature (116)..(116): n is a, c, g, or t
catgaattcgggccttctgccggcttctgggtaaccctancgggcgcgaatcgcacctggggctcnaaccagggctgccagggtccatggancccagggcaggggctgatgggaanacacttacatccgtgggggacccaggtcccgcttctttgcggcgcggttttttttttctctgccccaggtttctca

SEQ ID NO: 634216 - DNA, 1037 bp, Homo sapiens
ctaggctccagcggaagagacgacacatcagaccaagggatcccaaccctgggaccaggacccttcagttgcacgcgacatgaagtcctagggcgatgtaatttcaaagccgaattcatcctcaggaaaacccttgaagactacaggctttgcacgaaaactgcaggtggaaacgtacttatctcgtaagaccacgccttcaatgcaggccccaaacagcacaatgcaggagagatagatgaaagacgtcgtcactatggccaggatggtccccgtggggatggacttctgtgcatccttgaggtccccggaccggtttgaacccgccatgataccggtcacggaggggaagtagatgccaaccagcagggtgaaggaggccgcgatgtcggtgagcacgtagggcagtgcgctggcacggctctcctctgccacgggcaccgagggcacacctttcttctccacaaacgcccccgcgtgcgcgtacgtactccacaggttctccaggaagacaccactggccgcgcccgggatgccctggatttcggtgacgttgttctggatgaagtactcgtcacaggcggcgctgggctgggagccgttgcagaagaggccccagagcgcggaggtggctgagttgttgtggatgccgtaggccttgacgcaggcatcgaagctgcgccgtgacagcgtgcggttccccaggaggcagaccgggatgtccggggggtcgaaggcagacttgatgacgccggcatagatggccaggatggacagcacgacgcaggccaggaagaccagcgccagcttgttgacatacttgacgcccacgaagaccaccagggccatgagcacgagcgtgcacgtgccgtacacacgcatgttgtgcagcatggcggccgccttgccacctgcagcctacgcctccaagatggccgcacccggggagatgtacgtcagaaaaatctcgatggtccccgaaatatacatggcccctgccaacgtcgggcccattcgaaacaatttccgggggtccc

SEQ ID NO: 634217 - DNA, 995 bp, Homo sapiens
acccccgtctacaaaaaatacagacattaaccgggcgtggtaccgtgtgcctggggtcccggctgcccccctctacaaaaaatacagatattagccgggcgtggtactgggtgcctggggtcccagctgcttgggagactcagttgggaggaatatttgtgtctaggagttgaggctgcagtgagccgtgatcacaccactgccctccagcctgggtgacagagcaagaccttgcctcaaaaaagagagggagagaaagaaagagaaggagaagcctggagcagcgggctcaccggtcacggaggggaagtagatgccaaccagcagggtgaaggaggccgcgatgtcggtgagcacgtagggcagtgcgctggcacggctctcctctgccacgggcaccgagggcacacctttcttctccacaaacgcccccgcgtgcgcgtacgtactccacaggttctccaggaagacaccactggccgcgcccgggatgccctggatttcggtgacgttgttctggatgaagtactcgtcacaggcggcgctgggctgggagccgttgcagaagaggccccagagcgcggaggtggctgagttgttgtggatgccgtaggccttgacgcaggcatcgaagctgcgccgtgacagcgtgcggttccccaggaggcagaccgggatgtccggggggtcgaaggcagacttgatgacgccggcatagatggccaggatggacagcacgacgcaggccaggaagaccagcgccagcttgttgacatacttgacgcccacgaagaccaccagggccatgagcacgagcgtgcacgtgccgtacacacgcatgttgtgcagcatggcggccgccttgccacctgcagcctacgcctccaagatggccgcacccggggagatgtacgtcagaaaaatctcgatggtccccgaaatatacatggcccctgccaacgtcgggcccattcgaaacaatttccgggggtccc

SEQ ID NO: 634218 - DNA, 999 bp, Homo sapiens
atgagccgtacattaaagtccgcatctgctttgttgctggagccacgttactaatagcaggtaccccaggcaatcattggctctgtgtggtcatgctcgttcgatgtgtatgtggaacgttctactttggtatttgcacaatatcatttcttggtatccaatataacatttggttggtcctgtaggctcggaatggctagggtctctgggttgcttatttaggctggagctgttctcacctgctgcttatcatctttttacacagatgttaggacctcgagcagacaactatccttcattccttgcaggcacaagcctattcagccgcgggtgtattcccatggacaagtcatactcagcccctcgcacagagacggccaaaatgtatgctgtagacacaagggtgtaaaatgcacgtatacagaggtgtgtaagcatatgcatttaatcaatcagtatggttacattgctaacaatcgtaagtcaatcccaggcaacagttatttagacattcatcttgacttagacattcattgctagcgttaatcaaaatgtatgattctcctatactatgtctccctattacttcttatattagccgatcatactctctgctaaccttccacgcctttattggcaacagcacacttacccatatcatttcacagcataagtctggctcacagcaatagtctcgaccacgtatctcgctcacgcgacttactcatatagacgactccgagcactcctcgaccctacgtacatcatcaaaactggtcactggataccttaaagcaggaatacggtcatcatcgaacacaagagctgacacggcaatccttaaaacttttgtgaaggcactatgcacttcaacgctaaccctatcgactttccctaggctgtcgggctaaccgcgatatcgaaccttacataccacgtgggtgcaagtcatctggataagtgttcgaagaacgattattctagtaaactacacgatag

SEQ ID NO: 634219 - DNA, 509 bp, Homo sapiens
  misc_feature (52)..(52): n is a, c, g, or t
  misc_feature (67)..(67): n is a, c, g, or t
  misc_feature (130)..(130): n is a, c, g, or t
  misc_feature (133)..(134): n is a, c, g, or t
  misc_feature (163)..(163): n is a, c, g, or t
  misc_feature (170)..(170): n is a, c, g, or t
  misc_feature (182)..(182): n is a, c, g, or t
  misc_feature (197)..(197): n is a, c, g, or t
  misc_feature (224)..(224): n is a, c, g, or t
  misc_feature (228)..(229): n is a, c, g, or t
  misc_feature (236)..(236): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (267)..(267): n is a, c, g, or t
  misc_feature (280)..(280): n is a, c, g, or t
  misc_feature (288)..(288): n is a, c, g, or t
  misc_feature (311)..(311): n is a, c, g, or t
  misc_feature (320)..(320): n is a, c, g, or t
  misc_feature (325)..(325): n is a, c, g, or t
  misc_feature (335)..(335): n is a, c, g, or t
  misc_feature (342)..(342): n is a, c, g, or t
  misc_feature (344)..(345): n is a, c, g, or t
  misc_feature (348)..(348): n is a, c, g, or t
  misc_feature (383)..(383): n is a, c, g, or t
  misc_feature (390)..(390): n is a, c, g, or t
  misc_feature (392)..(392): n is a, c, g, or t
  misc_feature (446)..(446): n is a, c, g, or t
  misc_feature (450)..(450): n is a, c, g, or t
  misc_feature (454)..(454): n is a, c, g, or t
  misc_feature (457)..(457): n is a, c, g, or t
  misc_feature (468)..(468): n is a, c, g, or t
  misc_feature (471)..(471): n is a, c, g, or t
  misc_feature (476)..(476): n is a, c, g, or t
  misc_feature (483)..(483): n is a, c, g, or t
ttaatttaaaaaatttgaatcaaatagatcattatttaggtttaaactctgngaatatatatatganattgaatttaattaatatctgagtaatctcaattaccattttctaggaaggatagagtgtaanaannaaacatttcatgtagaaatattaactttnaaaagtnataataccaganttttagagtgaaggngtatttaaaatgtgtctttctttgggngggnntcatttngttctttactaacaataattnggnaatnggnaatttaatatctngggaatangaaaatattatggtatagattancttctaggnggggngagggggggngggagtncnnggnggttaaaaaaacatttaactttttaaagataatangcatatngnatattatttgaacataatagttaagaaaattatctttgggcttttttgaatatngggnattngcnaaataacattngcncttangcatganataaattgtaactagatttaatgggc

SEQ ID NO: 634220 - DNA, 385 bp, Homo sapiens
gatacgactcgagctcggtaccgctactgacgagttgtcatagtcacgatgtggctggagtgtggtgcggcgttgtaggctgtcgtgccccttggagcctgaacggtatggggatggggtcgtagattctccaagaagaactgaggttgtggagcgggcaggtaggactattgttcccgttgcgtcttggctgctgtgggatgctgttgattcctcactacggcctgaggttgtggacgctgtcagtgacacgtgtgttgttgcagttgacgcccgggctgctgtggtacgctggtacggttcttcaacaagggcagactgtggtgctaggacgctgacagatattgtgtgtgttgtgctgctattgaaaccttctaaaactagg

SEQ ID NO: 634221 - DNA, 1014 bp, Homo sapiens
caccgggggcttcatccttccacggaggagaagagggactccagaatggctgaggagaagaagctgaagcttagccaacactgtgctgccctcggcagctccatgaaggtggtggctgaatccatgggcatcgcccagattcaggaggagcacctgccagactgctaacggatgaggcatgccttgcaacgcttcatgcacactggcgaagcggcacaagctcacccaccagtgacacttgacctgcgcctcgaacgccctaacagaactgtcgagccactctactggctctccacgcccaggcacgttcattccttctccgccttccgccttctgcgtgcggggcccggcgagctttaccttcgtactgagcgcacgaaccggacggcttgactcctgagccgcacatcactccaataccgcctctggcccccggcgtgccccctggcacgctctgccctcacaagcctcacttgcgctgacccatcgcagcggctgccacgcccacgctatcccccgagaaacccgccccccagcctcccacaagagcaaaccagacacccgcctcgacaccccaccacgaaacacccccctgaaacgctccagcccaaagccccaggcccacgcgacggcccacggacccggacccccctgcaacccggccacacccggctcacagcgggcccacgcaacagcccgcacgcgccaccgcggacacccacgcacagcaaagcgcggcccagcgcccacttgccatagagcacgcggcggcccccccattagccgcacacgttgcaacacaccccccaggtacacgaatccccccagcaacattggtccgtcgctcggacggccaaccccgagcctcgatacgttaacgccacggcaaccacccaaccccgcacagcgcccctgccgctcgcggccctccctcgcggaacggcccaacccccggggcccggcaaaccccccctgcccaccccgccctacagccaacgggcaccccctggcacc

SEQ ID NO: 634222 - DNA, 184 bp, Homo sapiens
taacatccttgcacaagccttgcagaaaccatgagccaattaaatttcttttatttataaattatccagcctcagatatttctttatagcaatgcaagaatggcctaatacagggactcagagggatgggagggtaggagaagggtggatgataggaggttgcttcgtaggtactctgtatggg

SEQ ID NO: 634223 - DNA, 952 bp, Homo sapiens
  misc_feature (1)..(1): n is a, c, g, or t
ncgccgcctgttggttggccccctcctatagttgagcacccccgcggggtcgcagtatactaccttctacggggtttttttgctttgttcccccgggggggcggtgtccccattctgtcccacaacgggggccactggtttttgtcacatcatgggccctattttttggggggccaaccactcattaagacaaccaccactggttgtgtggccacgcgcacgaaacagcgcgcggttggggatctcgctcgctccgcggtaatctatcccgcggggaattttttgttggtgaccacaacccgcgggtttggctgctatgacacacactctcttcatggaggggcctcctcgccggggctgtaattttttggtggcacgttgctgtctccctcagtaggagacaccttagaaacccagtttgtttgttccaccgccggaccctcctctttggggggcgcccccccgcgcgcacgttttagatagctccgtatgagacgacgacctgctggtaaacagccgcctgccccccctctacttggccgcccgagtgagtatttttcctaatttgtggcgcaacaccacagtttgttgtgcgagaggcgtcgcgtcgtcccaaaactagtggggggcgtgtcttgctcccctattctagttatctcgtactctctactctgctttgccagtgtgtctccccactcctgcttcgccactattctcccatcccccacgccatttattatatttttcgcccagctcgtcaggcgccgtcagccttgtttgtggctctcttgccccccaggcgctcctccttttttaccctgattcggggggaccccccgtagtccccttttccccccttggccaaatacaccccttttttttttctccccccattcttttttttataccccctttttcccttttttaacccaaaaattccaatgggccctta

SEQ ID NO: 634224 - DNA, 127 bp, Homo sapiens
  misc_feature (91)..(91): n is a, c, g, or t
agtatttagaggatccaccatgatcgcagaagcgagtggcgagaaagtccaactattgggatgacaagttacttctcgtggtgggagcccncagccctgtcctgggataccgatgctcgaatttctg

SEQ ID NO: 634225 - DNA, 359 bp, Homo sapiens
tcagacacatagaggatccccattatatctgggacgtgcttatgcgggacggcatatattgatgcgcccacatgagccacccacaatgtggaatggcatgatgatgtcgatactgtaatcatcactcaaagcaaattaaaatacaaagtttatctgcaacggctttgcagtgacatgatgccttcataaattaaggaaactggccacccgtcacagcggctcacttcagggatcttcacgaaatcttcccccttcttgatggaggccttcagctcggggatggcatccgagatcatcttctcctcaaaagaggagactttgccgatgcccaggttcttctcgatgccctttttcccaag

SEQ ID NO: 634226 - DNA, 644 bp, Homo sapiens
  misc_feature (24)..(24): n is a, c, g, or t
  misc_feature (27)..(27): n is a, c, g, or t
  misc_feature (88)..(88): n is a, c, g, or t
  misc_feature (94)..(94): n is a, c, g, or t
  misc_feature (253)..(253): n is a, c, g, or t
  misc_feature (275)..(275): n is a, c, g, or t
  misc_feature (310)..(310): n is a, c, g, or t
  misc_feature (493)..(493): n is a, c, g, or t
  misc_feature (497)..(497): n is a, c, g, or t
  misc_feature (573)..(573): n is a, c, g, or t
  misc_feature (613)..(613): n is a, c, g, or t
gtgaccctggagcccaacaagganctncggccaaggggacacggtgaccatcacgtgctccagctaccggggctaccctgaggctgangtgttntggcaggatgggcaagggtgtgcccctgactggcaaccgtgaccacgtctcagatggccaaccgagcagggcttgtttgatgtgcacaagcgtcctgcgggtggtgctgggtgccgaatggcacctacagctgcctggtgcgcaaccccgtgcttgcancaggatgcgcacggctcttgtnaccatcacagggcaagcctatgacattccccccanaggcccttgtgggtgaccgtggggcttgtctgtctgtctcattgcacttgcttggtggccctggctttccgttgtgcttggaagaaagatcaaacaagagcttgtgaggagggaagaatgcaaggagctgaaggaccaaggatgggggaaggggaagaaaggcttcaagacagcccttgcaancctnttgaaaacaacttttgacaagcaaaagaaagatgatgggacaaaagaaaataagcctggaccattgaaggaccaanggaagcttgctacccctttccttacaagctactacccttntgggcttgcaatgggggcttggacttgtgga

SEQ ID NO: 634227 - DNA, 345 bp, Homo sapiens
ggacctggatggccgagtatgcgcacgtgggctttacagccttttactacatatttaagaatcctgtgtacggtgagatgacatcttggggcttggttaccattcacctccttccctggtgactcttcttcgtgaacaggcaccatccccatcacccgatggccatggcgcacgtgccttgtccttttctccccgtcctgttgactccacaccacacatgctgccagcccgtgctctttaaagtgtcgattctggtggaagccaccctgtgtggcctcaaaagcccttccctagcatgggatgtttacaatcactcacaggtttccctcaagcttctctgagcta

SEQ ID NO: 634228 - DNA, 1000 bp, Homo sapiens
cacggactcctggtctgagcccaataaagactgttaattcctcaaaaaaaaaaaaaaaaaacaaaaaaaaaaaaaaaaaaaaaaacacacaagaaaaaaaaacaaacaaaaaaaaaagttggtgtggcggctgccagccgcgcgcccagaagaagagttcttagaaaccaatggtggggtgggcgcgcggcggccccatgatgatagtcagaacagtcgggctcaatgtgtcgtcccagaaagacactcgcggcgcaagacaacaccgctggtgggagttcccccccacaaaaaaagacgccgcgcgggcggaacaccacacggggtgttttagaaacaaaacaacccgagaaaggagtggtctcatgagcgcacgcactatgggggggctttcttaacaacagagggaggcgtgccaaccagaggagagctgctcttaatattataaatatattacgccccccccccctgtgtaggtggttgataccatagcaacctagtacgaacgtggtacttcagatggatgttcacatacgatatcagacgagaagctagcgaggtgactgaccgtaacggtaaggaatggtgacgagggtagccagaataacgcaacagagaagcggacaaagaggcaggcgcgcgagagagaaagaagcggacgaagaggcagcgaagaggaaagggatcaaaaaaagaagaatagacaaaaacgaacagaagagaaaagaaaaaaaggagcgagcaacggaagcagagaaggagaggcaaggagaaagcctaaagaacgaaggcgcgagacaaaggaagccaagcagacccagccaagcgccaacgcgcggccagaagcggtcgcagagcaaaagccacagaccgacaagctagatcgaccacatgagaagacagaagaagcaaaggaaggtagcacggcgcaggacggtcagagaaaagacaaaagcaacaagaaacaaaaaacaacaagaattaatggcagcgtgttcag

SEQ ID NO: 634229 - DNA, 667 bp, Homo sapiens
gccgggctgagaggagcgtgacagtcgcctctctccggcatggcgtgtgctcgcccacgtgagtatcgagcgtgctccgacaaaagggggagtcatctggcgaaaaatgtcacattgcctgcgtgtattcaaggctcctattcgaccagcatattgtgaacttgttcagccccaacttgcgcaaaaactaacagatagacctatgctgtctagtgaattacgcaggtccattcagcacgtaatgctgcagtcttggggtactgggctcagattgtggttcgaaattcccagaatgttcgaggtgggtgggactcaccgcttctgggcctaggggtgtctttccgtgaaatcatgatgtcgtggaggccgcagtgttatgcaccaaccaaatatctggaaccgttggcatcgtaaagagaaccactaaactgataaacgatacggcacagtctggtttctgtacacgggaatggtctcagacccataaccagagagctggttgatgtataataggtcatcggtgttgaggaaagtttcctgaactttaagttatggatagattgatagatagagagtgaacgggtacagatgaagactggtggaaggtgtggggttccttaagaagagttaaaagtctggtaatgatcttgtccttgtctaatggggt

SEQ ID NO: 634230 - DNA, 363 bp, Homo sapiens
  misc_feature (32)..(32): n is a, c, g, or t
tcggttgcgttggtggtctgatataacgatgnagtctcgccccatagcctaggctggagtacagggtgtagatcggtgccgattgcatcttccgcctccaggattcaagcgagtctccagcctcagcttccacaggagctgggactacaggcatgtgccaccacacttggccaacatggtgaacccgtgcctttatgaaaaatggaaaaattagccaggcatggtggtgggcaccagtcaatcccagccactcgggaggcttagacgggagaatcgcttgaacctgggaggcagaggttgcagtgagctgagatcgtgccattgcgctccagcatcagcaaccagagcaaaactccatctcaa

SEQ ID NO: 634231 - DNA, 300 bp, Homo sapiens
aacagcgaattaaaaagtgccaatctcgtgcacttgtagtcccagccactcgggaggctgaggcaggagaatcgcttgaatccgggaggcagaggttgcagttagccgagatcacaccactgcactccagtctggcaacagagcgagactccatctccagaaaaaaaaaaaaaaaaaaaaacccaatctttcttgaattctctgttaaaaatttggctatttttccttttatcttttcccaattatgctaggttaaaaaaaggacatacgtgttttaacaccgaattttatcctcctgac

SEQ ID NO: 634232 - DNA, 1642 bp, Homo sapiens
gggcgagcggaggtcatagctcctgtggggtccgttgttttggaggtgtggcccagatcgtgtaggcagactatttcgaaggccgactgggatgcgtcgtgtcgaagggcgttggagtacgggaaggcatgcaggccccggggttggtggttccagggactgctcgggtctaatgcgtttatgctcggacgcactgcccgtgtctcgtctaatccgctcgctcccgtcctcccctatcaaatgagtgattcgtcaggtcgcgatgagctgcagccttggcagctgaggtcgaaaccctcttcagacatcgccaacagatcttgcagactgggtgccctgaatggtcatcagggagacactcctgaagcagtggtcccacagcgggccccagcggcgctcatgcccaccctgcctgctccgtccgcaaagcctgtgccagtgcagaccgccctgttgagaagaacgttacagattgtgacatttcgcgcttccgacggagagttgatttactgcatcttggtgttggctttttggagtgcgcggattctatcaaagctatgatgggatcgtagcacaactgagaactgccttggtgagatgtcacgacctgtgacatttgtaggtgccaaagtgacacggattaatgacagtcgttggtaagccccctcagaaacatgttatcaaatgggactattcattttatactgggcacttacttccaagttatagcaactataaaaacgaagggaataaggggtagttctaccgtagggtttcaagggctaaaacagggaattgggggccttcccggaaacttattaccctataagggcgtacacttccccaaatggcgagtgggaaccctacgtgaccaaaaggttattagcgacttatataaattcggaacaggttcatatataacacaaggctccgtatagattaattacagccaaaatataagtaggcaattggggaaggaagaggaaggacaagctaaccatataataccactccgttgtgtgcagcccaccgcagttacacgtaaattatatcgctggaggactatgaccctcatcctgtgcccacagtgtggcgttggaaactttacattattggctctgtgaccagatatggtacccagtggcacactcacatagttgggaacagcttgcactaaacagggttacgcagatattcacaacaccccccagaccagaggatgttaattgaccaacgaacatttttgtcagcggaatgtacgtgtctccccacaatgtgatatacgggaaacaacaggcgctctaaaagcgactcctacaaaagggagggatgtgcaaccactcatcttgggagtatcaagaggaacccatataacacacaggtgtcaacaatgccgacagtcacggacaaggaacgggtgaaagcacaggatcaaacaagagggggctacagaaccaccggacgactgtgctcatgccacacaaacagacagaatacaaaatgacgacgcaaaaaaacaagaacaacggaagaaaagaacacacacagatgatagatgagcggcaaaacaaagaagaggcagtagacacaacgaaaataaggagacggtcataggaagcaacagcagaaaaagaggagacca

SEQ ID NO: 634233 - DNA, 306 bp, Homo sapiens
  misc_feature (6)..(6): n is a, c, g, or t
  misc_feature (26)..(26): n is a, c, g, or t
  misc_feature (56)..(56): n is a, c, g, or t
  misc_feature (90)..(90): n is a, c, g, or t
  misc_feature (112)..(112): n is a, c, g, or t
aaaaangggggggggggtttttttcnccctttgccaggcgggtaaagaatgaatgnccccccccccccccctttgggcggggcccttttnttccctttataaggggtttggnaaaaaactttttttccttgggggggccggaacaagggtaggggtttttatgggaaagggggcccggccccccaggttttttggtcccttttggggccccccgggtaatcccccccccctccccatttacggggaaatggttttccccccccctttttttttcggggaacttggggaattaactggaatttccca

SEQ ID NO: 634234 - DNA, 989 bp, Homo sapiens
gctggtaaccgctactcccggacaccagagcacgccttccgtacacaggggcccgcatccaccctcccggacctaagagcctgggtcccctgtttccggaggtccgattccacggcccccagattctggcatcccagccctcagatgtccaagagccaggcagcccgggtccccgcctcccggatccaggcgtccagggatcatggccaccagaacctagacctcctgcagagctccgacatctgggggcactcaagctcctggagccaagggccccacgtacacaccagagaaactctcgtattcccagctcctagggccaaggaacccgggacgctccgaactcccagcgttacggacatctggcacacgggggcagagcagagaagcctcagacgcccagcctggggaacttcacacactccagcttccacagagccaaggaacttcagtcgctgtgaactcaaccactctaacggagccctcccaaagctccagtctccaggtgcctgtgactcacactcagtcctagggaacgtcgggtcctgggaaggagccacaagccgctccccagaccacgctacccagggagcttaacgaaagccccgggtgctaccacatcaatggtgcgccggatcacttacatcgagaagtccaaagggggcatcgcgcaggggcggaggcccaaccggcacaaacgcgggcggcctaggcaagctgggaccagtcaccacatcggaaggggacaccccaaagaggacgcagcgacaagcaaagcgacggggacttaacagtggcgagaactaccccggggggaacccacgaggtcgcggcagaacggaccgcaatgcggagcacccaacaccatggggatagtcagcctaggagtggaacaggtatgcgagggcaccgagggggggaacagggacgatagaggccacaggaggaaacagggggcagtacgacacagagaggcaccagacaggtga

SEQ ID NO: 634235 - DNA, 1072 bp, Homo sapiens
  misc_feature (772)..(772): n is a, c, g, or t
tcttattgttccaataaaatcttatttaactaaaacaaatggagggccgggttaggtccatgggctggggttggttgacccctagcatgtgtggcctagtgggatttggaagggccgaatgggggctttgctctagcccaatcccttcccattgctttccctctgggggactgagctggcccccggggaggcgctagttctcagagaggcttgtcctgtctgcgcaggggaggcaagtgtgtgtgggacctggatatcagtgggagaatgtctctggtgcacatctcctgggactgtttatgtccacggaacgcccaaatggctcctcaaaagggaacccctatgtgcctctacaaagcccagctcttacaccagattcactcaaacggtccacggtgtgagacttcttcatctccacctgtgaccctcttggggctcatagattctctatacactcgggcctcagggacctgtgtccgggatactcacaggtgccattctggagggatcccccgggccaacaggtgcgggccctcctcggctgcccgtgtttgccccgtgtcacagggaaagggcccaaaggacagaccacgtctcctacattgggtgggcgcgttagcgcgtgttgtgcgtgggctggggcgcgacacccctcacctcgggcccggccagcccagaaccatgcgcagccaaagcccccaccaaacgggacccaccacaccacaatccgctatcggggagacgcacccccaaaacaaaggcactgacccgnacagcgaccacgctgcgggacacccccccgaccccccaggccaccccccacacagcaaaggccccgcaccagggcggataacagaggaacaccaacccacacccagcgcaccaactgcgaacacccccacacagcacaccaaacaaacacccagaggaacacacgcaccctcggccccaccacacacccagcaaacgtaaacacgccaagcacgcagccgggaccatgtccccacccggccatcgtaacccccaaccaacaacacaaaacccgcgcgccaatcccaagctcccggaatga

SEQ ID NO: 634236 - DNA, 242 bp, Homo sapiens
ggatccccgtcacacgccgaaggcccagacacttcttcaggtcaagtcttggttggacgaaggttgttgcaggtcacagtggacgaagttgttgctgcacacgccgaaaatccataccacatgagctaagtctggaggttcggagatcacagtggacgaagttgttgcaacaacttcgtccactcagatctccgagcctccatctctcggactcgcggcgttgtggcctctcggcgtgtgca

SEQ ID NO: 634237 - DNA, 188 bp, Homo sapiens
gcaatatggcggaagtagttaggagtgagattagtccgccgtagtcgtgtactcgtaggttcagtaccattggtggccaaattgatttgctggtaagggagggatcgtatgacctcgtactgttatgtaaaggatgcgtaaggataaggagggcgataaaggactagagatgatagcgggccaggata

SEQ ID NO: 634238 - DNA, 127 bp, Homo sapiens
attaggctgaagctcctattccgcacgagacgccaggatgcggcccggggtccccaccacgagatggggacagttcttcttcaacacttctccatccttcttgatggagcgaccaccgacgcacaca

SEQ ID NO: 634239 - DNA, 1298 bp, Homo sapiens
agatcaagttaggaagctacttgcagttgaacccatgagaagcgatgacgcgcagagtcccacaggaacaggacagtgccttcgggagacccactggacaccatggcgggtactgcactcaatcttatactgagtgacatccagtttagaatccatgactaagaatctcgagcagaaacgggggcctgggcatcattacaggtggttgggtgatatcacccaatctaatgtcacgattagacggatcagtctgttaacagactagctatgggctaaagaacattgtcaccttcctacgacgcacacagtggcggatcgacagaccagcacgacaccatcgcgcaaccccaaaatgggatcgaaccttcctacgcgagaagaccacaatgaagattgaagttaagtgacgccacaggtagtcataggcaccagaaggggcaaacttaaaggcaacaatctcggacagcccgttaggggaaacaaccccatgctaaacagcgggccccacagccagacgaagaggccaaaaagaggagcaacccacgaagaccccaccggcgcagtgaatgaaaggccacccacgcggaccacaggagaggcccaaactcccacgccccacagagcaacaccaacagaccccaaaccaccacgacgaggcaccaacaactccgaacgggaacaaataggaaaacgtacatattccctggattctcaataatgtatgtcaatccgttccatttacaatcaataattccgttacagcatattattcaattacccaacttacctccaattaacatttccacatatcttatccacaataatcacaccactatcttcacataacaatatatatcacctaacataccattcactctataaatcttaaatagtgcccagttcccacactatctcaacctatattattcagtccattagcttcgactccacatcattcccatcaacctaaacacaaccaaaacccaaatccacccattaccagccatctccacacacaccaaatgctaaaaactcctagatgatgcgctccatctccacgtgcagacaataataacacactgtctatacggcctgcgatcagagtgcataaggtagagggacgcgagcgcaaacaacaaccatgcgacctcaaaaccgatggcacaccgcaataaaacggaccggcacaaaggagcaagcagaacaggaatggataagaggagaaaaaggaagaacgcgacaaagcccgccagcgcagccccgccagctgccacacctcaagagcgcagctcacttga

SEQ ID NO: 634240 - DNA, 897 bp, Homo sapiens
ctatcccctaattggatatacgtcagtctttgagttcctggattttccccatgggccccctgagattcaacgctggatcccaagatttggaaattttctgagtgctgaacaatcccttgccgtcccgttgaacgacttgtgcacccttgcaatcgttctccggtggtcaccccccggagtgttttagcccctgaccccttaagtacgcttgtcatatgtagcaaagcaaggaaaaatggggcggccaaaaaaagtgtaataaaccgaaaaaaaacaccacgattcggtcattggttaacaagaaatatatgcccgtgaaggtgtgaaccccacttgggggcagttcaccccctaatggtacgaataaaaagctgtcccccccaaagtagccccggcccagaacttgtcaaacgtggaaacaattgagcccaagtggggggggccccacccctgcaaagaagctctggcctaaagtaggtattctcccgaaagaccgcgccacccacaacatcttctgtcacaggagaaaccctgggatcacaacaatcaacgagatgtcgctatagtttaaacatctcaaaatagggaaaccacattttcccaaaatccgtaaaatccacaaaggtgaatctatgtgttacagaaaaataaaaagtgacattacagggtaatggggaaaccccttcgtggagactgcggggtgctttgcataccttcggtgaatcagaatggcgtaagaataatctccccccgtcgactcctatgaggcagcaacccacatttcaagagtttgcctattggccaaaagggtatctacacccgtgcccaaggcacacaagatgtaggatgtgtgtttaaccgcaataaaaaaaaacaaggctttaaccccccatgaca

SEQ ID NO: 634241 - DNA, 784 bp, Homo sapiens
cagaggtgcctggcaggaattcaaagcagcagctttcggcgagaaggatgctggatgcccagctggacgcctataatgcgagaatggacaccagttaaacagaccagcaaatcctgcgtgcggaacatggacccagtgcgtctcctcttgctccctggtaaggcggggcgtggtggctgtggctgtgcggccaatgatggatttgtttctttgatgttattaaaatatggatttaagaaactcatgtaacaggttcttctctatttatttgcttctaatatattttttatagcttctcgaaacccacacctgtgttggttgaccccgagtgttccttattgtcgggcgattcaacacttgtacacctgggtagtgcgagtgatggttgcgtgagcacaaactgggcgcgcgcgcgtatcgcccgacgcattaatcgcccacatcagtattataactacttaggaacatacggtcgtgtcatagacacatttgtggggaacaattataaccatataggatctaggagacacaaccagggtgggcgcgcgcgccaggagctagatagaaattagatctccccggacagtagcggggacgaccaggcacctgtgcacgacgagagtacgccgaaggttcttgtaattggtgaaaagtacatacaagttatggggcgccaataggtaatagagtgggagtcgcagatagaatatgtagaaggcccaagcgagcgggatgcgaggcgcggggtgtatgaatgcttcacccaagggtcgtaggtttagtg

SEQ ID NO: 634242 - DNA, 172 bp, Homo sapiens
tagtggtccagtgctacctcacaaacagttcacattagggctcactcctgccgtgtattctacgtgttttgacaaatctttaatgagatgtatccactattatggcaccatacagagtggttccattgccctaaaaatcctctgtgctacccctgtttgtggaggtagcact

SEQ ID NO: 634243 - DNA, 116 bp, Homo sapiens
tcagctcaatatacacttatgaggcaacctgaccactctacttaacactgccatctgtccccatacccaccatgctcatttctgagctgtctattttagaaacaacgatctatgct

SEQ ID NO: 634244 - DNA, 335 bp, Homo sapiens
tttgctagagtctcactctcttgcccagactacagtgcaatggcatgatcatggctcactgcagcctccacatcccaggctcatacgatcttcccacctcagcctcccttgtagctgggactacaggtgtgcaccgcacacccagctaatttttgtgttttttgtagggacaggtttcgtcatgttgcccaggctggtctcaaacttttgggctcaggtgatccacctgccccagcctcccaaagtgctgggattacaggcatcagctactgtgccaggcccaattcccaactttgatttctgaacttcaggcccacttctctctcttgtcgacg

SEQ ID NO: 634245 - DNA, 639 bp, Homo sapiens
gggaaagggattctccaggaaactagtcaagaaaataaccagtgatgtaaaaagtctggttctgtatgatcaagtgagatttctcccaggatgcaaggatggttcaacatatgcaaaccaatacatcacatcagcagaatgaaggacaaaaatcatatgatcatcttaatagacaaagaaaaagcatttgataaaattcaacatcccttcgtggtaaaaactctcaaaaaaccaagtacagaaggaacatacctcaatataataaaggccatatgtgagacccacagctgacatcatacctaatggcgaaaagcttaaagcctttcctctaagaactggaatagacaaggacggccattttcaccactcttattcaacatagtattggaagtcctagcaagagcaattaggcaagataaataagtaaaaagcatgcaaaattggaaaagaggaagtcaaatggtccctcatttgcagatgacatgctttttttttagagtctctgttgcccagactggagtgcagtggcgccatctcagctcactgcagccaccactcctgggttcaagcaaatcttgtgcctcggactcctgtagtgctgggactaaaggcatgtgccatgacacccgggtaattttg

SEQ ID NO: 634246 - DNA, 672 bp, Homo sapiens
ggtctatgcaaagaaattagcaaggtagctgggtcgctgcctgtacaatcgccgcatagtgccatcaggtcgtgtcccttaataccggcattggactctttgcgcgtattcattgtcgtcgcctatgtcccgcgttcggggtacttcggtatctcacgttgactcggcactgcctgcactgaagtctctcggggggcgtctagtgttgtacttgttgcggccaggctgttccgacggactgtctcccgcacttagtccgggttgacaagaccctttgcagcgagagtactagggcttgccggctaatagaacttcccggaaggcagggagaacccacaaaaaattgttaccggggaaatacccgggcgaaactttgatccatctcggaatgtcgcttgattcaacccacatggttggtaaacgcggaggaccatttgggacttgaccccgggtacaacctgggggcccctcggacagggcccaactttccacaatttgcgaagcaaatcaagtagaacacggcttggggagggaacgcatatccggtgaggtcccaaggccaacaggttgcgtccggcctgggcgtccggagctagtgctcacacacgcgaactataccccagcgtagacttttccaaaggactcccaactgattcaccccgtcctgtgccc

SEQ ID NO: 634247 - DNA, 429 bp, Homo sapiens
agtaagagtagagagctgttgtggcgacaggtgcgtgccacattacctgtgtaaatagctgtatgtttagtagagacatggtttcactgtgatagccaagatggtctgtatatcctgaccttacacactgttatgtgagatctttgtgtggctatggcatgagagctgtgtgagcacaggagtttaagaccagcctggataacacagtgagaccctgactgtaaatacatacattgtataatccttcaattaaggttaatgtgaacctgtaactgaagaaatagcaacttagttgttgaatgactgaatgacttgcaaagaatagtcgtcgagtttatttagactcttggcagctcactacagtttgagcctagattattatatcacgatttagacacgcagtcatacacacctgtacacacatgcacc

SEQ ID NO: 634248 - DNA, 113 bp, Homo sapiens
agtgatcgagccggtccgcataactatctctaaagatattactcagttctagctgtccagttgtctccaccaccacctctgcctccctaacaagaagaaaaaatgggcaatga

SEQ ID NO: 634249 - DNA, 766 bp, Homo sapiens
gtcttgaactcctgtcaagtgagcctcccacctcagcctcccaaagtgctatgattacaggtgtgagcctccatgcttggatgagatgttgtttttaatgttttggttttttggtttgttgttttgtttttttgagacagggtctcactctgtggcccaggctggagtgcagtggcaccataatggctcactgcagcctcgacctcccaaggctcaggtgatcctcttgcctcagccaccccttccccggccaccaagtagctgggactatgggcttgtgccaccatgcctggctaatttttttatttttagtagagatggggttttaccacgtcggccaggctagtgtccaactcctgacctccaaacagctaatttttgtatttttaatagagacaggttttcgccatgttgcccagcctcgtctcgaactcctgggctcaaatgatccacccacctcggcctcccaaagtgctgggattataggcatgagccaccacacctggcttttcagtttttttatttttattttgttctttgagacggagtctcgctctgtcgcccaggctggagtgcatgtggcgtgatcttggctcactgaaacctccatctcctgggttcaagcagttctcctgcctcagctcctgagtagctggattacggtgctggcacatgctgtttaatttttgtatttagtcgacgacggttttgccactttgcccagcttgtgttgactcctgggcccattgttcacttgcttggtcca

SEQ ID NO: 634250 - DNA, 837 bp, Homo sapiens
  misc_feature (253)..(253): n is a, c, g, or t
catcaggaagaacccgagaccatccctgagaggacccactgctgagtctggtaggttctctccgtcctgcgttttccgggtactttgtctaccaggaggcttgtcgggccacctgacagaaccctgggccgtctgcgatgagtctgtgccagtcttgtggcctgattgctctgagggtcgtgcttccacaggtacgtcacgatgctggtatgctgctggttgctggagcagttcctgggcatcctgacctgantaagtgtccggcccgtgggttggtggcccacgttcctcctgagaagctgctagatggcagccgtccctggttggagggcctcgtctgatttcctggtcgtgccaggatgctgctgtgctcccctgcgggactcatctctctaatgtcttagtgatggtgtgtctgagaggcagcatgtgatccatctgctgcttccaggcgagctcgcgagccccatgcatgcccttgtgagctgggtgagagtcccggtcgaccgttctgcagactgcggtgagtgcccgagcgtagcctggcatcctctgctggtccttaggtggggtgttgggccgatgtctgtggttggcgacgaggtgcagacctggcgagccagggccgtcagggagctccatggtccatgctatcgttcgggactttcctcctgttgtctctcgtgactgttcgaccttgtgtactcagattaagtcttcagagattattgccgattcatccatacttaaccacaaaataggtgaagaaaacatccattccattaaagaaaacgaaatcttccaaagccccggatcatgaacgctctgaaagtcaag

SEQ ID NO: 634251 - DNA, 595 bp, Homo sapiens
  misc_feature (9)..(9): n is a, c, g, or t
attgagtgnccatgtgaggtggtcatgcctgtaatcccagcactttgggaggccaaggtgggcggatcacttgaggtaaagagttgagaccagcctggctagcatgcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaaaagaaagaaagaaagaaagaaagaaagaaagaaagaaagaaagaaagaaagggaaagaaatatctttgctatttgtataaaaatggaaattttaacagcttagcctctagagagttactgaacgtggttaccttgggaatgtaaatagaactgcaaattaaaatgactggccacttcaactgggtaagggaaacagctgcaataaagcttcgtgaatataaaaaaaaaaaa

SEQ ID NO: 634252 - DNA, 521 bp, Homo sapiens
ctcttttatctattctgaactctattttttttcttttttaagagacaaggttttgctctgttgcccagcttggactcgaactttcctgggctcgggcgaccctcctgcctcagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaaaagaaagaaagaaagaaagaaagaaagaaagaaagaaagaaagaaagaaagggaaagaaatatctttgctatttgtataaaaatggaaattttaacagcttagcctctagagagttactgaacgtggttaccttgggaatgtaaatagaactgcaaattaaaatgactggccacttcaactgggtaagggaaacagctgcaataaagcttcgtgaatataaaaaaaaaaaa

SEQ ID NO: 634253 - DNA, 1658 bp, Homo sapiens
  misc_feature (943)..(943): n is a, c, g, or t
  misc_feature (1174)..(1174): n is a, c, g, or t
tcctaaaaggtttctacttctgcttttttttacaggccttgttgggtatttacacagttcaagaatacaggtgtttagaaaacacaaaaggtgtttgaaaaaaaaacttctcaaaattgggtttccagaatctctcgaggaaaagtgattctccacatgtggtagaggccagagtctctctccgcagtgtgtgtgtggctccactccgagaagaggcaagctgtggtgtctcacgagacaccctcctttgtgtgccgaaaagccgtggcgggttctcgagagaggtgtgctctcgagaacacaacacagaggtgtggacttatatagaaaaaagaggtgggacatctcgtgggtggtgtggggtgtgaatactccgagggcggccgtgtcgcgtggggccaccggcccgagagacacacctgtgagagggctctccgagactctccctgtggccgaggagagcgcgcggcggcagcggtgtgtctctccaaagacactgtgagtctcctctcgccttgtggggtgtgtgtctcggcgcgctctcgaaagatatcacactctcccacatatttttctctttgtggggagcaccccgcagagagagggtctccaccctttaaagtatcaccctgtgtgccccttttgggggacatatctccccgagagaagggggggttcagagacaaacaccccgacacctttgtggggccccttgcgcgcgtggggtcctttatcccgcaaaaactctctgtgagatatattctccccaaattctcgcatagagttgaaaacaccctataaagagagttctcaccccagctgtggtctataagggggcgacagctcaaaagttatacccccaagaggggagtgggcctctttgggggccgcaactgtgtttaaacagggtgctttggcggacacagaagggggataatcacangggcgttacacgacaccgttctataaatacacgcgcctcttctgaaggacaccagtgagcaggcctccttgtgtaaaaccaacacgtcggaaggcgttagtgagcagtggacacatctgtggggcaacaccgcgggttcacaacactgtatcacacaaggggagcgccctttgtagaacatcgtgtcacaagaagaacatcccttatgtttgtaaaaacaattccccccgnttttatcacccttcccccaacgataacaggaacatatctataagcaaaccagcaggggctggatcaatttaaaaccaccattaatcgtcttggcggaacaaaaaggacaagggttcgcccctcttaacaacacgaaccaagaagagagagtgcatagacccaatatctaccataaaaccgaacggcaagcccgccccagggggtgccacatggcaacaaacaacggcggggacgtaacacttcaaggggggacactccccccccagagaacaaaagtgtgtccccccgtgtggccacagtggctagtgggtcccggtgggcaactaaaggaggaagccacaccagaaaggaagagtggcagaccaatacgcggggacagatcaatgtagcaacgaagtagtatcacaagatccccgccaggttgtaccacgcgcgtacagaaatatcgtaaaacagtatcatcgtcgtgggagcagcaagccac

SEQ ID NO: 634254 - DNA, 269 bp, Homo sapiens
  misc_feature (49)..(49): n is a, c, g, or t
  misc_feature (180)..(180): n is a, c, g, or t
  misc_feature (255)..(255): n is a, c, g, or t
gacccatgagcaaggagtggggcctccgcttgataccagctggagtctnctctgcccctgctctactggcttgcttcctcctggaaactgtgagcttctgctacgtccagtctacaactatagaccaccatttaaccgcctctttgatcacagtgctaaatagtgtattcaccttctccntacaagaaggctcagcgagatctgggctatgagcacttgtcagctgggaggaagcaagcagaaaacctcagagtngatcgggacactag

SEQ ID NO: 634255 - DNA, 424 bp, Homo sapiens
tagaaaaattcctttttttttttaattaatttaattcattccatttttttgggatggagtccttgcctttgtcaccccaagatcaggccactgcactccagcctcggggtcaagagcgaaactctgtctcaaacaaaaagaaagaaaggaaggaaggaaggagggaaggaaggaaggaaagagagaaagaaaaaagaaagaaagaaagaaagaaagaaagaaagaaagaaagaaagaaagaaagggaaagaaatatctttgctatttgtataaaaatggaaattttaacagcttagcctctagagagttactgaacgtggttaccttgggaatgtaaatagaactgcaaattaaaatgactggccacttcaactgggtaagggaaacagctgcaataaagcttcgtgaatataaaaaaaaaaaa

SEQ ID NO: 634256 - DNA, 348 bp, Homo sapiens
ctgcctgtgactatgattaggagccttgcttcatttcagaatctcccttcaacctgctagggcaggtatcagaaattccaaagggcatttatgtgaggcccctaattagagcctatcaaagtaggaagggagagccatttgaaaggcatcatatttcaaacttttgctattatctgtgttatctttacagtcacgggaacccactagcgctactgaaaaaatacttatacaattttaagtgtctttaaaatttgtgtcccataatgggacatcccctgttgtatatatgccatgtattctattttagaatcctgtattttatgcccataaagtcatagtcaaggccca

SEQ ID NO: 634257 - DNA, 848 bp, Homo sapiens
agcgtgaccttaactagctctgaatcagaagacagagctatatcagaggctctgtgtgccctcatagatagttcttctgggttcaaccactttggccagaatttgatcaattaaaagtctgtcatggggaacctatattttggagcacatggaacaaatatatacttcctcattcatattatgtggatacaaaagacctgtggcagccatttctcccagcagtttacagggatgaacatgggatttcatgccatcccatagaaaacctgttttaaaatttaagggatcttaacttggtcatacatgaaaagtacactgcttagaaattaatagactatcatgatctgtccacagtgcccatggtcactgtcttgtctcatttcttcccttggtccttagtacatccaaataagcctgaaaagcataagagatatacttactgaatatggttggcaataacattagcattgcattatctaacaaagtgactataatttccaggacatggtaacaatgtgttaataacccccagacgaatgaaaatttcaagtcataccagcagattcattgacgggtaaagtttagtcctataaatgttcaggcgtaatataaccacaaggaacacattacgtggaagggggaattaccaattcgcgtagcaaaaaaatctggtagggccttaataactcctatctagggcgttccacatgttatcagttggccactccttgtaacccgaaagtcttttactagaaaatttacaataacgtgcagatgttttagagggttccctatgctgacgcaaggtgtcccgaagggtgggtgtgtggaaaacaatgcatgtcggg

SEQ ID NO: 634258 - DNA, 696 bp, Homo sapiens
gtagggtcttcatgctacctgggtcagcgaaacttatgtatcagaaccatattgaacaaggctacatttacaatactgatataactataaaggtggctcgtgacattaagagcagcaaatatagtaacagttcatttcacagaaagcattgagacctatccaagatgagcgaaggtcatatatagtagtttggatggaagtcaggggttaggaagggagtagggaggcagaatgaaggaaaaggcaagcagcaatgtatgatagtgtgtatcatttagatgaaagttgaaggcacaggagaggtagcgaaaggccaggcttagctcttgggtgtatcttcaaaccatgagattcgcacacacataacaccactgccattacactaagtcaaaggtaaccctagaggctctaagtctcgaggaaacgttgtcgtggatgacaccatgatgcgtgtgggagcacgacattgctgctgcatcattagtcggtagtgctcatggagaggttggggtgctaaggtaaggtggacacgtattttataggctaatgtaagaggcaaggttgaacaatgtgacttgagactgacatggctgggtatatcatgagaatattgcctgtacgcattctaggtctaccttgaagggaagtggagagccgtagaggacgaagactaaaagaggagggtttgtgccctaa

SEQ ID NO: 634259 - DNA, 222 bp, Homo sapiens
tacgagcgcaacaatggaacaccaaatcttatcacacagagacacagtccgtatttaccagcccgctccagcagagcgggacattgtaaggaagcggtggcggctggtgaagcaagtctcacatgtcggcgttcttggccaagtggatacaagagataagagcaaatgtttgcctttttctagcgaacctgtcagagaattcgtcatgtcctttcagagact

SEQ ID NO: 634260 - DNA, 209 bp, Homo sapiens
acatcgtccttcctctcaagctagcccagcagggtgggagcctaaggaagcgtggggtcacagatggagtcaatggtcacgaggtcagcaccactcccaaagctcagccttgccaggctccctttctcctcttccccaggtccttcctttaggtctggttgttgcaccatctgcttggttggctggcgcgtgacagggggtcctctcac

SEQ ID NO: 634261 - DNA, 114 bp, Homo sapiens
  misc_feature (89)..(89): n is a, c, g, or t
agtggccattacggccgggggccgggcgcggtggctcacgcctgtaatcccagctctcagggaggctaagaggcgggaggtattaaacncctccggatgtcgtcccagggagtt

SEQ ID NO: 634262 - DNA, 295 bp, Homo sapiens
ataatagttttatactatattaacaagcaaaaaaaagactttcgggcgactcgggcattatgtcagtttagggcacttatggataaaccactataaacatttgtgtgcaggattttgcatggacataagttttctgttcatttgagtaaataccaagggaattacctgaggattgtattgcaggaggatgtttagctttgtaagaaactgccagattttcttccaaagtggctgtaccattttgcactcccaccagcaacgaatgatattttttgttgatctgctcacctgcatt

SEQ ID NO: 634263 - DNA, 280 bp, Homo sapiens
tgtggcgacggggtctcaccgtgtaagccaggatggtcttgatctcctgaccttgtgatcctgcccgcctcggcctccaaaagtgccgggattacaggcgtgagccaccgcgcctggccggaaatttttttttttttttggggggaaataaattctcattctgccacccaggttggagtgtagtggcgcagtttgggttcaggggaacctccacctcggggataaaagcaatttttctggatacagcctcccgagtagttaaaactacgggtggtgtgcc

SEQ ID NO: 634264 - DNA, 508 bp, Homo sapiens
tacactcatcaaagtcctgtactgaaactccgctcgagtgcgcgtcgtgtggtgcacactcacccccgcccagacgaactctggcatggaaacagtgggctaatgcataccacgtgctaccagaagcaccaacacgtgtggtactccagtccagcaatcacagaccagtatctactccaaacatcctgtagcgaaaactatggcatcttcccaggaacagcaaggcaggcttcttactcacgatgaaccatgcacgaataaacccagcaaaaagagaactgcatactttaaatgtatggatagtcattcatgaggatcgtcaacaattccaatataaggaacaaatcccctggctctccccaacaacatcttttgactctagccaatgttgtccttgtttatagaggcctcggtcatcaaccgcattattatctcctttggtcaaaaacttgatatgcccgttatgcttatcatgaatcttcaagactcggtggtgaatacgcgaatg

SEQ ID NO: 634265 - DNA, 578 bp, Homo sapiens
cgggaaataaagactgagctgctctccaaaagatggctaagttgtctgtatactttatttgaatcccaccaggaattcacttagagatttggacctggtcccttactgcttaagttcaaaaacaattcaaaaacttgtcaggctgtattttgacccagtgtagtccggaagattggatattaatctaactcccaaagttgttgcctctgtggatatgagtacaatttggaaagttatcagagctcagagaaaagaggaagagtgatctaataacaagattgaaaatgtcagctgagcagagtggctcaggcctgtaatcccagcattttgggaggctgaggtgggaggatcacttgagcccaggaattggagacccgcctgagcaacatagtgagacttcctctctacaaaaaataaacaaaattagtggggtgttctggcacgtgcctgtagtcccaactactcgggagactgaggtgagaggataacttgtacccaggaggtcaaggctggagttagccaggatagtgccactgcattccagcctgggaaacatagcgacactctgtctccaaaca

SEQ ID NO: 634266 - DNA, 374 bp, Homo sapiens
tggcatttaatttgttttggctatttacataagtaggttggcaatacaaccttatctccccatatagtcctgccttatacctgctgtccaggcataattataaatactgtcctcttttacttttgtaagttaatgggtttggatttataagtaacactgattagcactgtcggctggtgtggtggcttacacctgtaatctcagaactttgggaggccgaagtgggcagatcaccggaggtcaggagtttgagacccgccttgccaacatggcaaaaacctgtctctactaattagctgggggtagtggcacacgcctataatcccagctactcgggaggtggaggcaggaggatcgcttgaacccaggaggca

SEQ ID NO: 634267 - DNA, 611 bp, Homo sapiens
  misc_feature (424)..(424): n is a, c, g, or t
gacacagtaaggggaacatcacatactggggcctgttgtggggtaggggtaggggtgagggatagcattaggagatatacctaatgtaaatgatgagttaatgggtgcagcatgccaacatggcacatgtatacatacataacaaacctacacgttgtgcacatgtgccctagaacttaaagtataatatatatatatatatatatatatatatatatatatatatatatatatatatatatatatataaagtgctggctcctccttcaccttccaccatgattgtaagcttcctgaggcctcctcagccatgttttctgtccagcctgtagaaacatgagccaaataaacctcttttctttataaattacctagtctcaagtatttttttaaagcagtatgagaacaaactaatatacatagntattactggcatttaacttttaatatcctttatcttaaattgacaaactatttctaacatttagatgccctttgaggtggaccagtgttacattaaggtccacataaatcgaagggcaattggggatatcatatttttgtgcttaacccaaatttttatccaattatttagcattttgttttggttt

SEQ ID NO: 634268 - DNA, 148 bp, Homo sapiens
ctaaaaagatggactggcaggtcatatgtcatcaagacccctgaggctgtgtcacagggcatataaaataaaataaatataaaataaaaagttggctgggtacagtggctttggtctgtaatcccagcactttgggaagccgagataa

SEQ ID NO: 634269 - DNA, 145 bp, Homo sapiens
ggacaaagaatgaagcagccaaaattaaaaccctgggatgtctgtgtaccctctgtccccagggtgtagggaaatggaagaaaaaaggtttacgccaagttggggagggtgaaaagatgcaaaattattaaacccctcggttgga

SEQ ID NO: 634270 - DNA, 199 bp, Homo sapiens
  misc_feature (89)..(89): n is a, c, g, or t
  misc_feature (98)..(98): n is a, c, g, or t
  misc_feature (100)..(100): n is a, c, g, or t
  misc_feature (142)..(142): n is a, c, g, or t
  misc_feature (156)..(156): n is a, c, g, or t
  misc_feature (175)..(175): n is a, c, g, or t
cgaggatccgcataccatggcccccatcttacgagcccttactcctcatgatgaagaaactccaaaccctttgacagctcctcggggtnaaacctggnanaaagctgactgaccaggctccatgaaatctcccatctccatnatgtacctccttgntgccatctctatataaagngaaccagtcctaaaatcaaacact

SEQ ID NO: 634271 - DNA, 413 bp, Homo sapiens
gcacgagaagcgctttactcatcgcggtgttatatccagactaattttacgctcgtggcagaaccagatggctgagagaatattgtggctatgtgagcttggccccacaggatatattattttatttcacagaaagaacacgtgggcgaaaagaggacacgggaccgaggccatccctataaccaaatatttatataccgtgtctgagattatatcacgaggctataaaatatgtgtgagctacctcattcctgtgaaacccttgcgtgtggtataaatatggcgaggaataaacactggcccatatccatatgactctttgagggttctataaggtttgagtaagggtcaataagtgcgtacactttagcacacactctagactggttggtgttctttctgcgttacacggg

SEQ ID NO: 634272 - DNA, 435 bp, Homo sapiens
  misc_feature (347)..(347): n is a, c, g, or t
  misc_feature (357)..(357): n is a, c, g, or t
  misc_feature (378)..(378): n is a, c, g, or t
  misc_feature (392)..(392): n is a, c, g, or t
  misc_feature (416)..(416): n is a, c, g, or t
  misc_feature (423)..(423): n is a, c, g, or t
ctaaatttaaagaatctaagtatccaccctctggcaaaaacagatcatggaaaagaagcaagtaactgctttcctgctgaatttctcttagggccattgactgatttcccctgggtatagacaggttactctaggaacatggggtcatgtatggctgtgcttttttaatcatgccagctctgactcttccattaactttgtaatttgaatatgtcacatggtagttatgatcctccacttcctcaccaataaaatggggagtaataggcgacacttccccacctgtggcaggaagggcaaaaatgttaaagaagggtttaaaaagcactcggacaagcccaagtggnttttgttaantatttttaattactttggttngtttgagggttaantgttcaggggggattgttgggggncccaacnggattccttttt

SEQ ID NO: 634273 - DNA, 130 bp, Homo sapiens
gggcgaattcctcctcctcctgggcgaattcctcctcctcctcaaagtgccgagactacacgacgtgagccactggctgcccggcctgaggctatactcttgagtaaaacgcgcctgtgcttgggctctt

SEQ ID NO: 634274 - DNA, 273 bp, Homo sapiens
gggcattattaggtagtgaagtgttgagcctgtaactgctttcttgattggtggctgcttttaggcctactatgggtgttcaaattattactctctctacaaggttttctcctaatgtccaaagagctgttcctctttggactaacagttaaatttacaaggggatttagagggttctgtgggtcaaatttaaagttgaactaagattctatctaggacaagcagctatcaccaggctcggtaggtttgtcgcctctacctataaatcttccc

SEQ ID NO: 634275 - DNA, 763 bp, Homo sapiens
  misc_feature (1)..(1): n is a, c, g, or t
ncccacaggcgcccgacaccggataggttgttttactgcgggctccgtgtcgtggattccccgggttgttcgcccgctgttgtggtttctcctgttgaggacccgcgatagctggttgcttgcgtgatgcggagttcgtgggtagctatttcgtccgtgcggtgacgacctcctcctgcgggagggcaagtgtgtatcggtcatccggtgtgcgggctgcgtccgcttgtccccggtgcttgtcgctgtatcccagctaggcccgctctctgttagctgcgcggcgtgtaccgtcgcctggcgcgtctcggtgctcatgcccgtgtattgccagcactctctgggaggtccaatggtggctgatctagtttggtgctaagggagttcgatccacccctggccaacattgggtttaccccatcgtcctccgctcagtcttaatttatgtggctgttccatgttggcgtcatggccatgtaatcccagcacttttggggaggcccatgccgccccggatctgcgaagtcaggagtatcgagtctccttcctgggtatacccggtgaaccctgtctctactaatacacgattagtccatggcctggtggcggtgcacttgtattcgagccagtgcaggagggctgaggtcaggagaatggcgctgtggagcgcccagtgtcatgaggggtggcagtgatccgccgccttgtcaccccccccccgctggatgccagggggacatcgttcctttttcacatacataca

SEQ ID NO: 634276 - DNA, 215 bp, Homo sapiens
tgtattacagatgggatgcaccatgctcaggaccaacccctgcccccctttaaaaaaaaagtatgcagagggtccaaaatctgttactaggaattaagaagacacaaactgtgaggcgggcggatcacaaggtcaggggatcgagaccatcctggcctacacggtgaaacccatctctactaaaaacacaaaaaaaaattagctaggggtggtgg

SEQ ID NO: 634277 - DNA, 242 bp, Homo sapiens
tctgaggatcccctgcaggctggaatatcccatggcctgctcttccaccagacgggctcctgcacatttgatgaatatttcaagtcgaagctgtgccccttggtctgacccgagatctaatctctgtgctctgtgtattggcgaccagcagggtgagaataagtgcgttccccacagcgacgagagatactacggctacactggggctttccggtgcctggcttagaagctgttgcgggcgt

SEQ ID NO: 634278 - DNA, 649 bp, Homo sapiens
  misc_feature (204)..(205): n is a, c, g, or t
  misc_feature (212)..(213): n is a, c, g, or t
  misc_feature (241)..(241): n is a, c, g, or t
  misc_feature (448)..(448): n is a, c, g, or t
  misc_feature (494)..(494): n is a, c, g, or t
  misc_feature (559)..(560): n is a, c, g, or t
  misc_feature (576)..(576): n is a, c, g, or t
gccccattgtgtttgccccccgcgcattcggccattatggccggggctcttacctcgcttgagatggtgagagcacgatggttcacccaaaagctgtactgcatccacccgcaaaaatcgggccagggtcctcgatgtctgtagtgtcttaaaaaactcggaacaggtctgatcacgaaaatatgagtctaaatatagagaagnnagtgtannacgataagaacgtagaagggatagaggnttaattctaggaaaccttctgtttatgtttctacgttcttagggctcaatttctttatgtctggcgaacctatctatatttctccttctttctggcctcgacctctcctctccacccaacacctcttctactctacctcctcccttcttcctccccccctttctcttctctcttcttaaactcactcacacaccacaaacacccccncccgtgccgcgtctcctgctctctccccggcactgtttacttaccnatcaactccgtcgctctttcccctccttgaccactaccctcgttaggcgagtgctcttccggtcnntcttgtcggtctccgnctcctgctccccgctttgccctctctaaacctaacccagtcactaatgacgttatctttccttcacccaatca

SEQ ID NO: 634279 - DNA, 325 bp, Homo sapiens
tggttccgctgtcgcatgtactgggtcactctggcgcacattgtattcctggccccgcctcacccagaatggatagctccctccgtgacacagcttttgtctggtcctctgcgccccagtgagagtttcctgcggtacctcagcgcttccacaacgaccacacggcttgccatttgatctgcaaccacaaccggcggttgtttgtcctgtgcccactttatgaccctgtctgtgctaccacccctgtacgactgcctccctcatgtgtacgctcctccgacctgtctcactacacggtgtgtgcaacgacaaccagtgtatctcc

SEQ ID NO: 634280 - DNA, 426 bp, Homo sapiens
  misc_feature (21)..(21): n is a, c, g, or t
ggtgtcatcgatgccaccgantttcttgacaatataaagggccggcaagggtgtctaagtacaatagaaatcggaggcgtttatctctcttactttgaaaatgttcatggtttcattaataaaccccaggaagagcaatttctcaaaatctctaccaattcagtggtcacgggcggttggcagttaaatgtctgcaactccaaccccggttgtgttggaggaaacggtgaagacatctatagctcttatcatggctccggtccctggggatggtcagggaaacacggtgaagtcaacatcgatgaaggctttgcaaacccctgtatccatggcaacggctctgacagagttgcagcctaccacggcggatgtgagcctggatacacgggtgtgaacggtgaagtgggatcgataaacagggtaccg

SEQ ID NO: 634281 - DNA, 325 bp, Homo sapiens
aaaagtaccaaataacacagcagatgattccccttaacggcttgacctatttcaactaatcattaagtttggtcttaagtaatgagatttagcttcagatctatttaatattagtcttattatattattataactaagaagcgtaaaaggattcacaaatagtgatggcctcaacctgaatagagtagatgaaacctatggtcatagggattacaggatagaagcttcctgctgccaaccaggtggtgaaagaccttacttttacactcagggcaccggatcgcacacacctaataattgtcggtggcatcccccagagagccgg

SEQ ID NO: 634282 - DNA, 421 bp, Homo sapiens
  misc_feature (164)..(164): n is a, c, g, or t
  misc_feature (258)..(258): n is a, c, g, or t
  misc_feature (266)..(267): n is a, c, g, or t
ccaagcccgggggtcacttttcccataaggggggtttaccccagagcggggggggaacaaaagaccctctttgttaatttagggcccaggggtgatccaccaaccacagagatgaacctctggggccgggggggtcaccccccacctttcggggtccttttggnggtttttgggggcacccccaaacctcggggggtttccccccaaatttttgggggggcccccccaatttccatgcccccaatttttggggccccnttttcctnnggaggggagggggaaaaacctccccctcccccaaccaattggaaaggtgtttcctcccccaaaaagcccaggggcgggggttttttcctttttcccctgaaaaaggggggttttttttttttgccccccgcttttttaaaagcctccccccgca

SEQ ID NO: 634283 - DNA, 850 bp, Homo sapiens
taatcgcccagatcctgtgtgaagacacgttgctaaccacgaaccaaaaaaaggtttccgcccacaaagctcaaaacctcgctggtggaccactccccccctgtacctgatggtgacaaaacacctgttcgtccccccaccccagtagttcccccccccactaaacgcgtgttgtgttaagagcttccccacataattctgggcaagaaataccacccctcctcaccggttctcaacaagacaggaacccctgtcaaagtgcaagacaactgtatgcctgtgcgacccgcattgtcaaaatcgcgagggtcacccacaccgttgaccaccaatgttattgggttcaacccccaccctttgggtaatgcttattcaagatctaaacccatctttccctcatctttcttaagagacagtaagggacttctattttctcacgtgggacccccctaagaagataaatcctcccctgttaaaaaaccatctttaaaaaagaaaatgatgtaattcagaagtatatatttcacccccagagatactattcaataacatccctctttatcaccccccaggcatacattacaatgttttcgctttgtataacaaccactgtgaaaattagaagcactcgaggtgtcttgtacaccactaaagtacaacgcgtgaacaagagaatagcttctcaataacctagccgattagttctacgcgatacactatgtacacctaagacttgtctcccctttacccctaacaaaagactaaaggcccttctgtttgtttagaaactgtaccccgccaagaaatgcccctttcaaaaaaaattcaacttggaacccccaacaaaaca

SEQ ID NO: 634284 - DNA, 148 bp, Homo sapiens
agtgaaaaacaaagacgagacatatccacagaataataacgcatcgttgtgcgagggcatacaacagacaaaggcctaatctccaaaatatataaacaactcatacaactcaacaacaacaaaaagcaaacaatcgtaataagggtta

SEQ ID NO: 634285 - DNA, 245 bp, Homo sapiens
gcacaagcactgaaattagagatatgtgccatgcatgcctggttgaataggaaatgatctggtgtgagacaggggatctctctaatgttagcccaggctcatcttgaactctgggggctcaaggtgatctatccgtgcctgggtattcccaaatgtgtgaggataacaaggcagcgagcctcaccatgacctggcatgtatggttgtctattccactccatcagatatgcttattgaatgtgtga

SEQ ID NO: 634286 - DNA, 1327 bp, Homo sapiens
cgcacgcgtgggccctagttcttctaacaggcatcatcaacagctgcccaatgatctgcgttgcacttttgcacgtcgagtccaacttttcacccatctgtagcatcctatgtcaactgctgcctcaggtacgcaaggttacatggggacgggacttgcactccattctccaggttgacacgagaccacaccctgtcagtgctgggctcttgagatgttcgatctcttgcacatctgtgtgtgggaaactgaactctacacatatgttcatgggtatcattcctggagggcttcgatgaactatggtagtacttcctcagataccatgctaggtgcgcctcttcagaacccaggtgatcctctccatgctctgccaatagcgtcgccacccctatgtcagacgctcagtactactgattgaccatcttcgaaattccaaatccattctatgcccagaccctttggatgcgagccgaaatccttggggccatccgcgaacacatcgggtacaccgaggtgaacgcaaatgtaatgggttcataacttaggggatgctccaagaccacctaggtggttccaaagactacgcaaaggtaatagacttcgggggcgggaagtcctaaaacgttgtggccataggctagaaacgggtctgagcacccaatagaccaacacccaagcctttgtgggaattggccgggctagacgacattatcgacatgggcgtcaattgccaatgttattttctctacccataggtaaaccgcattccccccgcgttgttaaaattagaggcgcttaattcgcgtggtcattaaccctaaccattgcctaaattccagcggggcttatttgcacttcacggcgaggtacctctcggacaccatttcgcctcctccgacacaaagattttgggccgataaggcacttcgtttccccttgggtaaaaatatgaaccttgtcaaaatccccaaacggcccattctaatagctaattgacccacagaccccaatggcgccatatggatatactaggtgggaagccataccctatctccaactaactgcgcccaccgctttcttggggcacgcacctggggcaatttccaccgacggtagcgcccaaacgaagaaaataagcagcggtaccaataggtgattaaaaagcgtctcgcacttgcgcggacaacgcacacgcaccgtaccgcgacactttctacccatcccacacataaataaccgcaccccattgtattgccatatacagggccctagtacaacacagctttccctctttaaacttttaccaacagacccgagacaatcc

SEQ ID NO: 634287 - DNA, 154 bp, Homo sapiens
  misc_feature (104)..(104): n is a, c, g, or t
  misc_feature (148)..(148): n is a, c, g, or t
tcatctagagaccctgtgctcctcttcatagacattcttctgatccagcacacagcataagtaggttcctgtcactcactctttctttttctctatctccattntggcttaaaggaactaagctggaatacaaagttaccccctcttntgaaag

SEQ ID NO: 634288 - DNA, 914 bp, Homo sapiens
  misc_feature (60)..(60): n is a, c, g, or t
  misc_feature (112)..(112): n is a, c, g, or t
  misc_feature (195)..(195): n is a, c, g, or t
aaagacagtattttgacaaaatacgaagtggagatttacactacattgtacaaggaatgnaagtgtcacgggtaaaaactctaaaaggttaatttctgtcaaatgcagtagnatgatgaaagaaaggttggtattatcaggaaatgttttcttaagcttttcctttctcttacacctgccatgcctccccaaatngggcatttaattcatctttaaactggcttgttctcgttagtcgctaacttagctaagtgcttttcttatagaaccccttctgactgacccaatatgcctccttgtattataaaatctttctgataatgcattagcaaggtcaacaaagtcgatctagtaaacagtgctttccatgttactttcattcagagctaataagtgcttctccttagtctttctaggtaactagcgtgtaacacaatcatgtgtcgcagctttatagctcatacaaatattccagactacatcctttaacactatgaaccttcttaacatcactgtcttcgccagattaccgacactgtcacttgaccaatacatgaccactcttatacctcggcaccacgcaggaacaccacgcctccctgatagtcgcaattagcctatggatgtcccataagggatcctgtcagggtcacgaaaacttgtacatagtcgctgaacgacggtactggtacaactaacttcaactggcgcaaaaattaccaagcgatgacaacccataccaaccacctacaccaagacacttctatactatgaaacggtttgccaacatttctggactgacataaccacatgaactatacaggaaacagtgcactataggcataaatgttcaaggcattttttaacctacgctcataccttgcactgtattaacaaaaacaatacacacacaa

SEQ ID NO: 634289 - DNA, 81 bp, Homo sapiens
  misc_feature (53)..(53): n is a, c, g, or t
aagattggtagttggatctaaaggattgttcatattgaaatgtgacgtttggnggtcagttctatagacctggtgagatct

SEQ ID NO: 634290 - DNA, 871 bp, Homo sapiens
gtataacccaggccatgacccctaacaggagccctctcagccctcctaatgacctccggagctagtccatgtgatttcacttccactccataacgctcctcatactaggtctactaaccaacacactaaccatataccaatgatggcgcgatgtaacacgagaaagcacataccaaggccaccacaacgaccacctagtaccaacaaaagggcttctgatacagggatacaatccttatttattgacctcacgaaggtttttttcttcgcatggatttcttctgatgccttcttaccactccaagtcctacgcccctaagcccacccaaattatggagggcatcattggtccctcaaccatggcatcacccccagttgaaatcccctaagaaagtagccaatgcgctaagaaacgacaagctaccgtgatatagctacgcatgcagcgagtatcaatcacgctagagcttgcaccatagtctaatagaaagacaaccgaaaccaaataatccaagcactagctgattacaatatcactgggtgctctaaatttatagccctcctacaagcctaacaagagtacttgccgagtctcccttacagcagttccgacgggctctacggctcaacattcatgaagccacaggctttccaagggactttcgactgtcatggattggctcaactattccctacactatcttgcttcatccgaccaactagatatattcacttttacataccaaaaattcactataggttcgaaaggcgccgcctaaaatactaggcataggtgtaccactcgattggtagaagatagcctggattgtcctaccatctgaattgaaaagggcttaaacaaaaaactaag

SEQ ID NO: 634291 - DNA, 202 bp, Homo sapiens
  misc_feature (92)..(92): n is a, c, g, or t
ggtacgctgatacaccaatgctctggtagtgtgaatcagttgccaccaagaggtatataggcgcacagcatcacaaaaggtgaagagtgctncagctgtgacgagtgtacgaggggtcgtgccgagtcaggccaaactggaaccaggatttataactattatgatcaaggatatggaaattacactagtgcctatggtggta

SEQ ID NO: 634292 - DNA, 179 bp, Homo sapiens
cattcattttctaccttgcatgccatatgtcctaggcgcacaggggcattttgagaataatcttctactaccccaacggtattgagttgaaaataacgcacgacattttatagtcgcagcaagctctttaacaactgcattagctattgccgtcctattaaatgtggcagcacctcttc

SEQ ID NO: 634293 - DNA, 101 bp, Homo sapiens
gtgctgagcaagcggcaggtccggtaaggggcagcaaagatctggtgacgaaaacttcgttctcgtgcagagagtgagaaacaggggttagtggacagttc

SEQ ID NO: 634294 - DNA, 102 bp, Homo sapiens
ggctggctcctgcctctgggatttagactttatctcaccctttccattttctttgggggctcgggaccgagacctgcttcgacgatttcgtcatactcctcc

SEQ ID NO: 634295 - DNA, 2287 bp, Homo sapiens
ctgataaatatgttaaaaactagctatttccctctaaatactgctttagttacaccccacagatttttttctaattatgttccacagatttttatatagagagctttcactgccactcatttttaaatgtttatatttttcctttaacccacaggtcattttggtagtatgtttcaagattatatacttattttggttttctgctgctgttctttactacctttattactactttactatctttactcctgatttctaattttgctgcattaggagtgcaaagtcatgtgactttgactcttgggaattttaaagtttcctttatgacccagtacatggttagtttttacgactgttcagtaagttcttgaaaatattgtttattctctatgttaggacaaaattctatatacacatctatgaacttgagcttgttaatgttattaaaactttatgttgatgcttctttatttgatcaaattctgacaggagcacatccaaatgaccaactacaattgttgatttatctgtttcacctcattgctgctatatatacatttatttgtttacttatagacagaatcttgcgctgtcacccaggggtatgatcttagctcactgcaacctccacctcctgggttcaagcaattctcctgcctcaggctcccaagtagctgaaaactacaggtgcgtgccaccacgcccagctcatttttgtattttcagtagagacagggcttcaccatgttggccaggctggtctcgaactcctgaactcaggtgatccacccgcctcagcctcccaaagtgctgggactacaggcgtgggccgccgcgcccggcccgctttatgtatttaaatgccatgctgttaggtgcatcgatcggcacggttatattttcttgatctactgtttcttttatcagcatataacattgctctgtgtgccttaaaagataatttaatcaatattaaaataaatcatatttgggaaggcctattttcctgatataacttttatttttaaattttttttctatctctgtatttttaactttgctgttactttttgtctgtttaactcttgttgacagtatctttctgtatctttttagcccaactgagatgtatattttcattttgatctaagtacttatttgtatttattgactttcccatgatttgtacttatctcagccttctttttcatggtgtccacatgctatcacatttctttctctcccctccccattcttctctattctccactgggtaaactgggttttactctgacggtttgaaacttatacattccattttgatttttctagcgtattaagagccatacttatgcttgtattttcttaagcttatcattatcttcttaagtaactgtattttcttaagcttatcattatcttcttaagtaacttaatgtaacttcttaagcttatcagtatctacatcttcccacaaacaagacattaccccatcaccaccgtaagcagtgccatctcaccagctggagctgggggagtggttgtggcaggaagcaagcctcccagatcagaacgcctctggtatgatcatctgtaccgctgctagaacaaatgctctgccccaggtatagagaggatgctgaaaggggaaggagcactccaaagccagtctaccttcacaagcagacttgaatatcataccagtgtcaccctgcagcacccacccccaacccctaccccataactcaacaacccacatacaacagtgagagaaacacattcatctgaaaaagattctaagccctatctcttttcatagcacccagtcctcttttactctgagcagctgtttcagagatttagatagatatatacagatatatcaataggcacagatagagatagagatagagatttagatagatatatacagatatatcaataggcacagatagagatagagatagagatagagatagagatagagatagatatatacagatatatcaataggcacagatagagatagagatagagatttagatagatatatacagatatatcaatagacacagatagagatagagatagagatagagatagagacacagatagagatagagatagagatacagatagagatagagatagagatagagatagagatagagatagagatagagatagagacagagatagagatagagatagagatagagatagagatagagatagagagagagagagacatagacatagagatagatatagatagagatagagacac

SEQ ID NO: 634296 - DNA, 858 bp, Homo sapiens
  misc_feature (6)..(6): n is a, c, g, or t
  misc_feature (32)..(32): n is a, c, g, or t
  misc_feature (103)..(103): n is a, c, g, or t
  misc_feature (289)..(289): n is a, c, g, or t
  misc_feature (353)..(353): n is a, c, g, or t
  misc_feature (386)..(386): n is a, c, g, or t
  misc_feature (529)..(529): n is a, c, g, or t
  misc_feature (532)..(532): n is a, c, g, or t
  misc_feature (540)..(540): n is a, c, g, or t
  misc_feature (549)..(549): n is a, c, g, or t
  misc_feature (551)..(552): n is a, c, g, or t
  misc_feature (554)..(554): n is a, c, g, or t
  misc_feature (560)..(560): n is a, c, g, or t
  misc_feature (563)..(563): n is a, c, g, or t
  misc_feature (567)..(567): n is a, c, g, or t
  misc_feature (572)..(572): n is a, c, g, or t
  misc_feature (578)..(579): n is a, c, g, or t
  misc_feature (582)..(582): n is a, c, g, or t
  misc_feature (585)..(587): n is a, c, g, or t
  misc_feature (595)..(596): n is a, c, g, or t
  misc_feature (601)..(601): n is a, c, g, or t
  misc_feature (610)..(610): n is a, c, g, or t
  misc_feature (612)..(614): n is a, c, g, or t
  misc_feature (623)..(624): n is a, c, g, or t
  misc_feature (674)..(674): n is a, c, g, or t
  misc_feature (778)..(778): n is a, c, g, or t
  misc_feature (838)..(838): n is a, c, g, or t
tcaacnttaaacagacctttagtgactgaggnggggtttaggacttcaaggttgtgatggcccaggcgggaaacagagtggagagctcagtaggccgtctganactgctgctggcggtagccaccgcggcgcatgtagccctcgtttttgcggtagccgtccttctggtctcggaagtagcccccgtaggtgccctgcttgtggtcaaacacccgttcgttgttctccaccaggctgcccagcttctcggccagctgcagagccaggttctgctgggcagtgggctcantgcggtgcatcaccactgtctgtgttggctggtccagggaggccatcagctcctcattaatgancattttgctgatgatggagtgcacagggggcanatccagctcaaacatgtttgacagcgttttcatgctgatggagtcatagacactgctgtaggtgaagagggaggtcctcagtgacttttcctggatcttcctaaccagcatggggcggactttgtcagcctcggggaaaaggnccnacactttnccattcatntnntnattganganaaanctgtnacaggnnttncannnacccattnnatggncttggaggnannnaccacattnnccgctggactcagggggacccagcaggggctgtcgctcgctcacgcgcantggtggtggaactgcttgctgaacatgcgttggcgggcatcgctcttatgggcggccatgtaggggatctccaggagcatgggagaaaccagggagacacactncagcagccccaggttgatgttcaggtggaaggggacctgacggcgccgctccaccttctnctgctcctggttgcgctcct

SEQ ID NO: 634297 - DNA, 133 bp, Homo sapiens
  misc_feature (110)..(110): n is a, c, g, or t
gctacactgggacggtggggttcctgccggctgaattcgggtcttggactggactgagaatctacggtggagaccatccatgtgaaaagaaccccccatgatgtaatacngggctccgcgtgcacgtcgcctt

SEQ ID NO: 634298 - DNA, 494 bp, Homo sapiens
  misc_feature (364)..(364): n is a, c, g, or t
  misc_feature (493)..(494): n is a, c, g, or t
gggcgtggtggtgcgcgcctgtaatcccagctactcgggaggctgaggcaggacaatcgtttgaacccgggaggcggaggttgcagtgaggcaagatcacagcgctgcactccaatctgggtgacagagcgagatttcgtctcaaaaaataataataataatcaatgaaaatgaaaactcgccgggcgtggtggctcatgcctgtaatcccagcactttgggaggccgagacaggcagatcacaaggtccagatatcgagaccatcctggctaacacggtgaaaccccatctctactaaaaatacaaaaaattagccgggcgtggtggtgcgcgcctgtaatcccagctactcgggaggctgangcaggagaatcacttgaacccgggagatggaggttgcagtgagtcaagatcgcaccactgcactccagcctggggcaaaaggagtgaaaactttgtcttcaaataaattaataataattaatattacann

SEQ ID NO: 634299 - DNA, 368 bp, Homo sapiens
  misc_feature (350)..(350): n is a, c, g, or t
gaggcctggacggagctgggtctgggcatggctcaggctcgctggtgggccaccttcgctagctatgtgattggcctggggctgcttctcctggcactgctgtgtgtctggcggctggaggaggggccggggaagctgccatactgctctggacccccagtgtagggctggtgctgtgggcaggtgcattctacctcttccacgtacaggagatcaatgacttatatagggcccaggctgaaaaccagaatgtgctaggaagagagcacaggacagccagaatctgagacacagaacctcagcaagcccaaaacatagaggccgcaggaggaaaaaaaaataaagaaacntaaaaataggaactttaa

SEQ ID NO: 634300 - DNA, 85 bp, Homo sapiens
ccccccccctgctccccccccctttttttttttagagggggcctttttgtgtcccccaggggggaatacagtgccctgttcttta

SEQ ID NO: 634301 - DNA, 949 bp, Homo sapiens
aaattaagtgaggaattgagtggtggtagattgaagccaaaacctattgatgtacaagtcattacacaccacatgcagcgatatgcagtttggtttggaggatcaatgctggcttccacgcctgagttctaccaagtatgccacaccaaaaaggattatgaacgaaattggacctagcatttgtcgtcacaatccagtgtttggagtcatgtcgtacacacttggccttcactacgttattggggttagaggaggtggggacagacgactacagtcttatctgattacctgtattagatctggatgggctggtacatgagcgatttgaaaacctgaccttgaccagtagataacaccaaaacatgattgatacaggacatattcttaatacacagtgtatcaccatgcagatgtagaagagacgcgacagtgattgtgtagaacacttgtagattgcacctcttttgaactctctatgtgtaaccgaaaacagaaggtggggtgacaacgtaacttatctgtgccctgaatactatctgtactattgacatgaaattatccacagcttccgcatggcgatctcatcacgatgtgtagcatagctcgtagtacatcgccttgacattcgcaccaacttcctcaaggttgttgccaggtggccaagacagacttggatccactacttctcacatcacgtatacaataccttatcgcagggaaaaaaagcaagtcacaaacagaagcgcagcaccggcaaaatagcggcgggcggcaaagagaacaccaatgcagacccaaaagcaaaacgggcaaacacaacgccagaaagaaaaaaacgaacagtcaatgaagaaaacggagaataacagacgcagaaggaaagacaccaaaggacagttaaatggacgacggcgacacaaaccaccatacgcacgacccgcacgcccca

SEQ ID NO: 634302 - DNA, 1240 bp, Homo sapiens
ggccagccgcgcacgccatgggagccgatgacatgacgacgaagttatacaggaagctgtctcctcattgatggagatggtgcttggagatgatcggagaattaatcttgctagatgaagagttacattaaatggtgcaactctggagtcccaggaagagggatatagccagtaccaacgtatgctgagcacgctgactcaatagtgaatatacaatgggcaacactttactagtatatgatatgaatctcagaagaaatggaaaatatgaaaaaatttacaaggacctagaatgtagacatagactggagacacatgaaaaaattgctgagtgcaaaaagcaaattcttcaagcaaaacgaatacgacaaaatcgacaagaatatgatgcataggcacagtgatacagcaccatccagacaggcatgagacattcaaggaactagaggctctgggacaagaatagagcatctttcacacattaacgaaagtgtagaagataagctggaattgagacggaaaacagtaacatgtacttcattaataacatccatgaaacttcagacacaccattggcaccatgaatgacaaaatctcagcaggtcagaaagacagcatcaggaaagcgaagcgatggcacacacgaaccaacgaccaacagacacaggacaagatgcccacacaaaacccaggaacatacaggacacacggcatcaaatgaccaacaacggctcaacaatgaggacatgcacaggaaaaaacacaggtacgcgcagaaaaccacaggaaaaagacaagacggaaataaatcatcttacactctacgcacagacatgacatcactatcgaatatgctaatatacaacataatactaatataaatgtaaggaactcacaacacaaagaataaacacaatcacgcaagaaaagaaatcaagttgagcaaacacacactcaaaataacatccatatgtgaccaacaacaatataatacataagcaaagcaactgaatatagatgacaacaacaaccatacattacaatacatacaaacaaacaacaactcacaaaacaacctaacacatataatgtcaagtcaataacctcctatatccataaagtaaaaagaacaaaaaatataacatatcaagcaaaataaagatagacataaacaacactgcaataataaaaaataaataagagaaaaatacaacaataacaaacatataacattacaaat

SEQ ID NO: 634303 - DNA, 271 bp, Homo sapiens
ggccccccccccccccgtttttgggcttttttgggggggaaaaaaaaaaaataaagggttttgaaattgtttttggggggaattttcggggacccccccccccttggggtatgggtttggcccccccgactccggggggttcaggaacccccggggggggtttcgcccggccctttttctccaggggtttggggttcccccccccccccccctggggggggggaaaaaaataaaggcgggtgggggggccccttttttttttttttaggga

SEQ ID NO: 634304 - DNA, 817 bp, Homo sapiens
  misc_feature (101)..(101): n is a, c, g, or t
  misc_feature (156)..(156): n is a, c, g, or t
  misc_feature (258)..(258): n is a, c, g, or t
  misc_feature (266)..(266): n is a, c, g, or t
  misc_feature (272)..(272): n is a, c, g, or t
  misc_feature (296)..(296): n is a, c, g, or t
  misc_feature (332)..(332): n is a, c, g, or t
  misc_feature (337)..(337): n is a, c, g, or t
  misc_feature (378)..(378): n is a, c, g, or t
  misc_feature (383)..(383): n is a, c, g, or t
  misc_feature (399)..(399): n is a, c, g, or t
gcacagatgtagttgactctgcgcgtgtgcgttttccctcctcccccgcctcagggtccacggccaccatggcgtattaggggcagcagtgcctgcggagnattggcctttgcagcggggcagcagaccaggctctgcaggggaacccccagcggnttaagccatggcgcttctcgacggcattcagcagcagcgttgctgtaaccgacaaagacaccttcgaattaagcacattcctcgattccagcaaagcaccgnaatatgancgaaantgagcttcctgagcagcgaggtgntggtgggggacttgatgtccccctttcgacccgtcngggtntgggggctgaagaaagcctaggtctcttagatgattcaccntgganggtggccaagcacttncaaacctcatgggttctccagcgacaaaggctaaggcgggctcctccgaatggctggctgtggatgggtgcgtcagtccctccaacaacagcaaggaggatgccttctccgggacagatggatgtggagaacctggattgaacggagttcgacttggatgccctgtcgggtatagatgacctggaaaccatgccagatgactttctgaccacgttggatgacaccttgtgcatctctttgcccccctaagtcgaggggactattaagcagccccccagaggtgaaccctattgggcatctccagaaagtttaacaagacccgacaggtttgccccttcaccttttaaagctcttcccctttcccggggcgggctccacccagaaactcctttattagaacggccggcagggatcccag

SEQ ID NO: 634305 - DNA, 873 bp, Homo sapiens
ggcttcccgctcccgctgggcgcccctggcacttcctgaggctgggcccagtgtgggggatccgggagggtgcagttcgggatcagcgaaggcatgccccggaatgggcgggcggagcctggtcgagtggtcgcacacatcttagttcggaaccctgtgcctggtgtggcagatgggtgccctaggggacgccgaaggacagccagcatttctccgtagagcgttatcaccgagacccggggtgctccccctcatcagtcttccatccgttaccccaacttggacatacaagaatcaacctagtgacagagctgaatgaacctcgtctccacatgaagatcgaaatctcctctctgtggcactacaagactgtgcgttggtgccaggcgatcttccatggaggagtcattagcagacatagacgcagaaaaccatggctgatggaaacgaaaacgaaatttggagaaagttcaacgcttaccgggagaaagacttgagaacggagcctggagaccagtattgcacatgcatgtccatgatcatcctgacttgacaaggtacctagaatcaccgacactgcacctagcataatccaagtacttgacgacgcacacggatgctattacacccttgaacacctgacaggggtcgattacctacacagcacacattacgcaccacgacagctcagcacaccctggcacacgcacagcaaacaacccaagcacggcgacaaccacacagcccccaccacacagacatgcacctaccaaaaggaccagcaccataaggcaaaactcgaacacaaaaccagcaagcactgacaacccccaacgacaatccccaaatcccgaacatgagaaccctgagaac

SEQ ID NO: 634306 - DNA, 599 bp, Homo sapiens
  misc_feature (349)..(349): n is a, c, g, or t
  misc_feature (362)..(362): n is a, c, g, or t
ttatttgcatattaaaaaaatcgtgcattccaataattaaaatcatttgaacaaaaaaaaaaagggcactctgattaaactgctttacagcctgcaggacacctgtgggccagctgggattttactcttagaattttcacgtggtcgctcccaccccactttctttccagccccaactttcttcctttcaccaaacatgtgcaagttctctttcctttccctgtgcctagccagaatagaatagaccagactgggaaacagggcagagcgcgggcctttccgttggtacagtcagtctctatggactggtgacaacgggggccagcaccaggctcattcttcaaacctntggatctccgaanccttccttttggcatttctttaccaacagggttcaaaccagggcttaaacaagaaggttacacaacttaagaaggggcaagtgcatgtggtggcaactgctaccaggtgcactactgtggcggggcgacagcgccttcattctacagaattgcgccgtgcttgtgcgttcctccgtggtctcaagtcgggtttccttgtggaacggcacggtggaattttacctctttggcgctcct

SEQ ID NO: 634307 - DNA, 243 bp, Homo sapiens
tcggtaccaatgatggtcacggtcctaccggtgtcttatgtcgggcaaacggtctctgctcttacccggagaatccagctgggctagaggctgagcaccttgggaaacaacatttaagggaatgtgagcacaatgcataagtgtcttgaagaagcatgtagtgatgtacacatttggtaacttaccttttttgtggttttgtagcaaccattggtaaaacattccaaataattccacaggcct

SEQ ID NO: 634308 - DNA, 588 bp, Homo sapiens
  misc_feature (291)..(291): n is a, c, g, or t
aaaatataccaagcatatatagcaaggactaagccgctttaccttctgcatctgaattacctagtaatttactttgcaatggagagcccaagactagtgacccccgaaaccagaggagctatcttacaacagcttaatgagcacacccgtctatgtaggcataatattgcgaagatctatgggtggaggcgagaaacctactgagcctgtgttattcctggtctcttccttgtataatattagttcaactttaaatttgcccacagaaccctctaaatccccttgtaaatntaactgttagtccaaagaggaacagctctttggacactaggaaaaaaccttgtagagagagtaaaaaacttaacacccatagtaggcctaaaagcagccaccaattaagaaagcgttcaagctcaacacccaccacctaaaaaatcccaaacatataactgaactcctcacacctaattggaccaatctatcaccctatagaagaactaatgttagtataagtaacatgaaaacattctcctccgcataagcctgcgtcagattaaaacactgaactgacaattaacagcccaatat

SEQ ID NO: 634309 - DNA, 327 bp, Homo sapiens
tgcttggcatagttgattcctgagtaacccattctacactggttcaaaaacgagatctcgtacagtgtctgcatgtctgtgtgtaccttgtgatggtattattatttggcctatataacactggttactcctactccaagatctggaggcgtgatttcattcattgcaatgaatcaatacatcttttgtgtcaaaatgtttgaaacaaaagacatagatggtagacttttattaaaacatatattgatgtggaaagcacatatattaatgcagtcatcccttttcaggtgggaagagagcaaaccagttgattttttaattcatcct

SEQ ID NO: 634310 - DNA, 875 bp, Homo sapiens
  misc_feature (350)..(350): n is a, c, g, or t
  misc_feature (359)..(359): n is a, c, g, or t
  misc_feature (361)..(361): n is a, c, g, or t
  misc_feature (386)..(386): n is a, c, g, or t
  misc_feature (405)..(406): n is a, c, g, or t
  misc_feature (427)..(427): n is a, c, g, or t
  misc_feature (479)..(479): n is a, c, g, or t
  misc_feature (518)..(518): n is a, c, g, or t
accgacagcctgagttgggacagccctggagctggacagacccagccatcatcacaggtattccagcgtcttcaggaaacagtttagactctcttcaagatgacaatccgtccacactggctaaaatcccttcaggccctcacagagatggacggcccagcgctgttccatcacgagatccagccacagcgcccccttcagcacacagatcccgctgcacagagccagtgggaatccctaccctcctccttcaaacccttccagcttccactccccaccccaggtttcagacggcttcagacccccagaaaaaccccacagatttactacagagttcaacactggaccgncattaggcnanagaggagcaaccattagaaaatgcnggattgtcccactctgttnnctccctctcagccaccaccanagtcccttctcatctcttatgttctgaagaatccagtacctgatcaattttntttctccctaaccccagatgcaatgcgatcacagggtcnttaccatctctttattaatggtaaaaattttagtggatccagcattttgagtgacactgtgtgaatgtttctaaagaatgcctttttaaggagagaaaagaaaatcaaagggcagtctcaagtacttagaaaatagtgtgtctgtgcgcagtaatagtgacataagtctgcttagcagaaaaaggacgattaatctataggaaaagctcagtaatgcattatcaactgagaagtttgaaaccagtctttctgggatgcaagctggggaacaagggcgacaccacgtttggcaaatatggggaagcggctaaaaatattttggcgagggaggggggtttcccatgggttgggagatca

SEQ ID NO: 634311 - DNA, 411 bp, Homo sapiens
tccttaaatatcagctataggctatactattataaatattgttattcactcaacactagagcacccagatacataaacaaatattacagctaagagagagagaggcgttaatacattaatagatggaggcttcaacactccacttcagcattggacagatcagatcatccagacaaaattaacgaagaaacatcaaacttaatctgcactgtagaccaaatggatttaatagatatttctagaacatttcatctgatggctgcagaatttacattgttctctttagcacatggatcgccctcaaggttagaccatatgttaggccacaaaataagtcattaaaaattgaaaccttgatactaaaagcagacaaagacacgtcaaagaaagaatactacaggccaatgtctc

SEQ ID NO: 634312 - DNA, 309 bp, Homo sapiens
  misc_feature (14)..(14): n is a, c, g, or t
ccaagcggccgttntctaatcttgtcttcctgaggatagatagactagctcggcgctccttagtgaccttaggccgtatgcagtgagtgatattcatcagcagcatatccactgagcacagtcacgcttcccctgcgcaccggcagggaaagcactggttccgacacccgaataggcttggacctgccatggagggtgcccggcagatgtggtgcgagagagatggctcatgaggcttggacctgccgtgaagtggtgcccagcagcacgtggtattagagggttaagggcctcccggaggattaaggg

SEQ ID NO: 634313 - DNA, 590 bp, Homo sapiens
ctccttctccccccaaaaaaaaagaaggggttctcctccttcgggggggagggggggcgccccccccccccctccgccgggggggggggggtttttttctccccccccacaaaaaaaaaaaaaagaggtgctctcctccccccaaaagaatttcccccccgcggggttttttctctcccccccaccggggggtttttttttcccccccaacccaaaaatattttgtttttgcccccccaaaaaaaatatttttttttttcccgcgccgttctttttttttttcacgggaaggtttaaaaaaacaagttgggccccccctcttttttgtttttttttcgcccccccccaaaaaaggggggggggccccccccgggggggttttttttgtgggggaaaaaaataaaaagcccttttcgagattttcccccccaaaggtgctcaaaaaagaccccaaattttttttttaaataaatttgggggtttttccccaaaaggttttaattttttggaacctttgggcaaaccttcatggggtttttgaacgggccaacctttttttagaatgggttcataagtcttgccaagtctca

SEQ ID NO: 634314 - DNA, 605 bp, Homo sapiens
  misc_feature (121)..(121): n is a, c, g, or t
  misc_feature (128)..(128): n is a, c, g, or t
gatcccacacggttgagtcctgctgccctgacagactacgtgcaccatggcatgtcagttaatcactaaacattgcttttcccatcccatctgtgaaaagattggacaacatcatcttgtnttcctcntttagatgaagatacttggatatggacagaactcgaatgtagtgagagaagagactcacgtagtcgaaatcatggtctagaatttgggctgtagtgcgatagaagagctgaactatggtagtctagtgtatttccctcttgaggcttccataactggcctggttgatttttctaggtcatttgggagcctgaattctcttgataaacatgcttttgataatatggtacaacctcactgtacaggcagtcctttgaacggcagttggcagaggtaaaaatggccatgcaaaaaactacccaaagtgctgggattacaggcgtgagccaccgcgcccggcccacatgaaacgttttacatttatcacttaggtaatattaatggtatagtgaagctctagtctctgactgtagatgcctggaaaatgtctttgagtaatgagaaactcagaaaaaattgatgaaagaatatgttttctg

SEQ ID NO: 634315 - DNA, 343 bp, Homo sapiens
gacatacttttatcctccgaacgtttttgcccggctgggctaatgttttgagcggttactccgacagctaatgcaccgcctggatgggaacgaagaactccgtgatggaagcacacgtataaagctgcaagcacgttacagcattgtacagttgacccgtgacaaactagatgccacatacaggagttttcacgtatgatgcccaaacagagtgaacattaaacacaccgagtccactcctcaagttggatcacttaatgtccctttcagatcctgcgtatatctctctaaataatcgcttttcccattacccccatagacatctagacactgcatcagcctt

SEQ ID NO: 634316 - DNA, 1503 bp, Homo sapiens
aacaaatatgaaattaagaacagctttggacagagggtttactttgcagcggaagactactgattgctgtacccgaaattgctgtgggccatctagaccttttacccttgacggattattgactcactatgggtcacagaacgtcataacctctggagacgaccactaagatgtagcagactgtagtagtccctgctgactatcaggagatagaactccaagctcctcctggtgtaccaactaggtcactgttattcagcacttggcagccatgtctaacaaagtttacaattcaaacatgagacaccgcgaggcatgtacgtacacatacagtggtccactgtgttgtagtgcacgctgcatgtgcacgatgtagactcttgacgattaaatctcttgactgaacagtgtgtggcttggcaaacatatccaagcactggactggaaatcatgacgagacgcatttacagacgctgatacctttggactccacttcccttaagaccctgatggttcaccatgaaagactgctattgattggtgcctggtcgcctcattggactcatgatatggaagcccctggcagcacgacccacactcagcgtgggactcgcatcgggaagccctcaggaaattgacgctgcattgtgcgacatctaacctccgatgataacgcgaagcgtgtcctggtgcaacatggtccaacaccctccgcacggataagtcgggacttctctcgcccgcacgccaatggactacaactgtcaaggcgcttgccccccaacgccatttcttctttgccatattactatatagtgactgaaccctgacgagcagaaagcgcccagccccccaccacaacaacaaacgacacccgcagggaaagatggaagcagaaggaggagaggagaagagaaaagggcggagagaagcagagaacaagtaacgtgagggagagagccaggcacgcgggcccacgatgagccggccagcaggcgagacggcagacaacagtaaccgcgggcagcgacgagtgcacgacgagggaagatcaccgggcgcggctgcgctaggctcccgggccaccgggggaacgaacgcaacgcggccacagaagcacgcgacgcgagagcgccagaaagaccaagaagacgccagagggcggccaccgacacgcgaagacaagcaagagccggcaaaggagagggagagcgacaggcgagggaagccacccgagagagacgagacgcgaccgaaaggaggaagcaaaacgccaggaagaaaaagccgcaagcggaagaaagcgaaggagagagcgaagcggaaggaagagacagagcacaacccacacaggagcaaaccaacacacagcgacgagagaaaggaggaacgaacgaccagagactggaccacaacaaacacgctagacaaacacccgaacacaaacaaacaagcgcagaacgcaacaacgaacgaccaccacaacgaccgaggagcaaacac

SEQ ID NO: 634317 - DNA, 81 bp, Homo sapiens
ctagaagattcagcaaagtacttttgtgctcttggggaactccatctggtatactgggggagcttgacagcacaactcttc

SEQ ID NO: 634318 - DNA, 316 bp, Homo sapiens
catgaaccgaatggaataacacaacccctgacaaaccccagagacgaactaataaaaactgcgcacagaaggagatggagtatacaccttaaatgataagaagcaatggataaataaggctgttggagataaacttcctgaatgtgaagcagtatgtgggaagcccaagaatccgacaaacccagtgtagcgaacactggatgcgcacatggatgccaaagaacgttccacttggtaggctaagacgtcctccaccacaatgtaacaatgggtgtcacattgattcatgaccaatggctgatgcccacagctagag

SEQ ID NO: 634319 - DNA, 621 bp, Homo sapiens
  misc_feature (1)..(1): n is a, c, g, or t
ntgaataccttaggagctaaataattaaactcatggcacattgagaatatacggatgggtcccataggctacggagggtggctggagaagtgaggatggttcatgggcactaaaaaagtcgaaagaatggctgggtgcagtggctcgcgcctgtaatcccagcactttgggaggccgaggcaggcggatcacttgaggtcacgagttccagatcagcccaggcgacatggtgaaaccctgtctctactgaaaatacaaaattaggcgggcgtggtggcacacacctgtagtcccagctactggggaggctgaagcaggagaatcacttaaaccaggaaacagaggttgcagtgagccgagatcatgccaatgcactccagcctgggcgataagagggagactctgtctcaaaaaaataaataataataactaaaagaatatacttgggttgtttataaacacaaaggataaatgcttgaggggatggataccccttttaccctgatgtgcttattatgcattgtatccctgtataaaaacatctcatgtaactcataaatatatacacccattatgtacccacaaaaattaaaaatcaaaatacatttagaatttcttaaa

SEQ ID NO: 634320 - DNA, 1070 bp, Homo sapiens
  misc_feature (580)..(580): n is a, c, g, or t
  misc_feature (752)..(752): n is a, c, g, or t
cattcacttccctaacccctccacgccccaccccttcaaatatcaccgcattgattctcagaagcaaatgtcagacagacgcgagaatgacatgtctccaagcaacaatgtgcgctcctattcctgttccaccaattactagaaaacaatgccatgaggtcgcagtccctgtcattaaccattctacaggctatttttctctctctccccgtatcaatcgctcgagtataatgcctattttctctcaagtcctcgacgatttcaaattctatcttcgcactcctttctgtgttcattgttctcgctctctcatctacctaccatcacttactcaattctactgccatgattcatatcctctccccatccgactaacctcttataacatcccctcccacctcctaccctccttcacttgtactcctcgttctcttccaccattctattccctattacactctattcatattactccttatactgacttcccctattctatcttcttccttcccaatatctaacctcatattacgcaatttacgtctccaacaccttctctaccagcacaccaccgctactnctctatatttctcccacactacatcccctttatcttcttctccctcacttaccttcacatcgttgctaacgatacttactgattccccaaccatccccatcaaccaccatcacacctcctcgcctaccttcctaaacttaatacgacttcctttccctaattcaacctacantctacaaataccattcaatctactcgacctctgaaccaatgatctccgactatctacacctcctctccctatcaaaccttctcccgctcattccattcataaatatacaccttctttctataatacttaacctgttatgtaattctgacccgtcatactatatcccctcaattacaccctttactccactctctctatcactcctcctccactaccgcaccattcaatccaatcatacacgctcatctgttacttaccttatccacatctcttaatactccacacccctaccttatcttctcttcccctctcctctcg

SEQ ID NO: 634321 - DNA, 470 bp, Homo sapiens
taactttacagaaatacattgtaattggactttttgctttttttcatttctctaaaaatgtttctatatggtaccaatcgttcttctactgtttgctttattttcagtgtccatatcatagaagagtccatgttgtaaaagaagtcaaaagcagccttgaataattggaacccttctgccagattgtcttacatcatcttgttctttggcattgcttctaagttttcttcctcatcatcttgcactgatttggaagcactcgtctccatcaacaagtcatctgttaattcctatggtgtggggtttattagctcctgaatttctcttgaaacccttcacaccccacttttttttgccacatccacaatctctttcatgatttccttgattgactcttttgtaaatcctatgatgttttgcacaacatctgcacaggtttctccagccagaatttattgttttgggcttgt

SEQ ID NO: 634322 - DNA, 468 bp, Homo sapiens
ctgtaccccttgcgcactgcctctgaacactctggttgccggagccaactgcggctacgtctctaaatcccttggatcagccaagcgaaacttggagctattgacaaggaactttcctaggatagcgctgataaccaggacaaaagacaatcaagggtacacgcaggcatgcacgggttacctgcccagcgacggcttaagccagcccccgactggcctggccacagtgctctccagtagcacagatgtctgctcctcctcttgaacttgggtgtgaaatcccacccaaaaagcccctattgtacttaggcaataccccttccctgactcccgagggctagggctagagcagacccgggtaagtaacggctgacccatggctcctctagcctcatacccgttgcctcacagagccatgcccgggcactttgccctgtgtcttcatacttctacatgtctgcttgagat

SEQ ID NO: 634323 - DNA, 1881 bp, Homo sapiens
  misc_feature (314)..(314): n is a, c, g, or t
  misc_feature (548)..(548): n is a, c, g, or t
  misc_feature (1813)..(1813): n is a, c, g, or t
  misc_feature (1881)..(1881): n is a, c, g, or t
tgtggtttacaaggtttaaatcaaagctggtatataaaataacttaattccgggatcttctaaagggtttcttccttggtatttggccctttttccttttccatacttgggcgagaagatggggctttaccggtgtcagagggactcttttatgggcgggtcattggctgccagtttatacgccatagggaataaccacctatgtggatgggggtgagaaggcctatacggtgtggcacaagtgtgtggtgccaattatacgcctattatcccggcgtgtgacaccccgggtcaagaggtggtaacaatacacnatatatattcttccctgtggtacacaccctgtgggcaccatacttgtgtgcgcaacaatgtggcgtgtgcacacctttatatatacgtgtgtctcacacgcgtatacacaaccacgcgtcgaaacctctttacatatacacctcgcgcttgcgcgagaatgtgtgggacaacgtgtggatattccgaacacgcgtgtgtgagtaccttctgctgtgggtctctacacgaacctncgtgtgtcgggaacacaagaacgtggcgagcaaaagcacaccactcaaaacttccttctccacatttacggcaaaaaagtggggtcggagccaagacgtgggtgtctccacttttgccacaagagctgcgcacaattatgtggtggggcgacaaaattccgtggggggactactcgccgagaacgcgtgaaacaaacgttaccacacacacgaggggggacacttataaaaaccttccacacttacttgggggaacctcccaagaggggaccccctccgcgggggcacaccaatataccaaaaggccaaccggtgggtactatgtcggcctcttgggcgaccacaacatctacgagggtgaacactgcccccgtcgcccccacaaacgacagtcggcgcgactaaatcaccatacacttcacgacaaccagctgtggggcacacattacaacaactgcatacagcgcacacagatcaacagggggcgccattataaccacccaccagacggatcctcagctgtagcgcccagaaacaaaccatctgtggtggacgcagcggaatggtagaaacgacgagcatcgtcgcgacaacacgcatacagcaggccacacagtcgtgtggtcacaccacagaggcggaaacctattcacaaacgcaacgaagcgctaactatcgcaagacagcaaacaggacaaatcatggtcggcccaaaagagactacacacaatcccacggcgagtgagtccaacagatctgggtgcgcccaccaaacgaacaccacgacgaaaggaatgttgtccgcgcccgttctgactgattcccaccctcatgaggcagtcgccacgaaagcaaaggaaataggtgcaccccacaccgcaggacactgtggtaacaaccctccacgaggtgtgtcaatgaggacagaggcaaccacgtgtggtggaccacacgatacaacgctgtgacaacaagtgtgggcaccccgcaatgaaaaaaggagctttgaagccacagagaagaggattcacctgtggtgaaacacccaacgtggttttgtggctcaggaacaagcaaaacgccaacacaaggcaacccaggggtggatccaccacggggcggacacaggtgcaccacacacgggggttgcacacaaagtagcgacgtgtggcaaaccaaccgagaacgaaggtacgcagccacaacacaacacaacacaggaagcgcgagctagacacaaaggagcggaccggatactaggaganccgagaacacactacgacagacaagaaaccacaattgagtagacagacgacgagagaacaaaagagan

SEQ ID NO: 634324 - DNA, 167 bp, Homo sapiens
gccgaggtcgacgggtaagacttttccgccgcctccgccgaagacgccgccggatggcctacgtggcctcctacctctggctgccctaggggaacttcctccccagcgccaggacataaggaggtcttggacaactggtattcaggggacgagaccgcttacaaggt

SEQ ID NO: 634325 - DNA, 664 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccacaaaaaaaaaaaaaaaaaaaaaaaaaaaactttggtgggcgcggccttgggcccttggaaaaggttttctatagaaccattctcggttggggcgcgcgcgggggccacagtaggtgtacacggtggacactgtggggcctataacgcgggtgcccaaaggggagaacccggggccatatggaactaaggcgcggggggtattctccacaccaatataacaaaaaacgcgcccggggggggcaaaaccggagagggcgttttctggaaaccaaattcccgagagaggggcgagatccacgggagaggggcctataacgcgggatatctctattccaacagcgggagagtccccaaaagggagagaacggctctcagagattatctcaaaatttttaacgcccccgagccccccggggggggggggaacctggggcagacaatcacaaggaggagagtgcacggatagaaacaacacaagacgcagagcgacaacaacacgaggacaactagaataggcagcacagaagaggcacgaacagacag

SEQ ID NO: 634326 - DNA, 998 bp, Homo sapiens
gacatacgccgatagttactggatggacataagcccgaagtgtatatggtctttagaaaattgctgccactttacattctctcaggcgtcatcggactagctgtagatccatgatggacatttgtaactattctgacacacgattaggaagctagcatggttcttgttagactatttgcttgcgcaaagtcgcttggagtatcagcatggttgtgcagagatacgcaggctggtgggaagaaacatttttggattctcgaaatttacaagtttgttatccatcattggttggatgttcgatcggtgactggccagttattgaaaggagatcacgaggcgttaaggaaagatggatgaggagaaaataagaaatgggctttctcaagaagggcatcctcgggaggacattaacggacgatagatccctagttgagaaagaagactttatgtgcaatgaaggtcactcggacaagtgagctagttgttggtccgcctattatcgtactatgagagtcctatctatccatgcttgttaataactaactaagagatacttactgcatatgttttgtgccaggacaactcctgtgatagctaggttctgtagactctgaattgttgcaactagagctccttggccttttggggatgagactgttatcatgtcatacccaggcgatggctgtctacaagatgggggggcccgatatgtgtcgggttactggcctatgagtcgtatgctgtcaccagagtaacttagagtgggggcggcttgtctgacattctggtgcccgggttagttccggtgcccatctgaacctgagaattggacaactttcccagtgaaaaaattccggggcgaatagatcactgataagttaggcgcaacttgaaaggtcttttcgcccaacagcgtgcgacattggtctctcgccacacatccggttagtacaaaggtgttgtgcgattaacaccgggggggggaaatacattaagag

SEQ ID NO: 634327 - DNA, 767 bp, Homo sapiens
  misc_feature (10)..(10): n is a, c, g, or t
  misc_feature (14)..(14): n is a, c, g, or t
  misc_feature (16)..(16): n is a, c, g, or t
  misc_feature (48)..(48): n is a, c, g, or t
  misc_feature (74)..(74): n is a, c, g, or t
  misc_feature (77)..(77): n is a, c, g, or t
  misc_feature (83)..(83): n is a, c, g, or t
  misc_feature (91)..(91): n is a, c, g, or t
  misc_feature (138)..(138): n is a, c, g, or t
  misc_feature (142)..(142): n is a, c, g, or t
  misc_feature (153)..(153): n is a, c, g, or t
  misc_feature (160)..(160): n is a, c, g, or t
  misc_feature (269)..(270): n is a, c, g, or t
  misc_feature (272)..(274): n is a, c, g, or t
agcacgagantgtngngccaattgatggactgagtgagaaatacttcncgcacaatgtgagcagacaccatccnatnttctangagcccanataggacccaaaaaagcaaagaaaaggcactctcctggaatggggantctnctcttctccgngccccancatcagaactctaggctctctgacatttggactccaggctttataccagcaactccctagtttcccaccaaaacccaggttcctggcccttagcctcagactaagaatnntnnntcagcttcccagggaacttggacggagatacgttgcgggggccccccggtctccagcttccagatggcctgaaatagaaattttcaacctccataatcacatgagccaatttcccagtgaattctctctcatatatgtatatgtatccgattgtgtctgtctctctggagatccttgatttcaccacatcatccatgtgactccactggaagaagataccttaaagcttgcacttggtttctccaggatcctgctctttgtcgttttccctttggttaccttaatccgtacgttttactatcacgacctctgctcgtgaccgaacattaacatcggcgtagcttggcttcgggcgagagctctggactcgatccctctaaggacggtaacgcatgaccttgagcccggactcgagtgtgccggccgccccggtgcggcgcgggtcctcccttaatcctatgccgagttagggggcggccaggtaaaggtaaca

SEQ ID NO: 634328 - DNA, 424 bp, Homo sapiens
gtgctcgctcaggaggggtagaaatggctaggagagagtgagtaagatagatagtgtggtggagatagctggggagaggtagagggtggcataagaatgggaatgagaataagattgagtataaaagtaaagaatagaacttcatcagggtgaaagtattggagggtgccctgccagcaaagatcatctatccactctaagagggagttaagagtggcggtttggggatagcaccaggagatatcagctgcgatggcttggagaaacagtgtaaactggcagtataaacaagagtagggtatttatgagtagttgagaacggtgaataggagtgtgactagacagaagacagaagggatgaccagtttttggggcgcagtccaagtagtgggggtgactgcataaagccatggagtaaatggca

SEQ ID NO: 634329 - DNA, 293 bp, Homo sapiens
tcctccctttatctgtctgttgtttccctgtgctggagccacactgcctattgcactgatgttattaataaccctgcaccattcgtatgtcaattcttcctgctcttcttatccatcaaaaatcactttatctccacttgcttctttactcttccatataaatagatcatacaaccatcatgttcacaaaaaaagcctgatattatttacattggacttacatggaatttgtagaatttgaaaaaacagatattcttatgagtcttcctattcatacaagtagtatgactcca

SEQ ID NO: 634330 - DNA, 754 bp, Homo sapiens
taaaggctggttaatttaaagggctgatctatgtaatcccagaggccagtttgtccagacaaagggggaggttataattcctgggtctcttacctcctgggataaagtcttcgatggatctcctaccttactgggcctggaggcgctcttcagggcggctatgcgtagctatcctagggtcttaaaacctgggggcctcagccgggtcacgccaggagcttcttgcggggcctatgtactggccttacacctgtgggggatgtgtcccagtgagaaatccgctgtgtacttggaacacattccccttacaccttcaggttaccaggctgtgaataacactgttggcgaatcgatcttctattcagaatctcagcggaatactatctgaagcagcgcggcgcaaaatcctacattctcctcatccatgttgcaccttctcgatggcattcgggccatgggctgtacccttcacgtttacctatgcccatgtgcctgccctatccggggggccaagggtgttttcccgggaatcgagcccgggaaatggaccgtcacagagcttgcgaaatgatccagcccatcttgtgatgagcttccggatcttgctggacgggcagtgggcactgggcgatctgaacctgggtgccccatggccgacagcctggcgaagctgacagaggtgtgcctggcggtgctccgggaagcgcgctatcccaagaggctccggccacagaaggaggccaaggcgatgggg

SEQ ID NO: 634331 - DNA, 630 bp, Homo sapiens
atttggggcggggatttgtccccaccagacgggcccccctatgtaaagcgcctggttatctaaatacgggctgtccagaaggccattatcgcgtgcgtaagaacagggtcagatgagggcatctccccccgggggtaatagctgacgtatagcccccccggcagttaatatctggcggcgctggacttctgcgaggagaacacactcccctccttctcggttccaggaaaatgcgttacacagagttctgtggcgatctccggcagatgttcactggggtccgccacggtcttcttctctacaaaaagagacaattgttcgttaggcagatgtattcaagaacagagaaggtgcaaggcaccgacttttgcgccaggggattcctctgccaataaaggccagttaggggcgtccaaatcgggcgacgagtcattgcaacgaggagggcgctcggcgccagcaagcctcacaccccggactgtggagcaccgacaatgttgcagagcagcctcattgcacggtaagtccgcgcgtcggccaggtctgacggcagatatcaaagccgatccctcccctttgtgagataaattaaatcttctttctaaaaaccagaaaaccccccacataaca

SEQ ID NO: 634332 - DNA, 428 bp, Homo sapiens
agatcgagaccatcctggctaacacggtgaaacccagtgtctactaaaaatacaaaaaattagctgggcgtggtggcgggcgcctgtagtcccagctacttgggaggctgaggcgtgaacccgggaggcggagcttgcagtgagccgagatggcgccgctgcactccagcctgggtgacagagcgaaactctatctccaaaaaaaaaaaaaaaaactttatgggaacagtcgcatatgtataatagcagatagaagactgatgttagagagtatttctatgctttcatctgaaaatgaagggcagggctgggcgtgaaggtgcaggcctgtaagcccagtactttgggagccaaggcaggcagatcacttgagtccaggagttccagagcaagcagcctgggtgacatggcgaaaccccgtgtctaca

SEQ ID NO: 634333 - DNA, 293 bp, Homo sapiens
tccctcttgtggatgtgtgaagcatagggcgtggcagccaccagaggcgggccagcagccgcggcggcctgcatcatcggcgtgggctgaggctggctggtgttggtcctgagctgctgcggaggacagggagcctatttgctcccctggtacttagccctgcttgcccagtgcacttgaatttggataacaggatactggatacatcttgaggtgcctagcacaggctaggtcccaatgtaggaatctagacggtatgtacggacgattgtactaggtggagctgtataagc

SEQ ID NO: 634334 - DNA, 260 bp, Homo sapiens
acgatgtcggtgatggggatgcctccaattttctttaacattatgcgtagatactagacaattttttatttttatttatttatttattttgagatggagtctcgctctttcacccaggccatagtgcagtggcacgatcttggctcattgcaacctccgtctccctggttcaagtgattctcctgcctcagcttcccgagtagcaggactacaggtgtgcaccaccatgcccaactaaattttagtgtttttggtttttt
